United States Patent 9,675,668 (MODIFIED POLYNUCLEOTIDES ENCODING HEPATITIS A VIRUS CELLULAR RECEPTOR 2) - sequence listing, part 16

SEQ ID NO: 32166 - DNA, 1635 bp, Artificial Sequence
  Description of Artificial Sequence: Synthetic coding sequence
atgtggctgaaggtgggcggcctgctgcggggcaccggcggccagctgggccagacagtgggctggccctgtggggccctgggccctggcccccaccgctggggcccctgtggcggctcctgggcccagaagttctaccaggacggccctggccggggcctgggggaggaggacatccggcgggcccgggaggcccggcccaggaagaccccccggccccagctgagtgacaggagccgggagaggaaggtgcctgccagccgcatcagccggctggccaactttggaggcctggccgtgggcctgggcctgggcgtgctggccgagatggccaagaagtccatgcctgggggccgcctgcagagcgagggcggcagcggcctggacagcagccccttcctgtctgaggccaatgctgagcgcatcgtgcagaccctgtgcaccgtgcggggggccgccctgaaggtgggccagatgctgagcatccaggacaacagcttcatcagcccccagctgcagcacatctttgagcgggtgcggcagagcgctgacttcatgccccgctggcagatgctgcgggtgctggaggaggagctgggccgggactggcaggccaaggtggccagcctggaggaggtgccctttgctgctgccagcatcggccaggtgcaccagggcctgctgagagatggaacagaggtggccgtgaagatccagtacccaggcatcgcccagagcatccagagtgatgtgcagaacctgctggccgtgctgaagatgtctgctgccctgcctgctggcctgtttgctgagcagagcctgcaggccctgcagcaggagctggcctgggagtgtgactaccgccgggaggccgcctgtgcccagaacttccggcagctgctggccaatgaccccttcttccgggtgcctgctgtggtgaaggagctgtgcaccaccagggtgctgggcatggagctggccggcggcgtgcccctggaccagtgccagggcctgagccaggacctgaggaaccagatctgcttccagctgctgaccctgtgcctgcgggagctgtttgagttccgcttcatgcagacagaccccaactgggccaacttcctgtatgatgccagcagccaccaggtgaccctgctggactttggagccagccgggagtttggaacagagttcacagaccactacatcgaggtggtgaaggctgctgctgatggagaccgggactgtgtgctgcagaagagccgggacctgaagttcctgactggatttgagaccaaggccttcagtgatgcccacgtggaggccgtgatgatcctgggggagccctttgccacccagggcccctatgactttggaagtggagaaacagcccggcgcatccaggacctgatccctgtgctgctgcggcaccggctgtgccccccacctgaggagacctacgccctgcacaggaagctggccggggccttcctggcctgtgcccacctgcgggcccacatcgcctgccgggacctcttccaggacacctaccaccgctactgggccagccggcagccagatgctgccacagctggcagcctgcccaccaagggggacagctgggtggaccccagctag

SEQ ID NO: 32167 - DNA, 1512 bp, Artificial Sequence; identical to SEQ ID NO: 32165
  Description of Artificial Sequence: Synthetic coding sequence

SEQ ID NO: 32168 - DNA, 1743 bp, Artificial Sequence
  Description of Artificial Sequence: Synthetic coding sequence
atgtggaggcctgtgcagctgtgccacttccacagcgccctgctgcaccggcggcagaagccctggcccagccctgctgtgttcttcagaagaaatgtgcggggcctgcccccacgcttcagcagccccacccccctgtggaggaaggtgctgagcacagctgtggtgggcgcccccctgctgctgggcgcccgctacgtgatggccgaggcccgggagaagaggaggatgaggctggtggtggatggcatgggccgcttcggccgcagcctgaaggtgggcctgcagatcagcctggactactggtggtgcaccaacgtggtgctgcggggcgtggaggagaacagccctggctacctggaggtgatgtctgcctgccaccagagagctgctgatgccctggtggccggggccatcagcaatggaggcctgtatgtgaagctgggccagggcctgtgcagcttcaaccacctgctgcccccagagtacaccaggaccctgcgggtgctggaggaccgggccctgaagaggggcttccaggaggtggatgagctgttcctggaggacttccaggccctgccccatgagctgttccaggagtttgactaccagcccatcgccgccgccagcctggcccaggtgcaccgggccaagctgcatgatggcacctctgtggccgtgaaggtgcagtacatcgacctgcgggacagatttgatggagacatccacaccctggagctgctgctgcggctggtggaggtgatgcaccccagctttggcttctcctgggtgctgcaggacctgaagggcaccctggcccaggagctggactttgaaaatgaaggaagaaatgctgagcgctgtgcccgggagctggcccacttcccctacgtggtggtgccccgggtgcactgggacaagagcagcaagagggtgctgacagctgacttctgtgccggctgcaaggtgaatgatgtggaggccatccgcagccagggcctggccgtgcatgacattgctgagaagctgatcaaggcctttgctgagcagatcttctacacaggcttcatccacagcgacccccaccctggaaatgtgctggtgaggaagggcccagatggcaaggccgagctggtgctgctggaccacggcctgtaccagttcctggaggagaaggacagagctgccctgtgccagctgtggagggccatcatcctgagagatgatgctgccatgagggcccacgccgccgccctgggcgtgcaggactacctgctgtttgctgagatgctgatgcagaggcctgtgcggctgggccagctgtggggcagccacctgctgagccgggaggaggccgcctacatggtggacatggcccgggagagatttgaagctgtgatggctgtgctgcgggagctgccccggcccatgctgctggtgctgaggaacatcaacacagtgcgggccatcaacgtggccctgggcgcccctgtggaccgctacttcctgatggccaagagagctgtgcggggctggagccggctggccggggccacctaccggggcgtgtatggcaccagcctgctgcggcatgccaaggtggtgtgggagatgctgaagtttgaggtggccctgcggctggagaccctggccatgaggctgacagccctgctggcccgggccctggtgcacctgagcctggtgcccccagctgaggagctgtaccagtacctggagacctag

SEQ ID NO: 32169 - DNA, 921 bp, Artificial Sequence
  Description of Artificial Sequence: Synthetic coding sequence
atggctgtggcccggctggccgctgtggccgcctgggtgccctgccgctcctggggctgggccgctgtgcccttcggcccccaccggggcctgtctgtgctgctggcccgcatcccccagagggccccccgctggctgcctgcctgccggcagaagaccagcctgtccttcctgaacagaccagacctgcccaacctggcctacaagaagctgaagggcaagagccctggcatcatcttcatccctggctacctgagctacatgaatggcaccaaggccctggccatcgaggagttctgcaagagcctgggccacgcctgcatccgctttgactacagcggcgtgggcagcagtgatggcaacagcgaggagagcaccctgggcaagtggaggaaggatgtgctgagcatcattgatgacctggctgatggcccccagatcctggtgggcagcagcctgggcggctggctgatgctgcatgctgccatcgcccggcctgagaaggtggtggccctgattggagtggccacagctgctgacaccctggtgaccaagttcaaccagctgcctgtggagctgaagaaggaggtggagatgaagggcgtgtggagcatgcccagcaagtacagcgaggagggcgtgtacaacgtgcagtacagcttcatcaaggaggccgagcaccactgcctgctgcacagccccatccctgtgaactgccccatccggctgctgcacggcatgaaggatgacatcgtgccctggcacacctccatgcaggtggccgacagagtgctgagcacagatgtggatgtgatcctgaggaagcacagcgaccacaggatgagggagaaggctgacatccagctgctggtgtacaccattgatgacctgattgacaagctgagcaccatcgtgaactag

SEQ ID NO: 32170 - DNA, 450 bp, Artificial Sequence
  Description of Artificial Sequence: Synthetic coding sequence
atgctgcacgccgccatcgcccggcctgagaaggtggtggccctgattggagtggccacagctgctgacaccctggtgaccaagttcaaccagctgcctgtggagctgaagaaggaggtggagatgaagggcgtgtggagcatgcccagcaagtacagcgaggagggcgtgtacaacgtgcagtacagcttcatcaaggaggccgagcaccactgcctgctgcacagccccatccctgtgaactgccccatccggctgctgcacggcatgaaggatgacatcgtgccctggcacacctccatgcaggtggccgacagagtgctgagcacagatgtggatgtgatcctgaggaagcacagcgaccacaggatgagggagaaggctgacatccagctgctggtgtacaccattgatgacctgattgacaagctgagcaccatcgtgaactag

SEQ ID NO: 32171 - DNA, 1407 bp, Artificial Sequence
  Description of Artificial Sequence: Synthetic coding sequence
atggccgccagcagcaacagcagcctgagcggcagctctgtgtccagtgatgctgaggagtaccagccccccatctggaagagctacctgtaccagctgcagcaggaggccccccggcccaagaggatcatctgcccccgggaggtggagaaccggcccaagtactacggccgggagttccacggcatcatcagccgggagcaggctgatgagctgctgggcggcgtggagggcgcctacatcctgcgggagagccagaggcagcccggctgctacaccctggccctgcgcttcggcaaccagaccctgaactaccgcctcttccatgatggcaagcactttgtgggggagaagagatttgagagcatccatgacctggtgacagatggcctcatcaccctgtacatcgagaccaaggctgctgagtacatcagcaagatgaccaccaaccccatctatgagcacatcggctacgccaccctgctgcgggagaaggtgtcccggcggctgagccgcagcaagaatgagcccaggaagaccaacgtgacccatgaggagcacacagctgtggagaagatcagcagcctggtgcggcgggccgccctgacccacaatgacaaccacttcaactatgagaagacccacaacttcaaggtgcacaccttccggggcccccactggtgtgagtactgtgccaacttcatgtggggcctgattgcccagggcgtgcgctgcagcgactgtggcctgaatgtgcacaagcagtgcagcaagcacgtgcccaatgactgccagcctgacctgaagaggatcaagaaggtgtactgctgtgacctgaccaccctggtgaaggcccacaacacccagaggcccatggtggtggacatctgcatccgggagattgaggcccggggcctgaagtctgagggcctgtacagagtgtctggcttcacagagcacattgaagatgtgaagatggcctttgacagagatggagagaaggctgacatcagcgccaacgtgtacccagacatcaacatcatcactggagccctgaagctgtacttccgggacctgcccatccctgtgatcacctatgacacctacagcaagttcattgatgctgccaagatcagcaatgctgatgagcggctggaggccgtgcatgaggtgctgatgctgctgcccccagcccactatgagaccctgcgctacctgatgatccacctgaagaaggtgaccatgaatgagaaggacaacttcatgaatgctgagaacctgggcatcgtgtttggccccaccctgatgaggcctcctgaggacagcaccctgaccaccctgcatgacatgagataccagaagctgattgtgcagatcctgattgaaaatgaagatgtgctcttctag

SEQ ID NO: 32172 - DNA, 438 bp, Artificial Sequence
  Description of Artificial Sequence: Synthetic coding sequence
atgagagctggccagcagctggcctccatgctgcgctggacccgggcctggaggctgccccgggagggcctgggcccccacggccccagctttgcccgggtgcctgtggcccccagcagcagcagcggcggccggggcggcgctgagccccggctgctggatggagaggccgccctgcctgctgtggtgttcctgcacggcctgtttggcagcaagaccaacttcaacagcatcgccaagatcctggcccagcagacaggccggcgggtgctgactgtggatgccaggaaccacggggacagcccccacagcccagacatgtcctatgagatcatgagccaggacctgcagcctgccccccacctgggcacagagggcctgcggcaggccctgtgtggccacgaggtgctgcagggctggagcgacctgcggctgtag

SEQ ID NO: 32173 - DNA, 777 bp, Artificial Sequence
  Description of Artificial Sequence: Synthetic coding sequence
atgagagctggccagcagctggcctccatgctgcgctggacccgggcctggaggctgccccgggagggcctgggcccccacggccccagctttgcccgggtgcctgtggcccccagcagcagcagcggcggccggggcggcgctgagccccggcccctgcccctgagctaccgcctgctggatggagaggccgccctgcctgctgtggtgttcctgcacggcctgtttggcagcaagaccaacttcaacagcatcgccaagatcctggcccagcagacaggaagaagagtgctgactgtggatgccagaaatcatggagacagcccccacagcccagacatgtcctatgagatcatgagccaggacctgcaggacctgctgccccagctgggcctggtgccctgtgtggtggtgggccacagcatgggcggcaagacagccatgctgctggccctgcagagggacatggctgtgcggcagcacctgctgaccaacctggtggaggtggatggccgctttgtgtggagggtgaacctggatgccctgacccagcacctggacaagatcctggccttcccccagaggcaggagagctacctgggccccaccctcttcctgctgggcggcaacagccagtttgtgcaccccagccaccaccctgagatcatgaggctcttcccccgggcccagatgcagacagtgcccaatgccggccactggattcatgctgaccggccccaggacttcatcgccgccatccggggcttcctggtgtag

SEQ ID NO: 32174 - DNA, 927 bp, Artificial Sequence
  Description of Artificial Sequence: Synthetic coding sequence
atgagagctggccagcagctggcctccatgctgcgctggacccgggcctggaggctgccccgggagggcctgggcccccacggccccagctttgcccgggtgcctgtggcccccagcagcagcagcggcggccggggcggcgctgagccccggctgctggatggagaggccgccctgcctgctgtggtgttcctgcacggcctgtttggcagcaagaccaacttcaacagcatcgccaagatcctggcccagcagacaggccggcgggtgctgactgtggatgccaggaaccacggggacagcccccacagcccagacatgtcctatgagatcatgagccaggacctgcaggacctgctgccccagctgggcctggtgccctgtgtggtggtgggccacagcatgggcggcaagacagccatgctgctggccctgcagaggcctgagctggtggagcggctgattgctgtggacatcagccctgtggagagcactggagtgagccactttgccacctacgtggccgccatgagggccatcaacattgctgatgagctgcccaggagccgggccaggaagctggctgatgagcagctgagcagcgtcatccaggacatggctgtgcggcagcacctgctgaccaacctggtggaggtggatggccgctttgtgtggagggtgaacctggatgccctgacccagcacctggacaagatcctggccttcccccagaggcaggagagctacctgggccccaccctcttcctgctgggcggcaacagccagtttgtgcaccccagccaccaccctgagatcatgaggctcttcccccgggcccagatgcagacagtgcccaatgccggccactggattcatgctgaccggccccaggacttcatcgccgccatccggggcttcctggtgtag

SEQ ID NO: 32175 - DNA, 1014 bp, Artificial Sequence
  Description of Artificial Sequence: Synthetic coding sequence
atggagaagtcctggatgctgtggaactttgtggagcgctggctgattgccctggcctcctggagctgggccctgtgccgcatcagcctgctgcccctcatcgtgaccttccacctgtatggaggcatcatcctgctgctgctgatcttcatcagcattgctggcatcctgtacaagttccaggatgtgctgctgtacttccctgagcagcccagcagcagccggctgtatgtgcccatgcccaccggcatcccccatgagaacatcttcatccgcaccaaggatggcatccggctgaacctgatcctgatccgctacacaggagacaacagcccctacagccccaccatcatctacttccatggaaatgccggcaacatcggccaccggctgcccaatgccctgctgatgctggtgaacctgaaggtgaacctgctgctggtggactaccggggctacggcaagtctgagggggaggccagcgaggagggcctgtacctggacagcgaggccgtgctggactatgtgatgaccaggccagacctggacaagaccaagatcttcctgtttggccgcagcctgggcggcgctgtggccatccacctggccagcgagaacagccaccgcatcagcgccatcatggtggagaacaccttcctgagcatcccccacatggccagcaccctcttctccttcttccccatgagatacctgcccctgtggtgctacaagaacaagttcctgagctacaggaagatcagccagtgcaggatgcccagcctcttcatcagcggcctgagtgaccagctgatcccccctgtgatgatgaagcagctgtatgagctgagccccagcaggaccaagaggctggccatcttcccagatggcacccacaatgacacctggcagtgccagggctacttcaccgccctggagcagttcatcaaggaggtggtgaagagccacagccctgaggagatggccaagaccagcagcaatgtgaccatcatctag

SEQ ID NO: 32176 - DNA, 816 bp, Artificial Sequence
  Description of Artificial Sequence: Synthetic coding sequence
atggtgggcgccctgtgtggctgctggttccggctgggcggggcccggcccctcatccccctgggccccaccgtggtgcagacctccatgagccgcagccaggtggccctgctgggcctgagcctgctgctgatgctgctgctgtatgtgggcctgcccggccccccagagcagaccagctgcctgtggggagaccccaacgtgacagtgctggccggcctgaccccaggcaacagccccatcttctaccgggaggtgctgcccctgaaccaggcccaccgggtggaggtggtgctgctgcacggcaaggccttcaacagccacacctgggagcagctgggcaccctgcagctgctgagccagaggggctacagagctgtggccctggacctgcccggcttcggcaacagcgcccccagcaaggaggccagcacagaagctggccgggccgccctgctggagcgggccctgcgggacctggaggtgcagaatgctgtgctggtgagccccagcctgagcggccactacgccctgcccttcctgatgaggggccaccaccagctgcacggctttgtgcccatcgcccccaccagcacccagaactacacccaggagcagttctgggccgtgaagacccccaccctcatcctgtatggagagctggaccacatcctggcccgggagagcctgcggcagctgcggcacctgcccaaccacagcgtggtgaagctgagaaatgccggccacgcctgctacctgcacaagccccaggacttccacctggtgctgctggccttcctggaccacctgccctag

SEQ ID NO: 32177 - DNA, 690 bp, Artificial Sequence
  Description of Artificial Sequence: Synthetic coding sequence
atgctgctgctgtatgtgggcctgcccggccccccagagcagaccagctgcctgtggggagaccccaacgtgacagtgctggccggcctgaccccaggcaacagccccatcttctaccgggaggtgctgcccctgaaccaggcccaccgggtggaggtggtgctgctgcacggcaaggccttcaacagccacacctgggagcagctgggcaccctgcagctgctgagccagaggggctacagagctgtggccctggacctgcctgtgcccggcagcagcaacagccctgccagcgccagccctgtggccgagatcacagaaaattccttctgggccgtgctggtgcgggacctggaggtgcagaatgctgtgctggtgagccccagcctgagcggccactacgccctgcccttcctgatgaggggccaccaccagctgcacggctttgtgcccatcgcccccaccagcacccagaactacacccaggagcagttctgggccgtgaagacccccaccctcatcctgtatggagagctggaccacatcctggcccgggagagcctgcggcagctgcggcacctgcccaaccacagcgtggtgaagctgagaaatgccggccacgcctgctacctgcacaagccccaggacttccacctggtgctgctggccttcctggaccacctgccctag

SEQ ID NO: 32178 - DNA, 618 bp, Artificial Sequence
  Description of Artificial Sequence: Synthetic coding sequence
atgctgctgctgtatgtgggcctgcccggccccccagagcagaccagctgcctgtggggagaccccaacgtgacagtgctggccggcctgaccccaggcaacagccccatcttctaccgggaggtgctgcccctgaaccaggcccaccgggtggaggtggtgctgctgcacggcaaggccttcaacagccacacctgggagcagctgggcaccctgcagctgctgagccagaggggctacagagctgtggccctggacctgcctgtgcccggcagcagcaacagccctgccagcgccagccctgtggccgagatcaccggctttgtgttcctgatgtgtgccagcgccagcggcccccagctgtttcctcccctgtggcccatcgcccccaccagcacccagaactacacccaggagcagttctgggccgtgaagacccccaccctcatcctgtatggagagctggaccacatcctggcccgggagagcctgcggcagctgcggcacctgcccaaccacagcgtggtgaagctgagaaatgccggccacgcctgctacctgcacaagccccaggacttccacctggtgctgctggccttcctggaccacctgccctag

SEQ ID NO: 32179 - DNA, 465 bp, Artificial Sequence
  Description of Artificial Sequence: Synthetic coding sequence
atgctgctgctgtatgtgggcctgcccggccccccagagcagaccagctgcctgtggggagaccccaacgtgacagtgctggccggcctgaccccaggcaacagccccatcttctaccgggaggtgctgcccctgaaccaggcccaccgggtggaggtggtgctgctgcacggcaaggccttcaacagccacacctgggagcagctgggcaccctgcagctgctgagccagaggggctacagagctgtggccctggacctgcctgtgctgggcttcggcaacagcgcccccagcaaggaggccagcacagaagctggccgggccgccctgctggagcgggccctgcgggacctggaggtgcagaatgctgtgctggtgagccccagcctgagcggccactacgccctgcccttcctgatgaggggccaccaccagctgcacggctttgtgcccatcgccccctag

SEQ ID NO: 32180 - DNA, 1014 bp, Artificial Sequence
  Description of Artificial Sequence: Synthetic coding sequence
atggacctggatgtggtgaacatgtttgtgattgctgggggcaccctggccatccccatcctggcctttgtggccagcttcctgctgtggcccagcgccctgatccgcatctactactggtactggaggaggaccctgggcatgcaggtgcgctacgtgcaccacgaggactaccagttctgctacagcttccggggccggcccggccacaagcccagcatcctgatgctgcacggcttcagcgcccacaaggacatgtggctgtctgtggtgaagttcctgcccaagaacctgcacctggtgtgtgtggacatgcctggccacgagggcaccaccaggagcagcctggatgacctgagcattgatggccaggtgaagaggatccaccagtttgtggagtgcctgaagctgaacaagaagcccttccacctggtgggcacctccatgggcggccaggtggccggcgtgtatgctgcctactaccccagtgatgtgagcagcctgtgcctggtgtgcccagctggcctgcagtacagcacagacaaccagtttgtgcagaggctgaaggagctgcagggcagcgctgctgtggagaagatccccctcatccccagcaccccagaggagatgtctgagatgctgcagctgtgcagctatgtgcgcttcaaggtgccccagcagatcctgcagggcctggtggatgtgcgcatcccccacaacaacttctacaggaagctgttcctggagatcgtgtctgagaagagccgctacagcctgcaccagaacatggacaagatcaaggtgcccacccagatcatctggggcaagcaggaccaggtgctggatgtgtctggagctgacatgctggccaagagcatcgccaactgccaggtggagctgctggagaactgtggccacagcgtggtgatggagcggcccaggaagacagccaagctgatcatcgacttcctggcctctgtgcacaacacagacaacaacaagaagctggactag

SEQ ID NO: 32181 - DNA, 678 bp, Artificial Sequence
  Description of Artificial Sequence: Synthetic coding sequence
atggacctggatgtggtgaacatgtttgtgattgctgggggcaccctggccatccccatcctggcctttgtggccagcttcctgctgtggcccagcgccctgatccgcatctactactggtactggaggaggaccctgggcatgcaggtgcgctacgtgcaccacgaggactaccagttctgctacagcttccggggccggcccggccacaagcccagcatcctgatgctgcacggcttcagcgcccacaaggacatgtggctgtctgtggtgaagttcctgcccaagaacctgcacctggtgtgtgtggacatgcctggccacgagggcaccaccaggagcagcctggatgacctgagcattgatggccaggtgaagaggatccaccagtttgtggagtgcctgaagctgaacaagaagcccttccacctggtgggcacctccatgggcggccaggtggccggcgtgtatgctgcctactaccccagtgatgtgagcagcctgtgcctggtgtgcccagctggcctgcagtacagcacagacaaccagtttgtgcagaggctgaaggagctgcagggcagcgctgctgtggagaagatccccctcatccccagcaccccagaggagatgtctgagatgctgcagctgtgcagctatgtgcgcttcaaggtgccctag

SEQ ID NO: 32182 - DNA, 1014 bp, Artificial Sequence; identical to SEQ ID NO: 32180
  Description of Artificial Sequence: Synthetic coding sequence

SEQ ID NO: 32183 - DNA, 522 bp, Artificial Sequence
  Description of Artificial Sequence: Synthetic coding sequence
atggacctggatgtggtgaacatgtttgtgattgctgggggcaccctggccatccccatcctggcctttgtggccagcttcctgctgtggcccagcgccctgatccgcatctactactggtactggaggaggaccctgggcatgcaggtgcgctacgtgcaccacgaggactaccagttctgctacagcttccggggccggcccggccacaagcccagcatcctgatgctgcacggcttcagcgcccacaaggacatgtggctgtctgtggtgaagttcctgcccaagaacctgcacctggtgtgtgtggacatgcctggccacgagggcaccaccaggagcagcctggatgacctgagcattgatggccaggtgaagaggatccaccagtttgtggagtgcctgaagctgaacaagaagcccttccacctggtgggcacctccatgggcggccaggtggccggcgtgtatgctgcctactaccccagtgatgtgagcagcctgtgcctggtgtgcccctag

SEQ ID NO: 32184 - DNA, 957 bp, Artificial Sequence
  Description of Artificial Sequence: Synthetic coding sequence
atggacctggatgtggtgaacatgtttgtgattgctgggggcaccctggccatccccatcctggcctttgtggccagcttcctgctgtggcccagcgccctgatccgcatctactactggtactggaggaggaccctgggcatgcaggtgcgctacgtgcaccacgaggactaccagttctgctacagcttccggggccggcccggccacaagcccagcatcctgatgctgcacggcttcagcgcccacaaggacatgtggctgtctgtggtgaagttcctgcccaagaacctgcacctggtgtgtgtggacatgcctggccacgagggcaccaccaggagcagcctggatgacctgagcattgatggccaggtgaagaggatccaccagtttgtggagtgcctgaagctgaacaagaagcccttccacctggtgggcacctccatgggcggccaggtggccggcgtgtatgctgcctactaccccagtgatgtgagcagcctgtgcctggtgtgcccagctggcctgcagtacagcacagacaaccagtttgtgcagaggctgaaggagctgcagggcagcgctgctgtggagaagatccccctcatccccagcaccccagaggagatgtctgagatgctgcagctgtgcagctatgtgcgcttcaaggtgccccagcagatcctgcagggcctggtggatgtgcgcatcccccacaacaacttctacaggaagctgttcctggagatcgtgtctgagaagagccgctacagcctgcaccagaacatggacaagatcaaggtgcccacccagatcatctggggcaagcaggaccaggtgctggatgtgtctggagcagatgtgggccaggtgaactgccagctgcccggcggggccagcggcaagctgtgggccctgagcagtgatggcaagccaggccggcagcccagcagctag

SEQ ID NO: 32185 - DNA, 1194 bp, Artificial Sequence
  Description of Artificial Sequence: Synthetic coding sequence
atggccctgctgcggggcgtgtttgtggtggccgccaagaggaccccatttggagcctacggcggcctgctgaaggacttcaccgccacagacctgtctgaatttgctgccaaggccgccctgtctgctgggaaggtgtccccagagaccgtggacagcgtcatcatgggaaatgtgctgcagagcagcagtgatgccatctacctggcccggcacgtgggcctgcgggtgggcatccccaaggagaccccagccctgaccatcaaccggctgtgtggcagcggcttccagagcatcgtgaatggctgccaggagatctgtgtgaaggaggccgaggtggtgctgtgtggcggcacagagagcatgagccaggccccctactgtgtgagaaatgtgcgcttcggcaccaagctgggcagtgacatcaagctggaggacagcctgtgggtgtccctgacagaccagcacgtgcagctgcccatggccatgacagctgagaacctggccgtgaagcacaagatcagccgggaggagtgtgacaagtatgccctgcagagccagcagcgctggaaggccgccaatgatgctggctacttcaatgatgagatggcccccatcgaggtgaagaccaagaagggcaagcagaccatgcaggtggatgagcacgcccggccccagaccaccctggagcagctgcagaagctgccccctgtgttcaagaaggatggcaccgtgacagctggaaatgccagcggcgtggctgatggagctggagctgtgatcatcgcctctgaagatgctgtgaagaagcacaacttcacccccctggccagaattgtgggctactttgtgtctggctgtgaccccagcatcatgggcatcggccctgtgcctgccatcagcggggccctgaagaaggccggcctgagcctgaaggacatggacctggtggaggtgaatgaggcctttgccccccagtacctggccgtggagaggagcctggacctggacatcagcaagaccaacgtgaatggaggagccatcgccctgggccaccccctgggcggcagcggcagccgcatcacagcccacctggtgcatgagctgcggaggagaggaggcaagtatgctgtgggcagcgcctgcattggaggcggccagggcattgctgtgatcatccagagcacagcctag

SEQ ID NO: 32186 - DNA, 378 bp, Artificial Sequence
  Description of Artificial Sequence: Synthetic coding sequence
atgcctggaagacatgtgtcccgggtgcgggccctgtacaagagggtgctgcagctgcaccgggtgctgcccccagacctgaagagcctgggggaccagtatgtgaaggatgagttccgccgccacaagacagtgggcagtgatgaggcccagcgcttcctgcaggagtgggaggtgtatgccacagccctgctgcagcaggccaatgaaaatcggcagaacagcacaggcaaggcctgcttcggcaccttcctgcctgaggagaagctgaatgacttcagagatgagcagatcggccagctgcaggagctgatgcaggaggccaccaagcccaaccggcagttcagcatcagcgagagcatgaagcccaagttctag

SEQ ID NO: 32187 - DNA, 1605 bp, Artificial Sequence
  Description of Artificial Sequence: Synthetic coding sequence
atgttccagttccacgccggctcctgggagagctggtgctgctgctgcctgatcccagctgaccggccctgggaccggggccagcactggcagctggagatggctgacaccaggtctgtgcatgagaccaggtttgaagctgctgtgaaggtgatccagagcctgcccaagaatggcagcttccagcccaccaatgagatgatgctgaagttctacagcttctacaagcaggccacagagggcccctgcaagctgagccggcccggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtgattggccccttctatgaaattgtggaggacaagaagagcggccgcagcagtgacatcacctctgtgcggctggagaagatcagcaagtgcctggaggacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccaggacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaatattggcaacatgcaggtggtggccgtggagggcaagggggaggtgaagcatggaggagaagatggaagaaacaacagcggggccccccaccgggagaagagaggaggagaaacagatgagttcagcaatgtgagaagaggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32188 - DNA, 1596 bp, Artificial Sequence
  Description of Artificial Sequence: Synthetic coding sequence
ttccacgccggctcctgggagagctggtgctgctgctgcctgatcccagctgaccggccctgggaccggggccagcactggcagctggagatggctgacaccaggtctgtgcatgagaccaggtttgaggccgctgtgaaggtgatccagagcctgcccaagaatggcagcttccagcccaccaatgagatgatgctgaagttctacagcttctacaagcaggccacagagggcccctgcaagctgagcaggcctggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcacctctgtgcggctggagaagatcagcaagtgcctggaggacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccaggacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaacatcggcaacatgcaggtggtggccgtggagggcaaaggagaggtgaagcacggcggagaagatggcaggaacaacagcggggccccccaccgggagaagaggggcggggagacagatgagttcagcaatgtgcggcggggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32189 - DNA, 1047 bp, Artificial Sequence
  Description of Artificial Sequence: Synthetic coding sequence
atgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcaccagtgacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaatattggcaacatgcaggtggtggccgtggagggcaagggggaggtgaagcatggaggagaagatggaagaaacaacagcggggccccccaccgggagaagagaggaggagaaacagatgagttcagcaatgtgagaagaggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32190 - DNA, 1251 bp, Artificial Sequence
  Description of Artificial Sequence: Synthetic coding sequence
atgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcaccagtgacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccaggacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaatattggcaacatgcaggtggtggccgtggagggcaagggggaggtgaagcatggaggagaagatggaagaaacaacagcggggccccccaccgggagaagagaggaggagaaacagatgagttcagcaatgtgagaagaggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32191 - DNA, 1473 bp, Artificial Sequence
  Description of Artificial Sequence: Synthetic coding sequence
atggctgacaccaggtctgtgcatgagaccaggtttgaggccgctgtgaaggtgatccagagcctgcccaagaatggcagcttccagcccaccaatgagatgatgctgaagttctacagcttctacaagcaggccacagagggcccctgcaagctgagcaggcctggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcaccagtgacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccaggacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaatattggcaacatgcaggtggtggccgtggagggcaagggggaggtgaagcatggaggagaagatggaagaaacaacagcggggccccccaccgggagaagagaggaggagaaacagatgagttcagcaatgtgagaagaggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32192 - DNA, 1578 bp, Artificial Sequence
  Description of Artificial Sequence: Synthetic coding sequence
atgctgttcctgtccttccacgccggctcctgggagagctggtgctgctgctgcctgatcccagctgaccggccctgggaccggggccagcactggcagctggagatggctgacaccaggtctgtgcatgagaccaggtttgaagctgctgtgaaggtgatccagagcctgcccaagaatggcagcttccagcccaccaatgagatgatgctgaagttctacagcttctacaagcaggccacagagggcccctgcaagctgagccggcccggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtgattggccccttctatgaaattgtggaggacaagaagagcggccgcagcagtgacatcaccagtgacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccaggacatcaatgatgaccacgtggaggatgtgacaggcatccagcacctgaccagtgacagcgacagcgaggtgtactgtgacagcatggagcagtttggccaggaggagagcctggacagcttcaccagcaacaacggccccttccagtactacctgggcggccacagcagccagcccatggagaacagcggcttccgggaggacatccaggtgcccccaggaaatggaaacatcggcaacatgcaggtggtggccgtggagggcaaaggagaggtgaagcacggcggagaagatggcaggaacaacagcggggccccccaccgggagaagaggggcggggagacagatgagttcagcaatgtgcggcggggccggggccacaggatgcagcacctgtctgagggcaccaagggccggcaggtgggcagcggaggagatggagagcgctggggcagtgaccggggcagccggggcagcctgaatgagcagatcgccctggtgctgatgaggctgcaggaggacatgcagaatgtgctgcagaggctgcagaagctggagaccctgacagccctgcaggccaagagcagcaccagcaccctgcagacagccccccagcccaccagccagaggcccagctggtggccctttgagatgagccctggggtgctgacctttgccatcatctggcccttcatcgcccagtggctggtgtacctgtactaccagaggagaagaaggaagctgaactag

SEQ ID NO: 32193 - DNA, 756 bp, Artificial Sequence
  Description of Artificial Sequence: Synthetic coding sequence
atggctgacaccaggtctgtgcatgagaccaggtttgaggccgctgtgaaggtgatccagagcctgcccaagaatggcagcttccagcccaccaatgagatgatgctgaagttctacagcttctacaagcaggccacagagggcccctgcaagctgagcaggcctggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcacctctgtgcggctggagaagatcagcaagtgcctggaggacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccactag

SEQ ID NO: 32194 - DNA, 885 bp, Artificial Sequence
  Description of Artificial Sequence: Synthetic coding sequence
atgcctggcccccccctgagcagcgcccggcatgccctgcccctgggctcctgggagagctggtgctgctgctgcctgatcccagctgaccggccctgggaccggggccagcactggcagctggagatggctgacaccaggtctgtgcatgagaccaggtttgaggccgctgtgaaggtgatccagagcctgcccaagaatggcagcttccagcccaccaatgagatgatgctgaagttctacagcttctacaagcaggccacagagggcccctgcaagctgagcaggcctggcttctgggaccccatcggccgctacaagtgggatgcctggagcagcctgggggacatgaccaaggaggaggccatgattgcctacgtggaggagatgaagaagatcatcgagaccatgcccatgacagagaaggtggaggagctgctgcgggtcatcggccccttctatgagatcgtggaggacaagaagagcggccgcagcagtgacatcacctctgtgcggctggagaagatcagcaagtgcctggaggacctgggcaatgtgctgaccagcaccccaaatgccaagacagtgaatggcaaggccgagagcagtgacagcggggctgagagcgaggaggaggaggcccaggaggaggtgaagggagctgagcagagcgacaatgacaagaagatgatgaagaagtctgctgaccacaagaacctggaggtgattgtgaccaacggctatgacaaggatggctttgtgcaggacatccagaatgacatccacgccagcagcagcctgaatggccgcagcacagaggaggtgaagcccattgatgagaacctgggccagacaggcaagtctgctgtgtgcatccaccagtag

SEQ ID NO: 32195 - DNA, 987 bp, Artificial Sequence
  Description of Artificial Sequence: Synthetic coding sequence
atggcccacagcaagcagcccagccacttccagagcctgatgctgctgcagtggcccctgagctacctggccatcttctggatcctgcagcccctgtttgtgtacctgctcttcaccagcctgtggcccctgcctgtgctgtactttgcctggctgttcctggactggaagaccccagagcggggcggccgccgcagcgcctgggtgaggaactggtgtgtgtggacccacatccgggactacttccccatcaccatcctgaagaccaaggacctgagccctgagcacaactacctgatgggcgtgcacccccacggcctgctgaccttcggggccttctgcaacttctgcacagaggccaccggcttcagcaagaccttccctggcatcaccccccacctggccaccctgtcctggttcttcaagatcccctttgtgcgggagtacctgatggccaagggcgtgtgcagcgtgtcccagcctgccatcaactacctgctgagccatggaactggaaacctggtgggcatcgtggtgggcggcgtgggggaggccctgcagagcgtgcccaacaccaccaccctcatcctgcagaagaggaaaggatttgtgaggacagccctgcagcacggggcccacctggtgcccaccttcaccttcggggagacagaggtgtatgaccaggtgctcttccacaaggacagcaggatgtacaagttccagagctgcttccgccgcatcttcggcttctactgctgcgtgttctacggccagagcttctgccagggcagcacaggcctgctgccctacagccggcccatcgtgacagtggtgggggagcccctgcccctgccccagatcgagaagcccagccaggagatggtggacaagtaccacgccctgtacatggatgccctgcacaagctgtttgaccagcacaagacccactacggctgcagcgagacccagaagctgttcttcctgtag

SEQ ID NO: 32196 - DNA, 1002 bp, Artificial Sequence
  Description of Artificial Sequence: Synthetic coding sequence
atgctgctgcccagcaagaaggacctgaagacagccctggatgtgtttgctgtgttccagtggagcttcagcgccctgctgatcaccaccaccgtgattgctgtgaacctgtacctggtggtgttcaccccctactggcctgtgacagtgctgatcctgacctggctggcctttgactggaagaccccccagaggggcggccgccgcttcacctgtgtgcgccactggaggctgtggaagcactacagcgactacttccccctgaagctgctgaagacccatgacatctgccccagcaggaactacatcctggtgtgccacccccacggcctgtttgcccacggctggtttggccactttgccacagaggccagcggcttcagcaagatcttccctggcatcaccccctacatcctgaccctgggcgccttcttctggatgcccttcctgcgggagtatgtgatgagcactggagcctgcagcgtgagccgcagcagcattgacttcctgctgacccacaagggcaccggcaacatggtgattgtggtgattggaggcctggctgaatgtcgctacagcctgcccggcagcagcaccctggtgctgaagaacagaagtggctttgtgaggatggccctgcagcacggcgtgcccctcatcccagcctatgcctttggagaaacagacctgtatgaccagcacatcttcacccctgggggctttgtgaaccgcttccagaagtggttccagagcatggtgcacatctacccctgtgccttctacggccggggcttcaccaagaacagctggggcctgctgccctacagcaggcctgtgaccaccatcgtgggggagcccctgcccatgcccaagattgagaaccccagccaggagatcgtggccaagtaccacaccctgtacattgatgccctgaggaagctgtttgaccagcacaagaccaagtttggcatcagcgagacccaggagctggagatcatctag

SEQ ID NO: 32197 - DNA, 2220 bp, Artificial Sequence
  Description of Artificial Sequence: Synthetic coding sequence
atgttcctgctgctggccctgctgacagagctgggccgcctgcaggcccacgagggcagcgagggcatcttcctgcacgtgacagtgcccaggaagatcaagagcaatgacagcgaggtgtctgagaggaagatgatctacatcatcaccattgatggccagccctacaccctgcacctgggcaagcagagcttcctgccccagaacttcctggtgtacacctacaatgagaccggcagcctgcacagcgtgagcccctacttcatgatgcactgccactaccagggctacgccgctgagttccccaacagctttgtgaccctgagcatctgcagcggcctgcggggcttcctgcagtttgagaacatctcctatggaattgagcctgtggagagcagcgccaggtttgagcacatcatctaccagatgaagaacaatgaccccaacgtgtccatcctggccgtgaactacagccacatctggcagaaggaccagccctacaaggtgcccctgaacagccagatcaagaacctgagcaagctgctgccccagtacctggagatctacatcatcgtggagaaggccctgtatgactacatgggcagcgagatgatggctgtgacccagaagatcgtgcaggtgattggcctggtgaacaccatgttcacccagttcaagctgaccgtcatcctgagcagcctggagctgtggagcaatgaaaaccagatcagcaccagcggagatgctgatgacatcctgcagcgcttcctggcctggaagagggactacctgatcctgcggccccatgacatcgcctacctgctggtgtacaggaagcaccccaagtatgtgggcgccaccttccctggcaccgtgtgcaacaagagctatgatgctggcatcgccatgtacccagatgccatcggcctggagggcttcagcgtcatcatcgcccagctgctgggcctgaatgtgggcctgacctatgatgacatcacccagtgcttctgcctgcgggccacctgcatcatgaaccacgaggccgtgtctgccagcggcaggaagatcttcagcaactgcagcatgcatgactaccgctactttgtgtccaagtttgagaccaagtgcctgcagaagctgagcaacctgcagcccctgcaccagaaccagcctgtgtgtggaaatggcatcctggagagcaatgaagaatgtgactgtggcaacaagaatgaatgccagttcaagaagtgctgtgactacaacacctgcaagctgaagggctctgtgaagtgtggcagcggcccctgctgcaccagcaaatgtgagctgagcattgctggcaccccctgcaggaagagcattgatcctgaatgtgacttcacagagtactgcaatggcaccagcagcaactgtgtgcctgacacctacgccctgaatggccgcctgtgcaagctgggcacagcctactgctacaacggccagtgccagaccacagacaaccagtgtgccaagatctttgggaagggggcccagggcgccccctttgcctgcttcaaggaggtgaacagcctgcacgagaggtctgagaactgtggcttcaagaacagccagcccctgccctgtgagaggaaggatgtgctgtgtgggaagctggcctgtgtgcagccccacaagaatgccaacaagagtgatgcccagagcacagtgtacagctacatccaggaccacgtgtgtgtgtccatcgccaccggcagctccatgagaagtgatggaacagacaatgcctacgtggctgatggcaccatgtgtggccctgagatgtactgtgtgaacaagacctgcaggaaggtgcacctgatgggctacaactgcaatgccaccaccaagtgcaagggcaagggcatctgcaacaactttggaaactgccagtgcttccctggccaccggcccccagactgcaagttccagtttggcagccctgggggcagcattgatgatggcaacttccagaagagcggggacttctacacagagaagggctacaacacccactggaacaactggttcatcctgtccttctgcatcttcctgcccttcttcatcgtgttcaccaccgtcatcttcaagagaaatgagatcagcaagagctgcaaccgggagaatgctgagtacaacagaaacagctctgtggtgtctgagagtgatgatgtgggccactag

SEQ ID NO: 32198 - DNA, 2148 bp, Artificial Sequence
  Description of Artificial Sequence: Synthetic coding sequence
atgttcctgctgctggccctgctgacagagctgggccgcctgcaggcccacgagggcagcgagggcatcttcctgcacgtgacagtgcccaggaagatcaagagcaatgacagcgaggtgtctgagaggaagatgatctacatcatcaccattgatggccagccctacaccctgcacctgggcaagcagagcttcctgccccagaacttcctggtgtacacctacaatgagaccggcagcctgcacagcgtgagcccctacttcatgatgcactgccactaccagggctacgccgctgagttccccaacagctttgtgaccctgagcatctgcagcggcctgcggggcttcctgcagtttgagaacatctcctatggaattgagcctgtggagagcagcgccaggtttgagcacatcatctaccagatgaagaacaatgaccccaacgtgtccatcctggccgtgaactacagccacatctggcagaaggaccagccctacaaggtgcccctgaacagccagatcaagaacctgagcaagctgctgccccagtacctggagatctacatcatcgtggagaaggccctgatgttcacccagttcaagctgaccgtcatcctgagcagcctggagctgtggagcaatgaaaaccagatcagcaccagcggagatgctgatgacatcctgcagcgcttcctggcctggaagagggactacctgatcctgcggccccatgacatcgcctacctgctggtgtacaggaagcaccccaagtatgtgggcgccaccttccctggcaccgtgtgcaacaagagctatgatgctggcatcgccatgtacccagatgccatcggcctggagggcttcagcgtcatcatcgcccagctgctgggcctgaatgtgggcctgacctatgatgacatcacccagtgcttctgcctgcgggccacctgcatcatgaaccacgaggccgtgtctgccagcggcaggaagatcttcagcaactgcagcatgcatgactaccgctactttgtgtccaagtttgagaccaagtgcctgcagaagctgagcaacctgcagcccctgcaccagaaccagcctgtgtgtggaaatggcatcctggagagcaatgaagaatgtgactgtggcaacaagaatgaatgccagttcaagaagtgctgtgactacaacacctgcaagctgaagggctctgtgaagtgtggcagcggcccctgctgcaccagcaaatgtgagctgagcattgctggcaccccctgcaggaagagcattgatcctgaatgtgacttcacagagtactgcaatggcaccagcagcaactgtgtgcctgacacctacgccctgaatggccgcctgtgcaagctgggcacagcctactgctacaacggccagtgccagaccacagacaaccagtgtgccaagatctttgggaagggggcccagggcgccccctttgcctgcttcaaggaggtgaacagcctgcacgagaggtctgagaactgtggcttcaagaacagccagcccctgccctgtgagaggaaggatgtgctgtgtgggaagctggcctgtgtgcagccccacaagaatgccaacaagagtgatgcccagagcacagtgtacagctacatccaggaccacgtgtgtgtgtccatcgccaccggcagctccatgagaagtgatggaacagacaatgcctacgtggctgatggcaccatgtgtggccctgagatgtactgtgtgaacaagacctgcaggaaggtgcacctgatgggctacaactgcaatgccaccaccaagtgcaagggcaagggcatctgcaacaactttggaaactgccagtgcttccctggccaccggcccccagactgcaagttccagtttggcagccctgggggcagcattgatgatggcaacttccagaagagcggggacttctacacagagaagggctacaacacccactggaacaactggttcatcctgtccttctgcatcttcctgcccttcttcatcgtgttcaccaccgtcatcttcaagagaaatgagatcagcaagagctgcaaccgggagaatgctgagtacaacagaaacagctctgtggtgtctgagagtgatgatgtgggccactag

SEQ ID NO: 32199 - DNA, 462 bp, Artificial Sequence
  Description of Artificial Sequence: Synthetic coding sequence
atgagaagtgatggaacagacaatgcctacgtggctgatggcaccatgtgtggccctgagatgtactgtgtgaacaagacctgcaggaaggtgcacctgatgggctacaactgcaatgccaccaccaagtgcaagggcaagggcatctgcaacaactttggaaactgccagtgcttccctggccaccggcccccagactgcaagttccagtttggcagccctgggggcagcattgatgatggcaacttccagaagagcggggacttctacacagagaagggctacaacacccactggaacaactggttcatcctgtccttctgcatcttcctgcccttcttcatcgtgttcaccaccgtcatcttcaagagaaatgagatcagcaagagctgcaaccgggagaatgctgagtacaacagaaacagctctgtggtgtctgagagtgatgatgtgggccactag

SEQ ID NO: 32200 - DNA, 549 bp, Artificial Sequence
  Description of Artificial Sequence: Synthetic coding sequence
atgttcctgctgctggccctgctgacagagctgggccgcctgcaggcccacgagggcagcgagggcatcttcctgcacgtgacagtgcccaggaagatcaagagcaatgacagcgaggtgtctgagaggaagatgatctacatcatcaccattgatggccagccctacaccctgcacctgggcaagcagagcttcctgccccagaacttcctggtgtacacctacaatgagaccggcagcctgcacagcgtgagcccctacttcatgatgcactgccactaccagggctacgccgctgagttccccaacagctttgtgaccctgagcatctgcagcggcctgcggggcttcctgcagtttgagaacatctcctatggaattgagcctgtggagagcagcgccaggtttgagcacatcatctaccagatgaagaacaatgaccccaacgtgtccatcctggccgtgaactacagccacatctggcagaaggaccagccctacaaggtgcccctgaacagccaggtgaccgtcatcatcctgatgctgtag

SEQ ID NO: 32201 - DNA, 2364 bp, Artificial Sequence
  Description of Artificial Sequence: Synthetic coding sequence
atgttccggctgtggctgctgctggccggcctgtgtggcctgctggccagcaggcctggcttccagaacagcctgctgcagatcgtcatccctgagaagatccagaccaacaccaatgacagcagcgagattgaatatgagcagatctcctacatcatccccattgatgagaagctgtacacagtgcacctgaagcagcgctacttcctggccgacaacttcatgatctacctgtacaaccagggctccatgaacacctacagcagtgacatccagacccagtgctactaccagggcaacatcgagggctacccagacagcatggtgaccctgagcacctgcagcggcctgcggggcatcctgcagtttgaaaatgtgtcctatggcatcgagcccctggagagcgctgtggagttccagcacgtgctgtacaagctgaagaatgaagataatgacatcgccatcttcatcgacaggagcctgaaggagcagcccatggatgacaacatcttcatcagcgagaagtctgagcctgctgtgcctgacctcttccccctgtacctggagatgcacatcgtggtggacaagaccctgtatgactactggggcagtgacagcatgattgtgaccaacaaggtgattgagatcgtgggcctggccaacagcatgttcacccagttcaaggtgaccatcgtgctgagcagcctggagctgtggagcgatgagaacaagatcagcacagtgggggaggctgatgagctgctgcagaagttcctggagtggaagcagagctacctgaacctgcggccccatgacatcgcctacctgctgatctacatggactacccccgctacctgggcgctgtgtttcctggcaccatgtgcatcacccgctacagcgctggggtggccctgtaccccaaggagatcaccctggaggcctttgctgtgattgtgacccagatgctggccctgagcctgggcatctcctatgatgaccccaagaagtgccagtgcagcgagagcacctgcatcatgaaccctgaggtggtgcagagcaatggagtgaagaccttcagcagctgcagcctgcggagcttccagaacttcatcagcaatgtgggcgtgaagtgcctgcagaacaagccccagatgcagaagaagagccccaagcctgtgtgtggaaatggccgcctggagggcaatgagatctgtgactgtggcacagaggcccagtgtggccctgccagctgctgtgacttccgcacctgtgtgctgaaggatggagccaagtgctacaagggcctgtgctgcaaggactgccagatcctgcagagcggcgtggagtgccggcccaaggcccacccagaatgtgacattgctgagaactgcaatggcaccagcccagaatgtggccctgacatcaccctcatcaatggcctgagctgcaagaacaacaagttcatctgctatgatggagactgccacgacctggatgcccgctgtgagagcgtgtttgggaagggcagcagaaatgccccctttgcctgctatgaggagatccagagccagagcgaccgcttcggcaactgtggccgggacaggaacaacaagtatgtgttctgtggctggaggaacctgatctgtggccgcctggtgtgcacctaccccaccaggaagcccttccaccaggagaatggagatgtgatctatgcctttgtgcgggacagcgtgtgcatcaccgtggactacaagctgcccaggacagtgcctgaccccctggccgtgaagaatggcagccagtgtgacatcggccgggtgtgtgtgaaccgggagtgtgtggagagccgcatcatcaaggccagcgcccacgtgtgcagccagcagtgcagcggccatggagtgtgtgacagcaggaacaagtgccactgcagccctggctacaagccacccaactgccagatccgcagcaagggcttcagcatcttccctgaggaggacatgggcagcatcatggagcgggccagcggcaagacagagaacacctggctgctgggcttcctgattgccctgcccatcctgattgtgaccacagccatcgtgctggccaggaagcagctgaagaagtggtttgccaaggaggaggagttccccagcagcgagagcaagtctgagggcagcacccagacctacgccagccagagcagcagcgagggcagcacccagacctacgccagccagaccaggtctgagagcagcagccaggccgacaccagcaagagcaagtctgaggacagcgctgaggcctacaccagccgcagcaagagccaggacagcacccagacccagagcagcagcaactag

SEQ ID NO: 32202 - DNA, 837 bp, Artificial Sequence
  Description of Artificial Sequence: Synthetic coding sequence
ttcaggaacctgctgaacaacgtgtccctgtgccaccctggctggagcgctgtggcccagagctggctgacagccaccagcgccagccaggtgcaggtgatcctgctgccccacccccccaactgctggctgggcctgcaggagcagatctcctacatcatccccattgatgagaagctgtacacagtgcacctgaagcagcgctacttcctggccgacaacttcatgatctacctgtacaaccagggctccatgaacacctacagcagtgacatccagacccagtgctactaccagggcaacatcgagggctacccagacagcatggtgaccctgagcacctgcagcggcctgcggggcatcctgcagtttgaaaatgtgtcctatggaattgagcccctggagagcgctgtggagttccagcacgtgctgtacaagctgaagaatgaagataatgacatcgccatcttcatcgacaggagcctgaaggagcagcccatggatgacaacatcttcatcagcgagaagtctgagcctgctgtgcctgacctcttccccctgtacctggagatgcacatcgtggtggacaagaccctgtatgactactggggcagtgacagcatgattgtgaccaacaaggtgattgaaattgtgggcctggccaacagcatgttcacccagttcaaggtgaccatcgtgctgagcagcctggagctgtggagcgatgagaacaagatcagcacagtgggggaggctgatgagctgctgcagaagttcctggagtggaagcagagctacctgaacctgcggccccatgacatcgcctacctgctgtag

SEQ ID NO: 32203 - DNA, 2358 bp, Artificial Sequence
  Description of Artificial Sequence: Synthetic coding sequence
atggtggtgcccagcctgaagctgcaggacctgattgaggagatccggggggccaagacccaggcccaggagcgggaggtgatccagaaggaatgtgcccacatccgggccagcttcagagatggagaccctgtgcaccgccaccggcagctggccaagctgctgtatgtgcacatgctgggctacccagcccacttcggccagatggagtgcctgaagctgattgccagcagccgcttcacagacaagagggtgggctacctgggcgccatgctgctgctggatgaaagacatgatgcccacctgctgatcaccaacagcatcaagaatgacctgagccagggcatccagcctgtgcagggcctggccctgtgcaccctgagcaccatgggcagcgctgagatgtgccgggacctggcccctgaggtggagaagctgctgctgcagcccagcccctacgtgaggaagaaggccatcctgacagctgtgcacatgatcaggaaggtgcctgagctgagcagcgtcttcctgcccccctgtgcccagctgctgcacgagcggcaccacggcatcctgctgggcaccatcaccctcatcacagagctgtgtgagaggagccctgctgccctgcggcacttcaggaaggtggtgccccagctggtgcacatcctgcggaccctggtgaccatgggctacagcacagagcacagcatctctggagtgtctgaccccttcctgcaggtgcagatcctgcggctgctgcgcatcctgggcagaaatcatgaggagagcagcgagaccatgaatgacctgctggcccaggtggccaccaacacagacaccagcagaaatgctggaaatgctgtgctgtttgaaacagtgctgaccatcatggacatccgctctgctgctggcctgcgggtgctggccgtgaacatcctgggccgcttcctgctgaacagcgacaggaacatccgctacgtggccctgaccagcctgctgcggctggtgcagagcgaccacagcgctgtgcagaggcaccggcccaccgtggtggagtgcctgcgggagacagatgccagcctgagccggcgggccctggagctgagcctggccctggtgaacagcagcaatgtgcgggccatgatgcaggagctgcaggccttcctggagagctgccccccagacctgcgggctgactgtgccagcggcatcctgctggccgctgagagatttgcccccaccaagcgctggcacatcgacaccatcctgcacgtgctgaccacagctggcacccacgtgagagatgatgctgtggccaacctgacccagctgattggaggagcccaggagctgcacgcctacagcgtgcggcggctgtacaatgccctggccgaggacatcagccagcagcccctggtgcaggtggccgcctggtgcattggagaatatggagacctgctgctggccggcaactgtgaggagattgagcccctgcaggtggatgaggaggaggtgctggccctgctggagaaggtgctgcagagccacatgagcctgcctgccacccggggctacgccctgacagccctgatgaagctgagcacccggctgtgtggggacaacaaccgcatccggcaggtggtgtccatctacggcagctgcctggatgtggagctgcagcagagagctgtggagtatgacaccctcttcagaaaatatgaccacatgagagctgccatcctggagaagatgcccctggtggagagagatggcccccaggctgatgaggaggccaaggagagcaaggaggccgcccagctgtctgaggccgcccctgtgcccacagagccccaggccagccagctgctggacctgctggacctgctggatggagccagcggagatgtgcagcaccccccccacctggaccccagccctggaggagccctggtgcacctgctggacctgccctgtgtgcccccacctccagcccccatcccagacctgaaggtgtttgagcgggagggcgtgcagctgaacctgtccttcatccggcccccagaaaatcctgccctgctgctgatcaccatcacagccaccaacttctctgaaggagatgtgacccacttcatctgccaggccgctgtgcccaagagcctgcagctgcagctgcaggcccccagcggcaacacagtgcctgcccggggcggcctgcccatcacccagctgttccgcatcctgaaccccaacaaggcccccctgcggctgaagctgcggctgacctatgaccacttccaccagagcgtgcaggagatctttgaggtgaacaacctgcctgtggagagctggcagtag

SEQ ID NO: 32204 - DNA, 2358 bp, Artificial Sequence; identical to SEQ ID NO: 32203
  Description of Artificial Sequence: Synthetic coding sequence

SEQ ID NO: 32205 - DNA, 1923 bp, Artificial Sequence
  Description of Artificial Sequence: Synthetic coding sequence
atggacagaagaattgagaacaggatgggcaccccagcccacagaagaagagtggtgcacacccaccgccacaccaggaaccggctgagctgcccctggcccccacccttcaccagccccaccctgaccccaggcatcctgctgggcaccatcaccctcatcacagagctgtgtgagaggagccctgctgccctgcggcacttcaggaaggtggtgccccagctggtgcacatcctgcggaccctggtgaccatgggctacagcacagagcacagcatcagcggcgtgtctgaccccttcctgcaggtgcagatcctgcggctgctgcgcatcctgggcaggaaccacgaggagagcagcgagaccatgaatgacctgctggcccaggtggccaccaacacagacaccagcagaaatgctggaaatgctgtgctgtttgagaccgtgctgaccatcatggacatccgctctgctgctggcctgcgggtgctggccgtgaacatcctgggccgcttcctgctgaacagcgacaggaacatccgctacgtggccctgaccagcctgctgcggctggtgcagagcgaccacagcgctgtgcagaggcaccggcccaccgtggtggagtgcctgcgggagacagatgccagcctgagcagaagagccctggagctgagcctggccctggtgaacagcagcaatgtgcgggccatgatgcaggagctgcaggccttcctggagagctgccccccagacctgcgggctgactgtgccagcggcatcctgctggccgctgagagatttgcccccaccaagcgctggcacatcgacaccatcctgcacgtgctgaccacagctggcacccacgtgagagatgatgctgtggccaacctgacccagctgattggaggagcccaggagctgcacgcctacagcgtgagaagactctacaatgccctggccgaggacatcagccagcagcccctggtgcaggtggccgcctggtgcatcggggagtatggagacctgctgctggccggcaactgtgaggagattgagcccctgcaggtggatgaggaggaggtgctggccctgctggagaaggtgctgcagagccacatgagcctgcctgccacccggggctacgccctgacagccctgatgaagctgagcacccggctgtgtggggacaacaaccgcatccggcaggtggtgtccatctacggcagctgcctggatgtggagctgcagcagagagctgtggagtatgacaccctcttcagaaaatatgaccacatgagagctgccatcctggagaagatgcccctggtggagagagatggcccccaggctgatgaggaggccaaggagagcaaggaggccgcccagctgtctgaggccgcccctgtgcccacagagccccaggccagccagctgctggacctgctggacctgctggatggagccagcggagatgtgcagcaccccccccacctggaccccagccctgggggcgccctggtgcacctgctggacctgccctgtgtgcccccacctccagcccccatcccagacctgaaggtgtttgagcgggagggcgtgcagctgaacctgtccttcatccggcccccagagaacccagccctgctgctgatcaccatcacagccaccaacttctctgaaggagatgtgacccacttcatctgccaggccgctgtgcccaagagcctgcagctgcagctgcaggcccccagcggcaacacagtgcctgcccggggcggcctgcccatcacccagctgttccgcatcctgaaccccaacaaggcccccctgcggctgaagctgcggctgacctatgaccacttccaccagagcgtgcaggagatctttgaggtgaacaacctgcctgtggagagctggcagtag

SEQ ID NO: 32206 - DNA, 1665 bp, Artificial Sequence
  Description of Artificial Sequence: Synthetic coding sequence
atgtctgtgaccatggtggtgccccagctggtgcacatcctgcggaccctggtgaccatgggctacagcacagagcacagcatctctggagtgtctgaccccttcctgcaggtgcagatcctgcggctgctgcgcatcctgggcagaaatcatgaggagagcagcgagaccatgaatgacctgactgtgctgaccatcatggacatccgctctgctgctggcctgcgggtgctggccgtgaacatcctgggccgcttcctgctgaacagcgacaggaacatccgctacgtggccctgaccagcctgctgcggctggtgcagagcgaccacagcgctgtgcagaggcaccggcccaccgtggtggagtgcctgcgggagacagatgccagcctgagcagaagagccctggagctgagcctggccctggtgaacagcagcaatgtgcgggccatgatgcaggagctgcaggccttcctggagagctgccccccagacctgcgggctgactgtgccagcggcatcctgctggccgctgagagatttgcccccaccaagcgctggcacatcgacaccatcctgcacgtgctgaccacagctggcacccacgtgagagatgatgctgtggccaacctgacccagctgattggaggagcccaggagctgcacgcctacagcgtgagaagactctacaatgccctggccgaggacatcagccagcagcccctggtgcaggtggccgcctggtgcatcggggagtatggagacctgctgctggccggcaactgtgaggagattgagcccctgcaggtggatgaggaggaggtgctggccctgctggagaaggtgctgcagagccacatgagcctgcctgccacccggggctacgccctgacagccctgatgaagctgagcacccggctgtgtggggacaacaaccgcatccggcaggtggtgtccatctacggcagctgcctggatgtggagctgcagcagagagctgtggagtatgacaccctcttcagaaaatatgaccacatgagagctgccatcctggagaagatgcccctggtggagagagatggcccccaggctgatgaggaggccaaggagagcaaggaggccgcccagctgtctgaggccgcccctgtgcccacagagccccaggccagccagctgctggacctgctggacctgctggatggagccagcggagatgtgcagcaccccccccacctggaccccagccctgggggcgccctggtgcacctgctggacctgccctgtgtgcccccacctccagcccccatcccagacctgaaggtgtttgagcgggagggcgtgcagctgaacctgtccttcatccggcccccagagaacccagccctgctgctgatcaccatcacagccaccaacttctctgaaggagatgtgacccacttcatctgccaggccgctgtgcccaagagcctgcagctgcagctgcaggcccccagcggcaacacagtgcctgcccggggcggcctgcccatcacccagctgttccgcatcctgaaccccaacaaggcccccctgcggctgaagctgcggctgacctatgaccacttccaccagagcgtgcaggagatctttgaggtgaacaacctgcctgtggagagctggcagtag

SEQ ID NO: 32207 - DNA, 414 bp, Artificial Sequence
  Description of Artificial Sequence: Synthetic coding sequence
atggtggtgcccagcctgaagctgcaggacctgattgaggagatccggggggccaagacccaggcccaggagcgggaggtgatccagaaggaatgtgcccacatccgggccagcttcagagatggagaccctgtgcaccgccaccggcagctggccaagctgctgtatgtgcacatgctgggctacccagcccacttcggccagatggagtgcctgaagctgattgccagcagccgcttcacagacaagagggtgggctacctgggcgccatgctgctgctggatgaaagacatgatgcccacctgctgatcaccaacagcatcaagaatgacctgagccagggcatccagcctgtgcagggcctggccctgtgcaccctgagcaccatgggcagcgctgagatgtgcaggtag

SEQ ID NO: 32208 - DNA, 603 bp, Artificial Sequence
  Description of Artificial Sequence: Synthetic coding sequence
atggtggtgcccagcctgaagctgcaggacctgattgaggagatccggggggccaagacccaggcccaggagcgggaggtgatccagaaggaatgtgcccacatccgggccagcttcagagatggagaccctgtgcaccgccaccggcagctggccaagctgctgtatgtgcacatgctgggctacccagcccacttcggccagatggagtgcctgaagctgattgccagcagccgcttcacagacaagagggtgggctacctgggcgccatgctgctgctggatgaaagacatgatgcccacctgctgatcaccaacagcatcaagaatgacctgagccagggcatccagcctgtgcagggcctggccctgtgcaccctgagcaccatgggcagcgctgagatgtgccgggacctggcccctgaggtggagaagctgctgctgcagcccagcccctacgtgaggaagaaggccatcctgacagctgtgcacatgatcaggaaggtgcctgagctgagcagcgtcttcctgcccccctgtgcccagctgctgcacgagcggcaccacggcatcctgctgggcaccatcaccctcatcacctag

SEQ ID NO: 32209 - DNA, 465 bp, Artificial Sequence
  Description of Artificial Sequence: Synthetic coding sequence
atgatccacttcatcctgctcttcagccggcagggcaagctgcggctgcagaagtggtacatcaccctgcctgacaaggagaggaagaagatcacccgggagatcgtgcagatcatcctgagccggggccacaggaccagcagctttgtggactggaaggagctgaagctggtgtacaagagatatgccagcctgtacttctgctgtgccatcgagaaccaggacaatgagctgctgaccctggagatcgtgcacagatatgtggagctgctggacaagtactttggaaatgtgtgtgagctggacatcatcttcaactttgagaaggcctacttcatcctggatgagttcatcattggaggagagatccaggagaccagcaagaagattgctgtgaaggccatcgaggacagcgacatgctgcaggagaccatggaggagtacatgaacaagcccaccttctag

SEQ ID NO: 32210 - DNA, 315 bp, Artificial Sequence
  Description of Artificial Sequence: Synthetic coding sequence
atgatccacttcatcctgctcttcagccggcagggcaagctgcggctgcagaagtggtacatcaccctgcctgacaaggagaggaagaagatcacccgggagatcgtgcagatcatcctgagccggggccacaggaccagcagctttgtggactggaaggagctgaagctggtgtacaagagatatgccagcctgtacttctgctgtgccatcgagaaccaggacaatgagctgctgaccctggagatcgtgcacagatatgtggagctgctggacaagtactttggaaacacctggccctttgcccgggcctag

SEQ ID NO: 32211 - DNA, 495 bp, Artificial Sequence
  Description of Artificial Sequence: Synthetic coding sequence
atgatccacttcatcctgctcttcagccggcagggcaagctgcggctgcagaagtggtacatcaccctgcctgacaaggagaggaagaagatcacccgggagatcgtgcagatcatcctgagccggggccacaggaccagcagctttgtggactggaaggagctgaagctggtgtacaagagatatgccagcctgtacttctgctgtgccatcgagaaccaggacaatgagctgctgaccctggagatcgtgcacagatatgtggagctgctggacaagtactttggaaatgtgtgtgagctggacatcatcttcaactttgagaaggcctacttcatcctggatgagttcatcattggaggagagatccaggagaccagcaagaagattgctgtgaaggccatcgaggacagcgacatgctgcaggagaaccggctgagcccccggggccgggactgcagcgagcccaggagctgccactgcaccctggcctag

SEQ ID NO: 32212 - DNA, 465 bp, Artificial Sequence
  Description of Artificial Sequence: Synthetic coding sequence
atgatccacttcatcctgctcttcagccggcagggcaagctgcggctgcagaagtggtacatcaccctgcctgacaaggagaggaagaagatcacccgggagatcgtgcagatcatcctgagccggggccacaggaccagcagctttgtggactggaaggagctgaagctggtgtacaagagatatgccagcctgtacttctgctgtgccatcgagaaccaggacaatgagctgctgaccctggagatcgtgcacagatatgtggagctgctggacaagtactttggaaatgtgtgtgagctggacatcatcttcaactttgagaaggcctacttcatcctggatgagttcatcattggaggagagatccaggagaccagcaagaagattgctgtgaaggccatcgaggacagcgacatgctgcaggaggtgtccacagtgtcccagaccatgggagagaggtag

SEQ ID NO: 32213 - DNA, 3249 bp, Artificial Sequence
  Description of Artificial Sequence: Synthetic coding sequence
atgtctgctgccccagcctacagtgaagataaaggaggcagcgctggccctggagagccagaatatggccatgaccctgccagcggcggcatcttcagcagtgactacaagagacatgatgacctgaaggagatgctggacaccaacaaggacagcctgaagctggaggccatgaagagaattgtggccatgattgcccggggcaagaatgccagtgacctcttccctgctgtggtgaagaatgtggcctgcaagaacatcgaggtgaagaagctggtgtatgtgtacctggtgcgctatgcagaggagcagcaggacctggccctgctgagcatcagcaccttccagaggggcctgaaggaccccaaccagctgatccgggccagcgccctgcgggtgctgagcagcatccgggtgcccatcatcgtgcccatcatgatgctggccatcaaggaggccgccagtgacatgagcccctacgtgaggaagacagctgcccacgccatccccaagctgtacagcctggacagcgaccagaaggaccagctgattgaggtgattgagaagctgctggccgacaagaccaccctggtggccggctctgtggtgatggcctttgaggaggtgtgcccagagagaattgacctgatccacaagaactacaggaagctgtgcaacctgctgattgatgtggaggagtggggccaggtggtgatcatctccatgctgaccaggtatgcccggacccagttcctgagccccacccagaatgaaagcctgctggaggagaatgctgagaaggccttctacggcagcgaggaggatgaggccaagggggccggcagcgaggagacagctgctgctgctgcccccagcaggaagccctacgtgatggaccctgaccaccggctgctgctgaggaacaccaagcccctgctgcagagccgctctgctgctgtggtgatggctgtggcccagctgtacttccacctggcccccaaggccgaggtgggcgtcatcgccaaggccctggtgcggctgctgcggagccacagcgaggtgcagtatgtggtgctgcagaatgtggccaccatgagcatcaagagaagaggcatgtttgagccctacctgaagagcttctacatccgcagcacagaccccacccagatcaagatcctgaagctggaggtgctgaccaacctggccaatgagaccaacatccccaccgtgctgcgggagttccagacctacatccgctccatggacaaggactttgtggccgccaccatccaggccatcggccgctgtgccaccaacatcggccgggtgcgggacacctgcctgaatggcctggtgcagctgctgagcaacagagatgagctggtggtggccgagagcgtggtggtgatcaagaagctgctgcagatgcagcctgcccagcacggggagatcatcaagcacctggccaagctgacagacaacatccaggtgcccatggcccgggccagcatcctgtggctgattggagagtactgtgagcacgtgccccgcatcgccccagatgtgctgaggaagatggccaagagcttcaccgctgaggaggacatcgtgaagctgcaggtgatcaacctggccgccaagctgtacctgaccaacagcaagcagaccaagctgctgacccagtatgtgctgagcctggccaagtatgaccagaactatgacatccgggaccgggcccgcttcacccggcagctgattgtgcccagcgagcagggcggggccctgagcagacatgccaagaagctgttcctggcccccaagccagcccctgtgctggagagcagcttcaaggaccgggaccacttccagctgggcagcctgagccacctgctgaatgccaaggccaccggctaccaggagctgcctgactggccagaggaggccccagaccccagcgtgagaaatgtggaggtgcctgagtggaccaagtgcagcaaccgggagaagaggaaggagaaggagaagcccttctacagcgacagcgagggggagagcggccccacagagagcgctgacagcgaccctgagagcgagagcgagagtgacagcaagagcagcagcgagagcggcagcggggagagcagcagcgagagtgacaatgaagaccaggatgaagatgaggagaagggccggggcagcgagagcgagcagagcgaggaggatggcaagaggaagaccaagaagaaggtgcctgagaggaagggggaggccagcagcagtgatgagggcagtgacagcagcagcagcagcagcgagagcgagatgaccagcgagagcgaggaggagcagctggagcccgcctcctggagcaggaagaccccacccagcagcaagagcgccccagccaccaaggagatcagcctgctggacctggaggacttcaccccacccagcgtgcagcctgtgagccccccagccatcgtgtccaccagcctggccgctgacctggagggcctgaccctgacagacagcaccctggtgcccagcctgctgagccctgtgtctggagtgggccggcaggagctgctgcaccgggtggccggggagggcctggccgtggactacaccttcagccggcagcccttcagcggggacccccacatggtgtctgtgcacatccacttcagcaacagcagtgacacccccatcaagggcctgcacgtgggcacccccaagctgcctgctggcatcagcatccaggagttccctgagattgagagcctggcccctggagagagcgccacagctgtgatgggcatcaacttctgtgacagcacccaggccgccaacttccagctgtgcacccagacccggcagttctacgtgtccatccagccccctgtgggggagctgatggcccctgtgttcatgtctgaaaatgagttcaagaaggagcagggcaagctgatgggcatgaatgagatcacagagaagctgatgctgcctgacacctgccgcagtgaccacatcgtggtgcagaaggtgacagccacagccaacctgggccgggtgccctgtggcaccagtgatgagtacagatttgctggccgcaccctgaccggcggcagcctggtgctgctgaccctggatgcccggcctgctggggccgcccagctgactgtgaacagcgagaagatggtgattggcaccatgctggtgaaggatgtgatccaggccctgacccagtag

SEQ ID NO: 32214 - DNA, 3153 bp, Artificial Sequence
  Description of Artificial Sequence: Synthetic coding sequence
atgtctgctgccccagcctacagtgaagataaaggaggcagcgctggccctggagagccagaatatggccatgaccctgccagcggcggcatcttcagcagtgactacaagagacatgatgacctgaaggagatgctggacaccaacaaggacagcctgaagctggaggccatgaagagaattgtggccatgattgcccggggcaagaatgccagtgacctcttccctgctgtggtgaagaatgtggcctgcaagaacatcgaggaccccaaccagctgatccgggccagcgccctgcgggtgctgagcagcatccgggtgcccatcatcgtgcccatcatgatgctggccatcaaggaggccgccagtgacatgagcccctacgtgaggaagacagctgcccacgccatccccaagctgtacagcctggacagcgaccagaaggaccagctgattgaggtgattgagaagctgctggccgacaagaccaccctggtggccggctctgtggtgatggcctttgaggaggtgtgcccagagagaattgacctgatccacaagaactacaggaagctgtgcaacctgctgattgatgtggaggagtggggccaggtggtgatcatctccatgctgaccaggtatgcccggacccagttcctgagccccacccagaatgaaagcctgctggaggagaatgctgagaaggccttctacggcagcgaggaggatgaggccaagggggccggcagcgaggagacagctgctgctgctgcccccagcaggaagccctacgtgatggaccctgaccaccggctgctgctgaggaacaccaagcccctgctgcagagccgctctgctgctgtggtgatggctgtggcccagctgtacttccacctggcccccaaggccgaggtgggcgtcatcgccaaggccctggtgcggctgctgcggagccacagcgaggtgcagtatgtggtgctgcagaatgtggccaccatgagcatcaagagaagaggcatgtttgagccctacctgaagagcttctacatccgcagcacagaccccacccagatcaagatcctgaagctggaggtgctgaccaacctggccaatgagaccaacatccccaccgtgctgcgggagttccagacctacatccgctccatggacaaggactttgtggccgccaccatccaggccatcggccgctgtgccaccaacatcggccgggtgcgggacacctgcctgaatggcctggtgcagctgctgagcaacagagatgagctggtggtggccgagagcgtggtggtgatcaagaagctgctgcagatgcagcctgcccagcacggggagatcatcaagcacctggccaagctgacagacaacatccaggtgcccatggcccgggccagcatcctgtggctgattggagagtactgtgagcacgtgccccgcatcgccccagatgtgctgaggaagatggccaagagcttcaccgctgaggaggacatcgtgaagctgcaggtgatcaacctggccgccaagctgtacctgaccaacagcaagcagaccaagctgctgacccagtatgtgctgagcctggccaagtatgaccagaactatgacatccgggaccgggcccgcttcacccggcagctgattgtgcccagcgagcagggcggggccctgagcagacatgccaagaagctgttcctggcccccaagccagcccctgtgctggagagcagcttcaaggaccgggaccacttccagctgggcagcctgagccacctgctgaatgccaaggccaccggctaccaggagctgcctgactggccagaggaggccccagaccccagcgtgagaaatgtggaggtgcctgagtggaccaagtgcagcaaccgggagaagaggaaggagaaggagaagcccttctacagcgacagcgagggggagagcggccccacagagagcgctgacagcgaccctgagagcgagagcgagagtgacagcaagagcagcagcgagagcggcagcggggagagcagcagcgagagtgacaatgaagaccaggatgaagatgaggagaagggccggggcagcgagagcgagcagagcgaggaggatggcaagaggaagaccaagaagaaggtgcctgagaggaagggggaggccagcagcagtgatgagggcagtgacagcagcagcagcagcagcgagagcgagatgaccagcgagagcgaggaggagcagctggagcccgcctcctggagcaggaagaccccacccagcagcaagagcgccccagccaccaaggagatcagcctgctggacctggaggacttcaccccacccagcgtgcagcctgtgagccccccagccatcgtgtccaccagcctggccgctgacctggagggcctgaccctgacagacagcaccctggtgcccagcctgctgagccctgtgtctggagtgggccggcaggagctgctgcaccgggtggccggggagggcctggccgtggactacaccttcagccggcagcccttcagcggggacccccacatggtgtctgtgcacatccacttcagcaacagcagtgacacccccatcaagggcctgcacgtgggcacccccaagctgcctgctggcatcagcatccaggagttccctgagattgagagcctggcccctggagagagcgccacagctgtgatgggcatcaacttctgtgacagcacccaggccgccaacttccagctgtgcacccagacccggcagttctacgtgtccatccagccccctgtgggggagctgatggcccctgtgttcatgtctgaaaatgagttcaagaaggagcagggcaagctgatgggcatgaatgagatcacagagaagctgatgctgcctgacacctgccgcagtgaccacatcgtggtgcagaaggtgacagccacagccaacctgggccgggtgccctgtggcaccagtgatgagtacagatttgctggccgcaccctgaccggcggcagcctggtgctgctgaccctggatgcccggcctgctggggccgcccagctgactgtgaacagcgagaagatggtgattggcaccatgctggtgaaggatgtgatccaggccctgacccagtag

SEQ ID NO: 32215 - DNA, 3306 bp, Artificial Sequence
  Description of Artificial Sequence: Synthetic coding sequence
atgtctgctgccccagcctacagtgaagataaaggaggcagcgctggccctggagagccagaatatggccatgaccctgccagcggcggcatcttcagcagtgactacaagagacatgatgacctgaaggagatgctggacaccaacaaggacagcctgaagctggaggccatgaagagaattgtggccatgattgcccggggcaagaatgccagtgacctcttccctgctgtggtgaagaatgtggcctgcaagaacatcgaggtgaagaagctggtgtatgtgtacctggtgcgctatgcagaggagcagcaggacctggccctgctgagcatcagcaccttccagaggggcctgaaggaccccaaccagctgatccgggccagcgccctgcgggtgctgagcagcatccgggtgcccatcatcgtgcccatcatgatgctggccatcaaggaggccgccagtgacatgagcccctacgtgaggaagacagctgcccacgccatccccaagctgtacagcctggacagcgaccagaaggaccagctgattgaggtgattgagaagctgctggccgacaagaccaccctggtggccggctctgtggtgatggcctttgaggaggtgtgcccagagagaattgacctgatccacaagaactacaggaagctgtgcaacctgctgattgatgtggaggagtggggccaggtggtgatcatctccatgctgaccaggtatgcccggacccagttcctgagccccacccagaatgaaagcctgctggaggagaatgctgagaaggccttctacggcagcgaggaggatgaggccaagggggccggcagcgaggagacagctgctgctgctgcccccagcaggaagccctacgtgatggaccctgaccaccggctgctgctgaggaacaccaagcccctgctgcagagccgctctgctgctgtggtgatggctgtggcccagctgtacttccacctggcccccaaggccgaggtgggcgtcatcgccaaggccctggtgcggctgctgcggagccacagcgaggtgcagtatgtggtgctgcagaatgtggccaccatgagcatcaagagaagaggcatgtttgagccctacctgaagagcttctacatccgcagcacagaccccacccagatcaagatcctgaagctggaggtgctgaccaacctggccaatgagaccaacatccccaccgtgctgcgggagttccagacctacatccgctccatggacaaggactttgtggccgccaccatccaggccatcggccgctgtgccaccaacatcggccgggtgcgggacacctgcctgaatggcctggtgcagctgctgagcaacagagatgagctggtggtggccgagagcgtggtggtgatcaagaagctgctgcagatgcagcctgcccagcacggggagatcatcaagcacctggccaagctgacagacaacatccaggtgcccatggcccgggccagcatcctgtggctgattggagagtactgtgagcacgtgccccgcatcgccccagatgtgctgaggaagatggccaagagcttcaccgctgaggaggacatcgtgaagctgcaggtgatcaacctggccgccaagctgtacctgaccaacagcaagcagaccaagctgctgacccagtatgtgctgagcctggccaagtatgaccagaactatgacatccgggaccgggcccgcttcacccggcagctgattgtgcccagcgagcagggcggggccctgagcagacatgccaagaagctgttcctggcccccaagccagcccctgtgctggagagcagcttcaaggaccgggaccacttccagctgggcagcctgagccacctgctgaatgccaaggccaccggctaccaggagctgcctgactggccagaggaggccccagaccccagcgtgagaaatgtggaggaggaggacctgagcctcatcgagacccacgtgggcctgctgggggagtacacagaggtgcctgagtggaccaagtgcagcaaccgggagaagaggaaggagaaggagaagcccttctacagcgacagcgagggggagagcggccccacagaatctgctgacagcgaccctgagagcgagagcgagagtgacagcaagagcagcagcgagagcggcagcggggagagcagcagcgagagtgacaatgaagaccaggatgaagatgaggagaagggccggggcagcgagagcgagcagagtgaagaagatggcaagaggaagaccaagaagaaggtgcctgagaggaaaggagaggccagcagcagtgatgagggcagtgacagcagcagcagcagcagcgagagcgagatgaccagcgagagcgaggaggagcagctggagcccgcctcctggagcaggaagaccccacccagcagcaagagcgccccagccaccaaggagatcagcctgctggacctggaggacttcaccccaccttctgtgcagcctgtgtccccaccagccatcgtgtccaccagcctggccgctgacctggagggcctgaccctgacagacagcaccctggtgcccagcctgctgagccctgtgtctggagtgggccggcaggagctgctgcaccgggtggccggggagggcctggccgtggactacaccttcagccggcagcccttcagcggggacccccacatggtgtctgtgcacatccacttcagcaacagcagtgacacccccatcaagggcctgcacgtgggcacccccaagctgcctgctggcatcagcatccaggagttccctgagattgagagcctggcccctggagagagcgccacagctgtgatgggcatcaacttctgtgacagcacccaggccgccaacttccagctgtgcacccagacccggcagttctacgtgtccatccagccccctgtgggggagctgatggcccctgtgttcatgtctgaaaatgagttcaagaaggagcagggcaagctgatgggcatgaatgagatcacagagaagctgatgctgcctgacacctgccgcagtgaccacatcgtggtgcagaaggtgacagccacagccaacctgggccgggtgccctgtggcaccagtgatgagtacagatttgctggccgcaccctgactggaggcagcctggtgctgctgaccctggatgcccggcctgctggagctgcccagctgactgtgaacagcgagaagatggtgattggcaccatgctggtgaaggatgtgatccaggccctgacccagtag

SEQ ID NO: 32216 - DNA, 3066 bp, Artificial Sequence
  Description of Artificial Sequence: Synthetic coding sequence
atggccctgaagatggtgaagggcagcattgacaggatgtttgacaagaacctgcaggacctggtgcggggcatccggaaccacaaggaggatgaggccaagtacatcagccagtgcattgatgagatcaagcaggagctgaagcaggacaacattgctgtgaaggccaatgctgtgtgcaagctgacctacctgcagatgctgggctatgacatctcctgggccgccttcaacatcatcgaggtgatgtctgccagcaagttcaccttcaagagaattggctacctggccgccagccagagcttccacgagggcacagatgtgatcatgctgaccaccaaccagatcaggaaggacctgagcagccccagccagtatgacaccggggtggccctgaccggcctgagctgctttgtgaccccagacctggcccgggacctggccaatgacatcatgaccctgatgagccacaccaagccctacatcaggaagaaggctgtgctgatcatgtacaaggtgttcctgaagtacccagagagcctgcggcctgccttcccccggctgaaggagaagctggaggaccctgaccccggggtgcagagcgctgctgtgaatgtcatctgtgagctggcccggaggaaccccaagaactacctgagcctggcccccctcttcttcaagctgatgaccagcagcaccaacaactgggtgctgatcaagatcatcaagctgtttggagccctgacccccctggagccccggctgggcaagaagctgattgagcccctgaccaacctgatccacagcaccagcgccatgagcctgctgtatgaatgtgtgaacacagtgattgctgtgctgatcagcctgagcagcggcatgcccaaccacagcgccagcatccagctgtgtgtgcagaagctgcgcatcctgattgaagattctgaccagaacctgaagtacctgggcctgctggccatgagcaagatcctgaagacccaccccaagtctgtgcagagccacaaggacctgatcctgcagtgcctggatgacaaggatgagagcatccggctgcgggccctggacctgctgtatggcatggtgtccaagaagaacctgatggagatcgtgaagaagctgatgacccacgtggacaaggccgagggcaccacctacagagatgagctgctgaccaagatcatcgacatctgcagccagagcaactaccagtacatcaccaactttgagtggtacatcagcatcctggtggagctgacccggctggagggcaccaggcatggccacctgattgctgcccagatgctggatgtggccatccgggtgaaggccatcaggaagtttgctgtgtcccagatgtctgccctgctggacagcgcccacctgctggccagcagcacccagagaaatggcatctgtgaggtgctgtatgctgctgcctggatctgtggggagttcagcgagcacctgcaggagccccaccacaccctggaggccatgctgcggccccgggtgaccaccctgcccggccacatccaggccgtgtatgtgcagaatgtggtgaagctgtatgccagcatcctgcagcagaaggagcaggccggggaggccgagggcgcccaggccgtgacccagctgatggtggaccggctgccccagtttgtgcagagcgctgacctggaggtgcaggagcgggccagctgcatcctgcagctggtgaagcacatccagaagctgcaggccaaggatgtgcctgtggccgaggaggtgtctgccctgtttgctggggagctgaaccctgtggcccccaaggcccagaagaaggtgcctgtgcctgagggcctggacctggatgcctggatcaatgagcccctgagtgacagcgagagtgaagatgagcggcccagggctgtgttccacgaggaggagcagaggcggcccaagcaccggcccagcgaggctgatgaggaggagctggcccggcggcgggaggccaggaagcaggagcaggccaacaaccccttctacatcaagagcagccccagcccccagaagcgctaccaggacaccccaggagtggagcacatccctgtggtgcagattgacctgtctgtgcccctgaaggtgcccggcctgcccatgtctgaccagtatgtgaagctggaggaggagaggaggcaccggcagaagctggagaaggacaagaggaggaagaagaggaaggagaaggaggagaggaccaagggcaagaagaagagcaagaagcagcccccaggcagcgaggaggccgccggggagcctgtgcagaatggagcccctgaggaggagcagctgcccccagagagcagctacagcctgctggctgaaaattcctatgtgaagatgacctgtgacatccggggcagcctgcaggaggacagccaggtgacagtggccatcgtgctggagaacagaagcagcagcatcctgaagggcatggagctgtctgtgctggacagcctgaatgccaggatggcccggccccagggcagctctgtgcatgatggagtgcctgtgcccttccagctgcccccaggagtgtccaatgaggcccagtatgtgttcaccatccagagcatcgtgatggcccagaagctgaagggcaccctgtccttcatcgccaagaatgatgagggcgccacccatgagaagctggacttccggctgcacttcagctgcagcagctacctgatcaccaccccctgctacagtgatgcctttgccaagctgctggagagcggggacctgtccatgagcagcatcaaggtggatggcatccgcatgtccttccagaacctgctggccaagatctgcttccaccaccacttctctgtggtggagcgggtggacagctgtgcctccatgtacagccgcagcatccagggccaccacgtgtgcctgctggtgaagaagggggagaacagcgtgtctgtggatggcaagtgcagcgacagcaccctgctgagcaacctgctggaggagatgaaggccaccctggccaagtgctag

SEQ ID NO: 32217 - DNA, 3462 bp, Artificial Sequence
  Description of Artificial Sequence: Synthetic coding sequence
atggccctgaagatggtgaagggcagcattgacaggatgtttgacaagaacctgcaggacctggtgcggggcatccggaaccacaaggaggatgaggccaagtacatcagccagtgcattgatgagatcaagcaggagctgaagcaggacaacattgctgtgaaggccaatgctgtgtgcaagctgacctacctgcagatgctgggctatgacatctcctgggccgccttcaacatcatcgaggtgatgtctgccagcaagttcaccttcaagagaattggctacctggccgccagccagagcttccacgagggcacagatgtgatcatgctgaccaccaaccagatcaggaaggacctgagcagccccagccagtatgacaccggggtggccctgaccggcctgagctgctttgtgaccccagacctggcccgggacctggccaatgacatcatgaccctgatgagccacaccaagccctacatcaggaagaaggctgtgctgatcatgtacaaggtgttcctgaagtacccagagagcctgcggcctgccttcccccggctgaaggagaagctggaggaccctgaccccggggtgcagagcgctgctgtgaatgtcatctgtgagctggcccggaggaaccccaagaactacctgagcctggcccccctcttcttcaagctgatgaccagcagcaccaacaactgggtgctgatcaagatcatcaagctgtttggagccctgacccccctggagccccggctgggcaagaagctgattgagcccctgaccaacctgatccacagcaccagcgccatgagcctgctgtatgaatgtgtgaacacagtgattgctgtgctgatcagcctgagcagcggcatgcccaaccacagcgccagcatccagctgtgtgtgcagaagctgcgcatcctgattgaagattctgaccagaacctgaagtacctgggcctgctggccatgagcaagatcctgaagacccaccccaagtctgtgcagagccacaaggacctgatcctgcagtgcctggatgacaaggatgagagcatccggctgcgggccctggacctgctgtatggcatggtgtccaagaagaacctgatggagatcgtgaagaagctgatgacccacgtggacaaggccgagggcaccacctacagagatgagctgctgaccaagatcatcgacatctgcagccagagcaactaccagtacatcaccaactttgagtggtacatcagcatcctggtggagctgacccggctggagggcaccaggcatggccacctgattgctgcccagatgctggatgtggccatccgggtgaaggccatcaggaagtttgctgtgtcccagatgtctgccctgctggacagcgcccacctgctggccagcagcacccagagaaatggcatctgtgaggtgctgtatgctgctgcctggatctgtggggagttcagcgagcacctgcaggagccccaccacaccctggaggccatgctgcggccccgggtgaccaccctgcccggccacatccaggccgtgtatgtgcagaatgtggtgaagctgtatgccagcatcctgcagcagaaggagcaggccggggaggccgagggcgcccaggccgtgacccagctgatggtggaccggctgccccagtttgtgcagagcgctgacctggaggtgcaggagcgggccagctgcatcctgcagctggtgaagcacatccagaagctgcaggccaaggatgtgcctgtggccgaggaggtgtctgccctgtttgctggggagctgaaccctgtggcccccaaggcccagaagaaggtgcctgtgcctgagggcctggacctggatgcctggatcaatgagcccctgagtgacagcgagagtgaagatgagcggcccagggctgtgttccacgaggaggagcagaggcggcccaagcaccggcccagcgaggctgatgaggaggagctggcccggcggcgggaggccaggaagcaggagcaggccaacaaccccttctacatcaagagcagccccagcccccagaagcgctaccaggacaccccaggagtggagcacatccctgtggtgcagattgacctgtctgtgcccctgaaggtgcccggcctgcccatgtctgaccagtatgtgaagctggaggaggagaggaggcaccggcagaagctggagaaggacaagaggaggaagaagaggaaggagaaggagaagaagggcaagagaagacacagcagcctgcccacagaaagtgatgaggacatcgccccagcccagcaggtggacatcgtgacagaggagatgccagaaaatgccctgcccagtgatgaagatgacaaggaccccaatgacccctaccgggccctggacatcgacctggacaagcccctggccgacagcgagaagctgcccatccagaagcacaggaacacagagaccagcaagagccctgagaaggatgtgcccatggtggagaagaagagcaagaagcccaagaagaaggagaagaagcacaaggagaaggagcgggacaaggagaagaagaaggagaaggagaagaagaagagccccaagcccaagaagaagaagcacaggaaggagaaggaggagaggaccaagggcaagaagaagagcaagaagcagcccccaggcagcgaggaggccgccggggagcctgtgcagaatggagcccctgaggaggagcagctgcccccagagagcagctacagcctgctggctgaaaattcctatgtgaagatgacctgtgacatccggggcagcctgcaggaggacagccaggtgacagtggccatcgtgctggagaacagaagcagcagcatcctgaagggcatggagctgtctgtgctggacagcctgaatgccaggatggcccggccccagggcagctctgtgcatgatggagtgcctgtgcccttccagctgcccccaggagtgtccaatgaggcccagtatgtgttcaccatccagagcatcgtgatggcccagaagctgaagggcaccctgtccttcatcgccaagaatgatgagggcgccacccatgagaagctggacttccggctgcacttcagctgcagcagctacctgatcaccaccccctgctacagtgatgcctttgccaagctgctggagagcggggacctgtccatgagcagcatcaaggtggatggcatccgcatgtccttccagaacctgctggccaagatctgcttccaccaccacttctctgtggtggagcgggtggacagctgtgcctccatgtacagccgcagcatccagggccaccacgtgtgcctgctggtgaagaagggggagaacagcgtgtctgtggatggcaagtgcagcgacagcaccctgctgagcaacctgctggaggagatgaaggccaccctggccaagtgctag

SEQ ID NO: 32218 - DNA, 2955 bp, Artificial Sequence
  Description of Artificial Sequence: Synthetic coding sequence
atggccctgaagatggtgaagggcagcattgacaggatgtttgacaagaacctgcaggacctggtgcggggcatccggaaccacaaggaggatgaggccaagtacatcagccagtgcattgatgagatcaagcaggagctgaagcaggacaacattgctgtgaaggccaatgctgtgtgcaagctgacctacctgcagatgctgggctatgacatctcctgggccgccttcaacatcatcgaggtgatgtctgccagcaagttcaccttcaagagaattggctacctggccgccagccagagcttccacgagggcacagatgtgatcatgctgaccaccaaccagatcctgctgatcagcctgagcagcggcatgcccaaccacagcgccagcatccagctgtgtgtgcagaagctgcgcatcctgattgaggacagcgaccagaacctgaagtacctgggcctgctggccatgagcaagatcctgaagacccaccccaagtctgtgcagagccacaaggacctgatcctgcagtgcctggatgacaaggatgagagcatccggctgcgggccctggacctgctgtatggcatggtgtccaagaagaacctgatggagatcgtgaagaagctgatgacccacgtggacaaggccgagggcaccacctacagagatgagctgctgaccaagatcatcgacatctgcagccagagcaactaccagtacatcaccaactttgagtggtacatcagcatcctggtggagctgacccggctggagggcaccaggcatggccacctgattgctgcccagatgctggatgtggccatccgggtgaaggccatcaggaagtttgctgtgtcccagatgtctgccctgctggacagcgcccacctgctggccagcagcacccagagaaatggcatctgtgaggtgctgtatgctgctgcctggatctgtggggagttcagcgagcacctgcaggagccccaccacaccctggaggccatgctgcggccccgggtgaccaccctgcccggccacatccaggccgtgtatgtgcagaatgtggtgaagctgtatgccagcatcctgcagcagaaggagcaggccggggaggccgagggcgcccaggccgtgacccagctgatggtggaccggctgccccagtttgtgcagagcgctgacctggaggtgcaggagcgggccagctgcatcctgcagctggtgaagcacatccagaagctgcaggccaaggatgtgcctgtggccgaggaggtgtctgccctgtttgctggggagctgaaccctgtggcccccaaggcccagaagaaggtgcctgtgcctgagggcctggacctggatgcctggatcaatgagcccctgagtgacagcgagagtgaagatgagcggcccagggctgtgttccacgaggaggagcagaggcggcccaagcaccggcccagcgaggctgatgaggaggagctggccaggagaagagaggccaggaagcaggagcaggccaacaaccccttctacatcaagagcagccccagcccccagaagcgctaccaggacaccccaggagtggagcacatccctgtggtgcagattgacctgtctgtgcccctgaaggtgcccggcctgcccatgtctgaccagtatgtgaagctggaggaggagcggcggcaccggcagaagctggagaaggacaagaggaggaagaagaggaaggagaaggagaagaagggcaagaggaggcacagcagcctgcccacagaaagtgatgaagatattgccccagcccagcaggtggacatcgtgacagaggagatgccagaaaatgccctgcccagtgatgaagatgacaaggaccccaatgacccctaccgggccctggacatcgacctggacaagcccctggccgacagcgagaagctgcccatccagaagcacaggaacacagagaccagcaagagccctgagaaggatgtgcccatggtggagaagaagagcaagaagcccaagaagaaggagaagaagcacaaggagaaggagcgggacaaggagaagaagaaggagaaggagaagaagaagagccccaagcccaagaagaagaagcacaggaaggagaaggaggagaggaccaagggcaagaagaagagcaagaagcagcccccaggcagcgaggaggccgccggggagcctgtgcagaatggagcccctgaggaggagcagctgcccccagagagcagctacagcctgctggccgagaacagctatgtgaagatgacctgtgacatccggggcagcctgcaggaggacagccaggtgacagtggccatcgtgctggagaacagaagcagcagcatcctgaagggcatggagctgtctgtgctggacagcctgaatgccaggatggcccggccccagggcagctctgtgcatgatggagtgcctgtgcccttccagctgcccccaggagtgtccaatgaggcccagtatgtgttcaccatccagagcatcgtgatggcccagaagctgaagggcaccctgtccttcatcgccaagaatgatgaaggagccacccatgagaagctggacttccggctgcacttcagctgcagcagctacctgatcaccaccccctgctacagtgatgcctttgccaagctgctggagagcggggacctgtccatgagcagcatcaaggtggatggcatccgcatgtccttccagaacctgctggccaagatctgcttccaccaccacttctctgtggtggagcgggtggacagctgtgcctccatgtacagccgcagcatccagggccaccacgtgtgcctgctggtgaagaagggagaaaattctgtgtctgtggatggaaaatgtagtgacagcaccctgctgagcaacctgctggaggagatgaaggccaccctggccaagtgctag

SEQ ID NO: 32219 - DNA, 3648 bp, Artificial Sequence
  Description of Artificial Sequence: Synthetic coding sequence
atggccctgaagatggtgaagggcagcattgacaggatgtttgacaagaacctgcaggacctggtgcggggcatccggaaccacaaggaggatgaggccaagtacatcagccagtgcattgatgagatcaagcaggagctgaagcaggacaacattgctgtgaaggccaatgctgtgtgcaagctgacctacctgcagatgctgggctatgacatctcctgggccgccttcaacatcatcgaggtgatgtctgccagcaagttcaccttcaagagaattggctacctggccgccagccagagcttccacgagggcacagatgtgatcatgctgaccaccaaccagatcaggaaggacctgagcagccccagccagtatgacaccggggtggccctgaccggcctgagctgctttgtgaccccagacctggcccgggacctggccaatgacatcatgaccctgatgagccacaccaagccctacatcaggaagaaggctgtgctgatcatgtacaaggtgttcctgaagtacccagagagcctgcggcctgccttcccccggctgaaggagaagctggaggaccctgaccccggggtgcagagcgctgctgtgaatgtcatctgtgagctggcccggaggaaccccaagaactacctgagcctggcccccctcttcttcaagctgatgaccagcagcaccaacaactgggtgctgatcaagatcatcaagctgtttggagccctgacccccctggagccccggctgggcaagaagctgattgagcccctgaccaacctgatccacagcaccagcgccatgagcctgctgtatgaatgtgtgaacacagtgattgctgtgctgatcagcctgagcagcggcatgcccaaccacagcgccagcatccagctgtgtgtgcagaagctgcgcatcctgattgaagattctgaccagaacctgaagtacctgggcctgctggccatgagcaagatcctgaagacccaccccaagtctgtgcagagccacaaggacctgatcctgcagtgcctggatgacaaggatgagagcatccggctgcgggccctggacctgctgtatggcatggtgtccaagaagaacctgatggagatcgtgaagaagctgatgacccacgtggacaaggccgagggcaccacctacagagatgagctgctgaccaagatcatcgacatctgcagccagagcaactaccagtacatcaccaactttgagtggtacatcagcatcctggtggagctgacccggctggagggcaccaggcatggccacctgattgctgcccagatgctggatgtggccatccgggtgaaggccatcaggaagtttgctgtgtcccagatgtctgccctgctggacagcgcccacctgctggccagcagcacccagagaaatggcatctgtgaggtgctgtatgctgctgcctggatctgtggggagttcagcgagcacctgcaggagccccaccacaccctggaggccatgctgcggccccgggtgaccaccctgcccggccacatccaggccgtgtatgtgcagaatgtggtgaagctgtatgccagcatcctgcagcagaaggagcaggccggggaggccgagggcgcccaggccgtgacccagctgatggtggaccggctgccccagtttgtgcagagcgctgacctggaggtgcaggagcgggccagctgcatcctgcagctggtgaagcacatccagaagctgcaggccaaggatgtgcctgtggccgaggaggtgtctgccctgtttgctggggagctgaaccctgtggcccccaaggcccagaagaaggtgcctgtgcctgagggcctggacctggatgcctggatcaatgagcccctgagtgacagcgagagtgaagatgagcggcccagggctgtgttccacgaggaggagcagaggcggcccaagcaccggcccagcgaggctgatgaggaggagctggcccggcggcgggaggccaggaagcaggagcaggccaacaaccccttctacatcaagagcagccccagcccccagaagcgctaccaggacaccccaggagtggagcacatccctgtggtgcagattgacctgtctgtgcccctgaaggtgcccggcctgcccatgtctgaccagtatgtgaagctggaggaggagaggaggcaccggcagaagctggagaaggacaagaggaggaagaagaggaaggagaaggagaagaagggcaagagaagacacagcagcctgcccacagaaagtgatgaggacatcgccccagcccagcaggtggacatcgtgacagaggagatgccagaaaatgccctgcccagtgatgaagatgacaaggaccccaatgacccctaccgggccctggacatcgacctggacaagcccctggccgacagcgagaagctgcccatccagaagcacaggaacacagagaccagcaagagccctgagaaggatgtgcccatggtggagaagaagagcaagaagcccaagaagaaggagaagaagcacaaggagaaggagcgggacaaggagaagaagaaggagaaggagaagaaggccgaggacctggacttctggctgagcaccaccccacctccagccccagccccagccccagcccctgtgcccagcactggagagctgtctgtgaacacagtgaccacccccaaggatgaatgtgaagatgccaagacagaggcccagggcgaggaggatgatgctgagggccaggaccaggacaagaagagccccaagcccaagaagaagaagcacaggaaggagaaggaggagaggaccaagggcaagaagaagagcaagaagcagcccccaggcagcgaggaggccgccggggagcctgtgcagaatggagcccctgaggaggagcagctgcccccagagagcagctacagcctgctggctgaaaattcctatgtgaagatgacctgtgacatccggggcagcctgcaggaggacagccaggtgacagtggccatcgtgctggagaacagaagcagcagcatcctgaagggcatggagctgtctgtgctggacagcctgaatgccaggatggcccggccccagggcagctctgtgcatgatggagtgcctgtgcccttccagctgcccccaggagtgtccaatgaggcccagtatgtgttcaccatccagagcatcgtgatggcccagaagctgaagggcaccctgtccttcatcgccaagaatgatgagggcgccacccatgagaagctggacttccggctgcacttcagctgcagcagctacctgatcaccaccccctgctacagtgatgcctttgccaagctgctggagagcggggacctgtccatgagcagcatcaaggtggatggcatccgcatgtccttccagaacctgctggccaagatctgcttccaccaccacttctctgtggtggagcgggtggacagctgtgcctccatgtacagccgcagcatccagggccaccacgtgtgcctgctggtgaagaagggggagaacagcgtgtctgtggatggcaagtgcagcgacagcaccctgctgagcaacctgctggaggagatgaaggccaccctggccaagtgctag

SEQ ID NO: 32220 - DNA, 3339 bp, Artificial Sequence
  Description of Artificial Sequence: Synthetic coding sequence
atggccctgaagatggtgaagggcagcattgacaggatgtttgacaagaacctgcaggacctggtgcggggcatccggaaccacaaggaggatgaggccaagtacatcagccagtgcattgatgagatcaagcaggagctgaagcaggacaacattgctgtgaaggccaatgctgtgtgcaagctgacctacctgcagatgctgggctatgacatctcctgggccgccttcaacatcatcgaggtgatgtctgccagcaagttcaccttcaagagaattggctacctggccgccagccagagcttccacgagggcacagatgtgatcatgctgaccaccaaccagatcaggaaggacctgagcagccccagccagtatgacaccggggtggccctgaccggcctgagctgctttgtgaccccagacctggcccgggacctggccaatgacatcatgaccctgatgagccacaccaagccctacatcaggaagaaggccaagctgattgagcccctgaccaacctgatccacagcaccagcgccatgagcctgctgtatgaatgtgtgaacacagtgattgctgtgctgatcagcctgagcagcggcatgcccaaccacagcgccagcatccagctgtgtgtgcagaagctgcgcatcctgattgaggacagcgaccagaacctgaagtacctgggcctgctggccatgagcaagatcctgaagacccaccccaagtctgtgcagagccacaaggacctgatcctgcagtgcctggatgacaaggatgagagcatccggctgcgggccctggacctgctgtatggcatggtgtccaagaagaacctgatggagatcgtgaagaagctgatgacccacgtggacaaggccgagggcaccacctacagagatgagctgctgaccaagatcatcgacatctgcagccagagcaactaccagtacatcaccaactttgagtggtacatcagcatcctggtggagctgacccggctggagggcaccaggcatggccacctgattgctgcccagatgctggatgtggccatccgggtgaaggccatcaggaagtttgctgtgtcccagatgtctgccctgctggacagcgcccacctgctggccagcagcacccagagaaatggcatctgtgaggtgctgtatgctgctgcctggatctgtggggagttcagcgagcacctgcaggagccccaccacaccctggaggccatgctgcggccccgggtgaccaccctgcccggccacatccaggccgtgtatgtgcagaatgtggtgaagctgtatgccagcatcctgcagcagaaggagcaggccggggaggccgagggcgcccaggccgtgacccagctgatggtggaccggctgccccagtttgtgcagagcgctgacctggaggtgcaggagcgggccagctgcatcctgcagctggtgaagcacatccagaagctgcaggccaaggatgtgcctgtggccgaggaggtgtctgccctgtttgctggggagctgaaccctgtggcccccaaggcccagaagaaggtgcctgtgcctgagggcctggacctggatgcctggatcaatgagcccctgagtgacagcgagagtgaagatgagcggcccagggctgtgttccacgaggaggagcagaggcggcccaagcaccggcccagcgaggctgatgaggaggagctggccaggagaagagaggccaggaagcaggagcaggccaacaaccccttctacatcaagagcagccccagcccccagaagcgctaccaggacaccccaggagtggagcacatccctgtggtgcagattgacctgtctgtgcccctgaaggtgcccggcctgcccatgtctgaccagtatgtgaagctggaggaggagcggcggcaccggcagaagctggagaaggacaagaggaggaagaagaggaaggagaaggagaagaagggcaagaggaggcacagcagcctgcccacagaaagtgatgaagatattgccccagcccagcaggtggacatcgtgacagaggagatgccagaaaatgccctgcccagtgatgaagatgacaaggaccccaatgacccctaccgggccctggacatcgacctggacaagcccctggccgacagcgagaagctgcccatccagaagcacaggaacacagagaccagcaagagccctgagaaggatgtgcccatggtggagaagaagagcaagaagcccaagaagaaggagaagaagcacaaggagaaggagcgggacaaggagaagaagaaggagaaggagaagaaggccgaggacctggacttctggctgagcaccaccccacctccagccccagccccagccccagcccctgtgcccagcacagatgaatgtgaagatgccaagacagaggcccagggcgaggaggatgatgctgagggccaggaccaggacaagaagagccccaagcccaagaagaagaagcacaggaaggagaaggaggagaggaccaagggcaagaagaagagcaagaagcagcccccaggcagcgaggaggccgccggggagcctgtgcagaatggagcccctgaggaggagcagctgcccccagagagcagctacagcctgctggccgagaacagctatgtgaagatgacctgtgacatccggggcagcctgcaggaggacagccaggtgacagtggccatcgtgctggagaacagaagcagcagcatcctgaagggcatggagctgtctgtgctggacagcctgaatgccaggatggcccggccccagggcagctctgtgcatgatggagtgcctgtgcccttccagctgcccccaggagtgtccaatgaggcccagtatgtgttcaccatccagagcatcgtgatggcccagaagctgaagggcaccctgtccttcatcgccaagaatgatgaaggagccacccatgagaagctggacttccggctgcacttcagctgcagcagctacctgatcaccaccccctgctacagtgatgcctttgccaagctgctggagagcggggacctgtccatgagcagcatcaaggtggatggcatccgcatgtccttccagaacctgctggccaagatctgcttccaccaccacttctctgtggtggagcgggtggacagctgtgcctccatgtacagccgcagcatccagggccaccacgtgtgcctgctggtgaagaagggagaaaattctgtgtctgtggatggaaaatgtagtgacagcaccctgctgagcaacctgctggaggagatgaaggccaccctggccaagtgctag

SEQ ID NO: 32221 - DNA, 1257 bp, Artificial Sequence
  Description of Artificial Sequence: Synthetic coding sequence
atgatccacagcctcttcctgatcaactgcagcggggacatcttcctggagaagcactggaagtctgtggtgtcccagagcgtgtgtgactacttctttgaggcccaggagaaggccgcagatgtggagaatgtgccccctgtgatcagcaccccccaccactacctgatcagcatctacagagacaagctgttctttgtgtctgtcatccagacagaggtgcccccactcttcgtcatcgagttcctgcaccgggtggccgacaccttccaggactactttggagagtgcagcgaggccgccatcaaggacaacgtggtgattgtgtatgagctgctggaggagatgctggacaatggcttccccctggccacagagagcaacatcctgaaggagctgatcaagccacccaccatcctgcggtctgtggtgaacagcatcaccggcagcagcaatgtgggggacaccctgcccaccggccagctgagcaacatcccctggaggcgggccggcgtgaagtacaccaacaatgaggcctactttgatgtggtggaggagattgatgccatcatcgacaagagcggcagcacagtgtttgctgagatccagggcgtgattgatgcctgcatcaagctgagcggcatgccagacctgagcctgtccttcatgaacccccggctgctggatgatgtgtccttccacccctgcatccgcttcaagcgctgggagagcgagcgggtgctgtccttcatccccccagatggcaacttccgcctcatctcctacagagtgagcagccagaacctggtggccatccctgtgtatgtgaagcacagcatctccttcaaggagaacagcagctgtggccgctttgacatcaccatcggccccaagcagaacatgggcaagaccatcgagggcatcaccgtgacagtgcacatgcccaaggtggtgctgaacatgaacctgacccccacccagggcagctacacctttgatcctgtgaccaaggtgctgacctgggatgtgggcaagatcaccccccagaagctgcccagcctgaagggcctggtgaacctgcagagcggggcccccaagccagaggagaaccccagcctgaacatccagttcaagatccagcagctggccatcagcggcctgaaggtgaaccggctggacatgtatggagagaagtacaagcccttcaagggcgtgaagtatgtgaccaaggccggcaagttccaggtgaggacatag

SEQ ID NO: 32222 - DNA, 1257 bp, Artificial Sequence; identical to SEQ ID NO: 32221
  Description of Artificial Sequence: Synthetic coding sequence

SEQ ID NO: 32223 - DNA, 1257 bp, Artificial Sequence
  Description of Artificial Sequence: Synthetic coding sequence
atgatccacagcctcttcctgatcaacagcagcggggacatcttcctggagaagcactggaagtctgtggtgagccgctctgtgtgtgactacttctttgaggcccaggagcgggccacagaagcagaaaatgtgccccctgtgatccccaccccccaccactacctgctgtctgtgtaccgccacaagatcttctttgtggccgtcatccagacagaggtgcccccactcttcgtcatcgagttcctgcaccgggtggtggacaccttccaggactactttggagtgtgcagcgagcccgtcatcaaggacaacgtggtggtggtgtatgaggtgctggaggagatgctggacaatggcttccccctggccacagagagcaacatcctgaaggagctgatcaagccacccaccatcctgaggacagtggtgaacaccatcaccggcagcaccaacgtgggggaccagctgcccaccggccagctgtctgtggtgccctggaggagaactggagtgaagtacaccaacaatgaggcctactttgatgtgattgaggagattgatgccatcatcgacaagagcggcagcaccatcacagctgagatccagggcgtgattgatgcctgtgtgaagctgaccggcatgccagacctgaccctgtccttcatgaacccccggctgctggatgatgtgtccttccacccctgtgtgcgcttcaagcgctgggagagcgagcgcatcctgtccttcatccccccagatggcaacttccggctgctgagctaccacgtgtctgcccagaacctggtggccatccctgtgtatgtgaagcacaacatctccttccgggacagcagcagcctgggccgctttgagatcaccgtgggccccaagcagaccatgggcaagaccattgaaggagtgacagtgaccagccagatgcccaagggcgtgctgaacatgagcctgacccccagccagggcacccacacctttgatcctgtgaccaagatgctgtcctgggatgtgggcaagatcaacccccagaagctgcccagcctgaagggcaccatgagcctgcaggccggggccagcaagccagatgagaaccccaccatcaacctgcagttcaagatccagcagctggccatcagcggcctgaaggtgaaccggctggacatgtatggagagaagtacaagcccttcaagggcatcaagtacatgaccaaggccggcaagttccaggtgaggacatag

SEQ ID NO: 32224 - DNA, 1257 bp, Artificial Sequence; identical to SEQ ID NO: 32223
  Description of Artificial Sequence: Synthetic coding sequence

SEQ ID NO: 32225 - DNA, 33 bp, Artificial Sequence
  Description of Artificial Sequence: Synthetic coding sequence
atgatccacagcctcttcctgatcaacagctag

SEQ ID NO: 32226 - DNA, 1257 bp, Artificial Sequence; identical to SEQ ID NO: 32223
  Description of Artificial Sequence: Synthetic coding sequence

SEQ ID NO: 32227 - DNA, 420 bp, Artificial Sequence
  Description of Artificial Sequence: Synthetic coding sequence
atgatccacagcctcttcctgatcaacagcagcggggacatcttcctggagaagcactggaagtctgtggtgagccgctctgtgtgtgactacttctttgaggcccaggagcgggccacagaagcagaaaatgtgccccctgtgatccccaccccccaccactacctgctgtctgtgtaccgccacaagatcttctttgtggccgtcatccagacagaggtgcccccactcttcgtcatcgagttcctgcaccgggtggtggacaccttccaggactactttggagtgtgcagcgagcccgtcatcaaggacaacgtggtggtggtgtatgaggtgctggaggagatgctggacaatggcttccccctggccacagagagcaacatcctgaaggagctgatcaagccacccaccatctag

SEQ ID NO: 32228 - DNA, 822 bp, Artificial Sequence
  Description of Artificial Sequence: Synthetic coding sequence
atgatccacagcctcttcctgatcaacagcagcggggacatcttcctggagaagcactggaagtctgtggtgagccgctctgtgtgtgactacttctttgaggcccaggagcgggccacagaagcagaaaatgtgccccctgtgatccccaccccccaccactacctgctgtctgtgtaccgccacaagatcttctttgtggccgtcatccagacagaggtgcccccactcttcgtcatcgagttcctgcaccgggtggtggacaccttccaggactactttggagtgtgcagcgagcccgtcatcaaggacaacgtggtggtggtgtatgaggtgctggaggagatgctggacaatggcttccccctggccacagagagcaacatcctgaaggagctgatcaagccacccaccatcctgaggacagtggtgaacaccatcaccggcagcaccaacgtgggggaccagctgcccaccggccagctgtctgtggtgccctggaggagaactggagtgaagtacaccaacaatgaggcctactttgatgtgattgaggagattgatgccatcatcgacaagagcggcagcaccatcacagctgagatccagggcgtgattgatgcctgtgtgaagctgaccggcatgccagacctgaccctgtccttcatgaacccccggctgctggatgatgtgtccttccacccctgtgtgcgcttcaagcgctgggagagcgagcgcatcctgtccttcatccccccagatggcaacttccggctgctgagctaccacgtgtctgcccagaagtgctgcctgggcatgtag

SEQ ID NO: 32229 - DNA, 582 bp, Artificial Sequence
  Description of Artificial Sequence: Synthetic coding sequence
atgatccaggccatcctggtgttcaacaaccacggcaagccccggctggtgcgcttctaccagcgcttccctgaggagatccagcagcagatcgtgcgggagaccttccacctggtgctgaagagagatgacaacatctgcaacttcctggagggcggcagcctcatcggcggcagtgactacaagctgatctaccgccactacgccaccctgtactttgtgttctgtgtggacagcagcgagagcgagctgggcatcctggacctgatccaggtgtttgtggagaccctggacaagtgctttgaaaatgtgtgtgagctggacctgatcttccacatggacaaggtgcactacatcctgcaggaggtggtgatgggcggcatggtgctggagaccaacatgaatgaaattgtggcccagatcgaggcccagaaccggctggagaagtctgagggcggcctgtctgctgccccagcccgggctgtgtctgctgtgaagaacatcaacctgcctgagatccccaggaacatcaacattggagacctgaacatcaaggtgcccaacctgagccagtttgtgtag

SEQ ID NO: 32230 - DNA, 375 bp, Artificial Sequence
  Description of Artificial Sequence: Synthetic coding sequence
atgatccaggccatcctggtgttcaacaaccacggcaagccccggctggtgcgcttctaccagcgcttccctgaggagatccagcagcagatcgtgcgggagaccttccacctggtgctgaagagagatgacaacatctgcaacttcctggagggcggcagcctcatcggcggcagtgactacaagctgatctaccgccactacgccaccctgtactttgtgttctgtgtggacagcagcgagagcgagctgggcatcctggacctgatccagctgaagaagcgggagaggaagaagagccagtgcaacaccctgcagacaggcaccctggccctgtgggagcagggccctgacatccgcacccggcggctgtag

SEQ ID NO: 32231 - DNA, 375 bp, Artificial Sequence; identical to SEQ ID NO: 32230
  Description of Artificial Sequence: Synthetic coding sequence

SEQ ID NO: 32232 - DNA, 1506 bp, Artificial Sequence
  Description of Artificial Sequence: Synthetic coding sequence
atgcctgctgccatgctgccctatgcctgtgtgctggtgctgctgggcgcccacacagccccagctgctggggaggccggcggcagctgcctgcgctgggagccccactgccagcagcccctgcctgacagagtgcccagcacagccatcctgcccccccggctgaatggcccctggatcagcacaggctgtgaggtgcggcccggccctgagttcctgacccgggcctacaccttctaccccagccgcctcttccgggcccaccagttctactatgaggaccccttctgtggggagcccgcccacagcctgctggtgaagggcaaggtgcggctgcggcgggcctcctgggtgaccaggggggccacagaagctgactaccacctgcacaaggtgggcatcgtgttccacagcagaagagccctggtggatgtgacaggccgcctgaaccagacccgggccggccgggactgtgcccggcggctgcccccagcccgggcctggctgcccggggccctgtatgagctgcggagcgcccgggcccagggcgactgcctggaggccctgggcctgaccatgcatgagctgagcctggtgcgggtgcagaggcggctgcagccccagccccgggccagcccccggctggtggaggagctgtacctgggggacatccacacagatcctgctgagaggaggcactaccggcccaccggctaccagaggcccctgcagagcgccctgcaccacgtgcagccctgcccagcctgtggcctgattgcccggagtgatgtgcaccacccccctgtgctgcccccacccctggccctgcccctgcacctgggcggctggtgggtgagcagcggctgtgaggtgcggcctgctgtgctcttcctgaccaggctcttcaccttccacggccacagccgctcctgggagggctactaccaccacttcagtgaccctgcctgccggcagcccaccttcaccgtgtatgctgctggccgctacacccggggcacccccagcaccagggtgcggggcggcacagagctggtgtttgaggtgacccgggcccacgtgacccccatggaccaggtgaccacagccatgctgaacttcagcgagcccagcagctgtggcggggccggggcctggagcatgggcacagaaagagatgtgacagccaccaacggctgcctgcccctgggcatccggctgccccacgtggagtatgagctgttcaagatggagcaggaccccctgggccagagcctgctcttcatcggccagaggcccacagatggcagcagcccagacaccccagagaagaggcccaccagctaccaggcccccctggtgctgtgccacggggaggccccagacttcagcaggcctccccagcaccggcccagcctgcagaagcaccccagcactggaggcctgcacatcgcccccttccccctgctgcccctggtgctgggcctggccttcctgcactggctgtag

SEQ ID NO: 32233 - DNA, 1539 bp, Artificial Sequence
  Description of Artificial Sequence: Synthetic coding sequence
atggctgaaaattctggccctggggtgcggcccccaggctgggaggcccagatcaacatcatcagcacccggctggccctggcccacacagccccagctgctggggaggccggcggcagctgcctgcgctgggagccccactgccagcagcccctgcctgacagagtgcccagcacagccatcctgcccccccggctgaatggcccctggatcagcacaggctgtgaggtgcggcccggccctgagttcctgacccgggcctacaccttctaccccagccgcctcttccgggcccaccagttctactatgaggaccccttctgtggggagcccgcccacagcctgctggtgaagggcaaggtgcggctgcggcgggcctcctgggtgaccaggggggccacagaggccgactaccacctgcacaaggtgggcatcgtgttccacagccggcgggccctggtggatgtgacaggccgcctgaaccagaccagggctggccgggactgtgcccggcggctgcccccagcccgggcctggctgcccggggccctgtatgagctgcggagcgcccgggcccagggcgactgcctggaggccctgggcctgaccatgcatgagctgagcctggtgcgggtgcagaggcggctgcagccccagccccgggccagcccccggctggtggaggagctgtacctgggggacatccacacagatcctgctgagcggcggcactaccggcccaccggctaccagaggcccctgcagagcgccctgcaccacgtgcagccctgcccagcctgtggcctcatcgcccggagtgatgtgcaccacccccctgtgctgcccccacccctggccctgcccctgcacctgggcggctggtgggtgagcagcggctgtgaggtgcggcctgctgtgctcttcctgaccaggctcttcaccttccacggccacagccgctcctgggagggctactaccaccacttcagtgaccctgcctgccggcagcccaccttcaccgtgtatgctgctggccgctacacccggggcacccccagcaccagggtgcggggcggcacagagctggtgtttgaggtgacccgggcccacgtgacccccatggaccaggtgaccacagccatgctgaacttcagcgagcccagcagctgtggcggggccggggcctggagcatgggcacagaaagagatgtgacagccaccaacggctgcctgcccctgggcatccggctgccccacgtggagtatgagctgttcaagatggagcaggaccccctgggccagagcctgctcttcatcggccagaggcccacagatggcagcagcccagacaccccagagaagaggcccaccagctaccaggcccccctggtgctgtgccacggggaggccccagacttcagccggcccccccagcaccggcccagcctgcagaagcaccccagcactggaggcctgcacatcgcccccttccccctgctgcccctggtgctgggcctggccttcctgcactggctgtag

SEQ ID NO: 32234 - DNA, 1452 bp, Artificial Sequence
  Description of Artificial Sequence: Synthetic coding sequence
atgcaggagttcaccaagttccccaccaagacaggaagaagaagcctgagccgcagcatcagccagagcagcacagacagctacagcagcgctgccagctacacagacagcagtgatgatgaggtgagcccccgggagaagcagcagaccaacagcaagggcagcagcaacttctgtgtgaagaacatcaagcaggccgagtttggccggcgggagattgaaattgctgagcaggacatgtctgccctgatcagcctgaggaagagggcccagggcgagaagcccctggccggggccaagatcgtgggctgcacccacatcacagcccagacagctgtgctgattgagaccctgtgtgccctgggcgcccagtgccgctggagcgcctgcaacatctacagcacccagaatgaggtggccgccgccctggccgaggccggcgtggccgtgtttgcctggaagggggagagtgaagatgacttctggtggtgcatcgacagatgtgtgaacatggatggctggcaggccaacatgatcctggatgatggaggagacctgacccactgggtgtacaagaagtaccccaacgtgttcaagaagatccggggcatcgtggaggagagcgtgactggagtgcaccggctgtaccagctgagcaaggccggcaagctgtgtgtgcctgccatgaatgtgaatgacagcgtgaccaagcagaagtttgacaacctgtactgctgccgggagagcatcctggatggcctgaagaggaccacagatgtgatgtttggaggcaagcaggtggtggtgtgtggctacggggaggtgggcaagggctgctgtgccgccctgaaggccctgggcgccatcgtgtacatcacagaaattgaccccatctgtgccctgcaggcctgcatggatggcttccgggtggtgaagctgaatgaggtgatccggcaggtggatgtggtgatcacctgcaccggcaacaagaatgtggtgacccgggagcacctggacaggatgaagaacagctgcatcgtgtgcaacatgggccacagcaacacagaaattgatgtgaccagcctgcggaccccagagctgacctgggagcgggtgcgcagccaggtggaccacgtgatctggccagatggcaagagggtggtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccagctttgatgcccacctgacagagctgacagatgaccaggccaagtacctgggcctgaacaagaatggccccttcaagcccaactactaccgctactag

SEQ ID NO: 32235 - DNA, 1593 bp, Artificial Sequence
  Description of Artificial Sequence: Synthetic coding sequence
atgtccatgccagatgccatgcccctgcccggggtgggggaggagctgaagcaggccaaggagattgaagatgctgagaagtacagcttcatggccaccgtgaccaaggcccccaagaagcagatccagtttgctgatgacatgcaggagttcaccaagttccccaccaagacaggccgccgcagcctgagccgcagcatcagccagagcagcacagacagctacagcagcgctgccagctacacagacagcagtgatgatgaggtgagcccccgggagaagcagcagaccaacagcaagggcagcagcaacttctgtgtgaagaacatcaagcaggccgagtttggaagaagagaaattgaaattgctgagcaggacatgtctgccctgatcagcctgaggaagagggcccagggcgagaagcccctggccggggccaagatcgtgggctgcacccacatcacagcccagacagctgtgctgattgagaccctgtgtgccctgggcgcccagtgccgctggagcgcctgcaacatctacagcacccagaatgaggtggccgccgccctggccgaggccggcgtggccgtgtttgcctggaagggggagagtgaagatgacttctggtggtgcatcgacagatgtgtgaacatggatggctggcaggccaacatgatcctggatgatggaggagacctgacccactgggtgtacaagaagtacccaaatgtgttcaagaagatccggggcatcgtggaggagagcgtgactggagtgcaccggctgtaccagctgagcaaggccggcaagctgtgtgtgcctgccatgaatgtgaatgattctgtgaccaagcagaagtttgacaacctgtactgctgccgggagagcatcctggatggcctgaagaggaccacagatgtgatgtttggaggcaagcaggtggtggtgtgtggctatggagaggtgggcaagggctgctgtgccgccctgaaggccctgggcgccatcgtgtacatcacagaaattgaccccatctgtgccctgcaggcctgcatggatggcttccgggtggtgaagctgaatgaagtcatccggcaggtggatgtggtgatcacctgcaccggcaacaagaatgtggtgacccgggagcacctggacaggatgaagaacagctgcatcgtgtgcaacatgggccacagcaacacagaaattgatgtgaccagcctgcggaccccagagctgacctgggagcgggtgcgcagccaggtggaccacgtgatctggccagatggcaagagggtggtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccagctttgatgcccacctgacagagctgacagatgaccaggccaagtacctgggcctgaacaagaatggccccttcaagcccaactactaccgctactag

SEQ ID NO: 32236 - DNA, 1452 bp, Artificial Sequence; identical to SEQ ID NO: 32234
  Description of Artificial Sequence: Synthetic coding sequence

SEQ ID NO: 32237 - DNA, 1119 bp, Artificial Sequence
  Description of Artificial Sequence: Synthetic coding sequence
tttgtgttcaaggcctacatgtacctgaatgaaggccagaagctgctgaagaccctgaagaaggacaagtcctggagccagacctttgaaagtgccaccttctacagcctgaagggggaggtgtgcttcaacatgggccagatcgtgctggccaagaagatgctgaggaaggccctgaagctgctgaaccgcatcttcccctacaacctgatcagcctcttcctgcacatccacgtggagaagaacagacacttccactacgtgaaccggcaggcccaggagagccccccacctgggaagaagaggctggcccagctgtaccggcagacagtgtgcctgagcctgctgtggaggatctacagctacagctacctgttccactgcaagtactatgcccacctggccgtgatgatgcagatgaacacagccctggagacccagaactgcttccagatcatcaaggcctacctggactacagcctgtaccaccacctggccggctacaagggcgtgtggttcaagtatgaggtgatggccatggagcacatcttcaacctgcccctgaagggggagggcattgaaattgtggcctacgtggccgagaccctggtgttcaacaagctgatcatgggccacctggacctggccatcgagctgggcagccgggccctgcagatgtgggccctgctgcagaaccccaacagacactaccagagcctgtgccgcctgagccgctgcctgctgctgaacagccgctacccccagctgatccaggtgctgggccgcctgtgggagctgtctgtgacccaggagcacatcttcagcaaggccttcttctactttgtgtgcctggacatcctgctgtacagcggctttgtgtaccgcacctttgaagaatgtctggagttcatccaccagtatgagaacaaccgcatcctgaagttccacagcggcctgctgctgggcctgtacagctctgtggccatctgggagtgtgaggccggcgtgggccggcggctgcacaccagccgggaccccggcatgccagacttcagaaatggcaccaccttcaccaacttccccatcgagctgaagatcttctgccaggaggagccctag

SEQ ID NO: 32238 - DNA, 4557 bp, Artificial Sequence
  Description of Artificial Sequence: Synthetic coding sequence
atgagcctgtctgaaggagatgccctgctggccctgtggagggtggagaggaagcagctgaagaacatcatcaccgtggtgatcaagtgcagcctggagatccacggcctgtttgagacccaggagtgggaggagggcctggacatccgggtgaagattggcctggccgccggccacatctccatgctggtgtttggagatgagacccacagccacttcctggtgattggccaggccgtggatgatgtgcggctggcccagaacatggcccagatgaatgatgtgatcctgagccccaactgctggcagctgtgtgaccgctccatgattgaaattgagagcgtgcctgaccagagagctgtgaaggtgaacttcctgaagcccccacccaacttcaactttgatgagttcttcaccaagtgcaccaccttcatgcactactaccccagcggggagcacaagaacctgctgcggctggcctgcaccctgaagccagaccctgagctggagatgagcctgcagaagtatgtgatggagagcatcctgaagcagattgacaacaagcagctgcagggctacctgtctgagctgcggcctgtgaccatcgtgtttgtgaacctgatgtttgaggaccaggacaaggccgaggagatcggccctgccatccaggatgcctacatgcacatcacctctgtgctgaagatcttccagggccagatcaacaaggtgttcatgtttgacaagggctgcagcttcctgtgtgtgtttggcttccctggagagaaggtgcctgatgagctgacccacgccctggagtgtgccatggacatctttgacttctgcagccaggtgcacaagatccagacagtgtccattggagtggccagcggcatcgtgttctgtggcatcgtgggccacacagtgagacatgagtacacagtgattggccagaaggtgaacctggccgccaggatgatgatgtactacccaggcatcgtgacctgtgacagcgtgacctacaacggcagcaacctgcctgcctacttcttcaaggagctgcccaagaaggtgatgaagggcgtggccgacagcggccccctgtaccagtactggggccgcacagagaaggtgatgtttggcatggcctgcctgatctgcaacaggaaggaggactaccccctgctgggcaggaacaaggagatcaactacttcatgtacaccatgaagaagttcctgatcagcaacagcagccaggtgctgatgtatgagggcctgcccggctacggcaagagccagatcctgatgaagattgagtacctggcccagggcaagaaccaccgcatcatcgccatcagcctgaacaagatctccttccaccagaccttctacaccatccagatgttcatggccaacgtgctgggcctggacacctgcaagcactacaaggagcggcagaccaacctgaggaacaaggtgatgaccctgctggatgagaagttctactgcctgctgaatgacatcttccacgtgcagttccccatcagccgggagatcagcaggatgagcaccctgaagaagcagaagcagctggagatcctcttcatgaagatcctgaagctgattgtgaaggaggagcgcatcatcttcatcattgatgaggcccagtttgtggacagcacctcctggaggttcatggagaagctgatccgcaccctgcccatcttcatcatcatgagcctgtgcccctttgtgaacatcccctgtgccgccgcccgggctgtgatcaagaacagaaacaccacctacatcgtgattggagctgtgcagcccaatgacatcagcaacaagatctgcctggacctgaatgtgtcctgcatcagcaaggagctggacagctacctgggggagggcagctgtggcatccccttctactgtgaggagctgctgaagaacctggagcaccacgaggtgctggtgttccagcagacagaaagtgaggagaagaccaacagaacctggaacaacctcttcaagtacagcatcaagctgacagagaagctgaacatggtgaccctgcacagcgacaaggagagcgaggaggtgtgccacctgaccagcggcgtgcggctgaagaacctgagcccccccaccagcctgaaggagatcagcctcatccagctggacagcatgaggctgagccaccagatgctggtgcgctgtgccgccatcatcggcctgaccttcaccacagagctgctgtttgagatcctgccctgctggaacatgaagatgatgatcaagaccctggccaccctggtggagagcaacatcttctactgcttcagaaatggcaaggagctgcagaaggccctgaagcagaatgaccccagctttgaggtgcactaccgcagcctgagcctgaagcccagcgagggcatggaccatggagaggaggagcagctgcgggagctggagaatgaggtgattgagtgccaccgcatccgcttctgcaaccccatgatgcagaagacagcctatgagctgtggctgaaggaccagaggaaggccatgcacctgaagtgtgcccgcttcctggaggaggatgcccaccgctgtgaccactgccggggccgggacttcatcccctaccaccacttcaccgtgaacatccggctgaatgccctggacatggatgccatcaagaagatggccatgagccacggcttcaagacagaggagaagctgatcctgagcaacagcgagatccctgagaccagcgccttcttcccagaaaatagaagccctgaggagatccgggagaagatcctgaacttctttgaccacgtgctgaccaagatgaagaccagtgatgaggacatcatccccctggagagctgccagtgtgaggagatcctggagatcgtcatcctgcccctggcccaccacttcctggccctgggggagaatgacaaggccctgtactacttcctggagatcgccagcgcctacctgatcttctgtgacaactacatggcctacatgtacctgaatgaaggccagaagctgctgaagaccctgaagaaggacaagtcctggagccagacctttgagagcgccaccttctacagcctgaagggggaggtgtgcttcaacatgggccagatcgtgctggccaagaagatgctgaggaaggccctgaagctgctgaaccgcatcttcccctacaacctgatcagcctcttcctgcacatccacgtggagaagaacagacacttccactacgtgaaccggcaggcccaggagagccccccacctgggaagaagaggctggcccagctgtaccggcagacagtgtgcctgagcctgctgtggaggatctacagctacagctacctgttccactgcaagtactatgcccacctggccgtgatgatgcagatgaacacagccctggagacccagaactgcttccagatcatcaaggcctacctggactacagcctgtaccaccacctggccggctacaagggcgtgtggttcaagtatgaggtgatggccatggagcacatcttcaacctgcccctgaagggggagggcatcgagatcgtggcctacgtggccgagaccctggtgttcaacaagctgatcatgggccacctggacctggccatcgagctgggcagccgggccctgcagatgtgggccctgctgcagaaccccaacagacactaccagagcctgtgccgcctgagccgctgcctgctgctgaacagccgctacccccagctgatccaggtgctgggccgcctgtgggagctgtctgtgacccaggagcacatcttcagcaaggccttcttctactttgtgtgcctggacatcctgctgtacagcggctttgtgtaccgcacctttgaggagtgcctggagttcatccaccagtatgagaacaaccgcatcctgaagttccacagcggcctgctgctgggcctgtacagctctgtggccatctggtacgcccggctgcaggagtgggacaacttctacaagttcagcaacagagccaagaacctgctgcccaggaggaccatgaccctgacctactatgatggcatcagccgctacatggagggccaggtgctgcacctgcagaagcagatcaaggagcagagtgaaaatgcccaggccagcggggaggagctgctgaagaacctggagaacctggtggcccagaacaccactggacctgtgttctgcccccggctgtaccacctgatggcctacgtgtgcatcctgatgggagatggccagaagtgtggcctcttcctgaacacagccctgcggctgtctgagacccagggcaacatcctggagaagtgctggctgaacatgaacaaggagagctggtacagcaccagcgagctgaaggaggaccagtggctgcagaccatcctgagcctgcccagctgggagaagatcgtggccggccgggtgaacatccaggacctgcagaagaacaagttcctgatgagggccaacacagtggacaaccacttctag

SEQ ID NO: 32239 - DNA, 4833 bp, Artificial Sequence
  Description of Artificial Sequence: Synthetic coding sequence
atgaacacccccaaggaggagttccaggactggcccatcgtgagaattgctgcccacctgcctgacctgattgtgtatggccacttcagccctgagcggcccttcatggactactttgatggagtgctgatgtttgtggacatcagcggcttcaccgccatgacagagaagttcagcagcgccatgtacatggacagaggagctgagcagctggtggagatcctgaactaccacatcagcgccatcgtggagaaggtgctgatctttggaggagacatcctgaagtttgctggagatgccctgctggccctgtggagggtggagaggaagcagctgaagaacatcatcaccgtggtgatcaagtgcagcctggagatccacggcctgtttgagacccaggagtgggaggagggcctggacatccgggtgaagattggcctggccgccggccacatctccatgctggtgtttggagatgagacccacagccacttcctggtgattggccaggccgtggatgatgtgcggctggcccagaacatggcccagatgaatgatgtgatcctgagccccaactgctggcagctgtgtgaccgctccatgattgaaattgagagcgtgcctgaccagagagctgtgaaggtgaacttcctgaagcccccacccaacttcaactttgatgagttcttcaccaagtgcaccaccttcatgcactactaccccagcggggagcacaagaacctgctgcggctggcctgcaccctgaagccagaccctgagctggagatgagcctgcagaagtatgtgatggagagcatcctgaagcagattgacaacaagcagctgcagggctacctgtctgagctgcggcctgtgaccatcgtgtttgtgaacctgatgtttgaggaccaggacaaggccgaggagatcggccctgccatccaggatgcctacatgcacatcacctctgtgctgaagatcttccagggccagatcaacaaggtgttcatgtttgacaagggctgcagcttcctgtgtgtgtttggcttccctggagagaaggtgcctgatgagctgacccacgccctggagtgtgccatggacatctttgacttctgcagccaggtgcacaagatccagacagtgtccattggagtggccagcggcatcgtgttctgtggcatcgtgggccacacagtgagacatgagtacacagtgattggccagaaggtgaacctggccgccaggatgatgatgtactacccaggcatcgtgacctgtgacagcgtgacctacaacggcagcaacctgcctgcctacttcttcaaggagctgcccaagaaggtgatgaagggcgtggccgacagcggccccctgtaccagtactggggccgcacagagaaggtgatgtttggcatggcctgcctgatctgcaacaggaaggaggactaccccctgctgggcaggaacaaggagatcaactacttcatgtacaccatgaagaagttcctgatcagcaacagcagccaggtgctgatgtatgagggcctgcccggctacggcaagagccagatcctgatgaagattgagtacctggcccagggcaagaaccaccgcatcatcgccatcagcctgaacaagatctccttccaccagaccttctacaccatccagatgttcatggccaacgtgctgggcctggacacctgcaagcactacaaggagcggcagaccaacctgaggaacaaggtgatgaccctgctggatgagaagttctactgcctgctgaatgacatcttccacgtgcagttccccatcagccgggagatcagcaggatgagcaccctgaagaagcagaagcagctggagatcctcttcatgaagatcctgaagctgattgtgaaggaggagcgcatcatcttcatcattgatgaggcccagtttgtggacagcacctcctggaggttcatggagaagctgatccgcaccctgcccatcttcatcatcatgagcctgtgcccctttgtgaacatcccctgtgccgccgcccgggctgtgatcaagaacagaaacaccacctacatcgtgattggagctgtgcagcccaatgacatcagcaacaagatctgcctggacctgaatgtgtcctgcatcagcaaggagctggacagctacctgggggagggcagctgtggcatccccttctactgtgaggagctgctgaagaacctggagcaccacgaggtgctggtgttccagcagacagaaagtgaggagaagaccaacagaacctggaacaacctcttcaagtacagcatcaagctgacagagaagctgaacatggtgaccctgcacagcgacaaggagagcgaggaggtgtgccacctgaccagcggcgtgcggctgaagaacctgagcccccccaccagcctgaaggagatcagcctcatccagctggacagcatgaggctgagccaccagatgctggtgcgctgtgccgccatcatcggcctgaccttcaccacagagctgctgtttgagatcctgccctgctggaacatgaagatgatgatcaagaccctggccaccctggtggagagcaacatcttctactgcttcagaaatggcaaggagctgcagaaggccctgaagcagaatgaccccagctttgaggtgcactaccgcagcctgagcctgaagcccagcgagggcatggaccatggagaggaggagcagctgcgggagctggagaatgaggtgattgagtgccaccgcatccgcttctgcaaccccatgatgcagaagacagcctatgagctgtggctgaaggaccagaggaaggccatgcacctgaagtgtgcccgcttcctggaggaggatgcccaccgctgtgaccactgccggggccgggacttcatcccctaccaccacttcaccgtgaacatccggctgaatgccctggacatggatgccatcaagaagatggccatgagccacggcttcaagacagaggagaagctgatcctgagcaacagcgagatccctgagaccagcgccttcttcccagaaaatagaagccctgaggagatccgggagaagatcctgaacttctttgaccacgtgctgaccaagatgaagaccagtgatgaggacatcatccccctggagagctgccagtgtgaggagatcctggagatcgtcatcctgcccctggcccaccacttcctggccctgggggagaatgacaaggccctgtactacttcctggagatcgccagcgcctacctgatcttctgtgacaactacatggcctacatgtacctgaatgaaggccagaagctgctgaagaccctgaagaaggacaagtcctggagccagacctttgagagcgccaccttctacagcctgaagggggaggtgtgcttcaacatgggccagatcgtgctggccaagaagatgctgaggaaggccctgaagctgctgaaccgcatcttcccctacaacctgatcagcctcttcctgcacatccacgtggagaagaacagacacttccactacgtgaaccggcaggcccaggagagccccccacctgggaagaagaggctggcccagctgtaccggcagacagtgtgcctgagcctgctgtggaggatctacagctacagctacctgttccactgcaagtactatgcccacctggccgtgatgatgcagatgaacacagccctggagacccagaactgcttccagatcatcaaggcctacctggactacagcctgtaccaccacctggccggctacaagggcgtgtggttcaagtatgaggtgatggccatggagcacatcttcaacctgcccctgaagggggagggcatcgagatcgtggcctacgtggccgagaccctggtgttcaacaagctgatcatgggccacctggacctggccatcgagctgggcagccgggccctgcagatgtgggccctgctgcagaaccccaacagacactaccagagcctgtgccgcctgagccgctgcctgctgctgaacagccgctacccccagctgatccaggtgctgggccgcctgtgggagctgtctgtgacccaggagcacatcttcagcaaggccttcttctactttgtgtgcctggacatcctgctgtacagcggctttgtgtaccgcacctttgaggagtgcctggagttcatccaccagtatgagaacaaccgcatcctgaagttccacagcggcctgctgctgggcctgtacagctctgtggccatctggtacgcccggctgcaggagtgggacaacttctacaagttcagcaacagagccaagaacctgctgcccaggaggaccatgaccctgacctactatgatggcatcagccgctacatggagggccaggtgctgcacctgcagaagcagatcaaggagcagagtgaaaatgcccaggccagcggggaggagctgctgaagaacctggagaacctggtggcccagaacaccactggacctgtgttctgcccccggctgtaccacctgatggcctacgtgtgcatcctgatgggagatggccagaagtgtggcctcttcctgaacacagccctgcggctgtctgagacccagggcaacatcctggagaagtgctggctgaacatgaacaaggagagctggtacagcaccagcgagctgaaggaggaccagtggctgcagaccatcctgagcctgcccagctgggagaagatcgtggccggccgggtgaacatccaggacctgcagaagaacaagttcctgatgagggccaacacagtggacaaccacttctag

SEQ ID NO: 32240 - DNA, 4374 bp, Artificial Sequence
  Description of Artificial Sequence: Synthetic coding sequence
atgctggtgtttggagatgagacccacagccacttcctggtgattggccaggccgtggatgatgtgcggctggcccagaacatggcccagatgaatgatgtgatcctgagccccaactgctggcagctgtgtgaccgctccatgattgaaattgaatctgtgcctgaccagagagctgtgaaggtgaacttcctgaagcccccacccaacttcaactttgatgagttcttcaccaagtgcaccaccttcatgcactactaccccagcggggagcacaagaacctgctgcggctggcctgcaccctgaagccagaccctgagctggagatgagcctgcagaagtatgtgatggagagcatcctgaagcagattgacaacaagcagctgcagggctacctgtctgagctgcggcctgtgaccatcgtgtttgtgaacctgatgtttgaggaccaggacaaggccgaggagatcggccctgccatccaggatgcctacatgcacatcacctctgtgctgaagatcttccagggccagatcaacaaggtgttcatgtttgataaaggctgcagcttcctgtgtgtgtttggcttccctggagagaaggtgcctgatgagctgacccacgccctggagtgtgccatggacatctttgacttctgcagccaggtgcacaagatccagacagtgtccattggagtggccagcggcatcgtgttctgtggcatcgtgggccacacagtgagacatgagtacaccgtcatcggccagaaggtgaacctggccgccaggatgatgatgtactacccaggcatcgtgacctgtgacagcgtgacctacaacggcagcaacctgcctgcctacttcttcaaggagctgcccaagaaggtgatgaagggcgtggccgacagcggccccctgtaccagtactggggccgcacagagaaggtgatgtttggcatggcctgcctgatctgcaacagaaaagaagactaccccctgctgggcaggaacaaggagatcaactacttcatgtacaccatgaagaagttcctgatcagcaacagcagccaggtgctgatgtatgagggcctgcccggctacggcaagagccagatcctgatgaagattgagtacctggcccagggcaagaaccaccgcatcatcgccatcagcctgaacaagatctccttccaccagaccttctacaccatccagatgttcatggccaacgtgctgggcctggacacctgcaagcactacaaggagcggcagaccaacctgaggaacaaggtgatgaccctgctggatgagaagttctactgcctgctgaatgacatcttccacgtgcagttccccatcagccgggagatcagcaggatgagcaccctgaagaagcagaagcagctggagatcctcttcatgaagatcctgaagctgattgtgaaggaggagcgcatcatcttcatcattgatgaggcccagtttgtggacagcacctcctggaggttcatggagaagctgatccgcaccctgcccatcttcatcatcatgagcctgtgcccctttgtgaacatcccctgtgccgccgcccgggccgtcatcaagaacagaaacaccacctacatcgtcatcggggctgtgcagcccaatgacatcagcaacaagatctgcctggacctgaatgtgtcctgcatcagcaaggagctggacagctacctgggggagggcagctgtggcatccccttctactgtgaggagctgctgaagaacctggagcaccacgaggtgctggtgttccagcagacagagagcgaggagaagaccaacagaacctggaacaacctcttcaagtacagcatcaagctgacagagaagctgaacatggtgaccctgcacagcgacaaggagagcgaggaggtgtgccacctgaccagcggcgtgcggctgaagaacctgagcccccccaccagcctgaaggagatcagcctcatccagctggacagcatgaggctgagccaccagatgctggtgcgctgtgccgccatcatcggcctgaccttcaccacagagctgctgtttgagatcctgccctgctggaacatgaagatgatgatcaagaccctggccaccctggtggagagcaacatcttctactgcttcagaaatggcaaggagctgcagaaggccctgaagcagaatgaccccagctttgaggtgcactaccgcagcctgagcctgaagcccagcgagggcatggaccacggggaggaggagcagctgcgggagctggagaatgaggtgattgagtgccaccgcatccgcttctgcaaccccatgatgcagaagacagcctatgagctgtggctgaaggaccagaggaaggccatgcacctgaagtgtgcccgcttcctggaggaggatgcccaccgctgtgaccactgccggggccgggacttcatcccctaccaccacttcaccgtgaacatccggctgaatgccctggacatggatgccatcaagaagatggccatgagccacggcttcaagacagaggagaagctgatcctgagcaacagcgagatccctgagaccagcgccttcttccctgagaacagaagccctgaggagatccgggagaagatcctgaacttctttgaccacgtgctgaccaagatgaagaccagtgatgaggacatcatccccctggagagctgccagtgtgaggagatcctggagatcgtcatcctgcccctggcccaccacttcctggccctgggagaaaatgacaaggccctgtactacttcctggagatcgccagcgcctacctgatcttctgtgacaactacatggcctacatgtacctgaatgaaggccagaagctgctgaagaccctgaagaaggacaagtcctggagccagacctttgaaagtgccaccttctacagcctgaagggggaggtgtgcttcaacatgggccagatcgtgctggccaagaagatgctgaggaaggccctgaagctgctgaaccgcatcttcccctacaacctgatcagcctcttcctgcacatccacgtggagaagaacagacacttccactacgtgaaccggcaggcccaggagagccccccacctgggaagaagaggctggcccagctgtaccggcagacagtgtgcctgagcctgctgtggaggatctacagctacagctacctgttccactgcaagtactatgcccacctggccgtgatgatgcagatgaacacagccctggagacccagaactgcttccagatcatcaaggcctacctggactacagcctgtaccaccacctggccggctacaagggcgtgtggttcaagtatgaggtgatggccatggagcacatcttcaacctgcccctgaagggggagggcattgaaattgtggcctacgtggccgagaccctggtgttcaacaagctgatcatgggccacctggacctggccatcgagctgggcagccgggccctgcagatgtgggccctgctgcagaaccccaacagacactaccagagcctgtgccgcctgagccgctgcctgctgctgaacagccgctacccccagctgatccaggtgctgggccgcctgtgggagctgtctgtgacccaggagcacatcttcagcaaggccttcttctactttgtgtgcctggacatcctgctgtacagcggctttgtgtaccgcacctttgaagaatgtctggagttcatccaccagtatgagaacaaccgcatcctgaagttccacagcggcctgctgctgggcctgtacagctctgtggccatctggtacgcccggctgcaggagtgggacaacttctacaagttcagcaacagagccaagaacctgctgcccaggaggaccatgaccctgacctactatgatggcatcagccgctacatggagggccaggtgctgcacctgcagaagcagatcaaggagcagagtgaaaatgcccaggccagcggggaggagctgctgaagaacctggagaacctggtggcccagaacaccaccggccctgtgttctgcccccggctgtaccacctgatggcctacgtgtgcatcctgatgggagatggccagaagtgtggcctcttcctgaacacagccctgcggctgtctgagacccagggcaacatcctggagaagtgctggctgaacatgaacaaggagagctggtacagcaccagcgagctgaaggaggaccagtggctgcagaccatcctgagcctgcccagctgggagaagatcgtggccggccgggtgaacatccaggacctgcagaagaacaagttcctgatgagggccaacacagtggacaaccacttctag

SEQ ID NO: 32241 - DNA, 672 bp, Artificial Sequence
  Description of Artificial Sequence: Synthetic coding sequence
atggccagcaagctgctgcgggccgtcatcctgggccccccaggcagcggcaagggcaccgtgtgccagagaattgcccagaactttggcctgcagcacctgagcagcggccacttcctgcgggagaacatcaaggccagcacagaggtgggggagatggccaagcagtacatcgagaagagcctgctggtgcctgaccacgtgatcacccggctgatgatgtctgagctggagaacagaagaggccagcactggctgctggatggcttccccaggaccctgggccaggccgaggccctggacaagatctgtgaggtggacctggtgatcagcctgaacatcccctttgagaccctgaaggaccggctgagccgccgctggatccacccccccagcggccgggtgtacaacctggacttcaaccccccccacgtgcacggcattgatgatgtgactggagagcccctggtgcagcaggaggatgacaagccagaggccgtggccgcccggctgcggcagtacaaggatgtggccaagcctgtgattgagctgtacaagagcagaggagtgctgcaccagttctctggaacagagaccaacaagatctggccctacgtgtacaccctcttcagcaacaagatcacccccatccagagcaaggaggcctactag

SEQ ID NO: 32242 - DNA, 672 bp, Artificial Sequence; identical to SEQ ID NO: 32241
  Description of Artificial Sequence: Synthetic coding sequence

SEQ ID NO: 32243 - DNA, 672 bp, Artificial Sequence; identical to SEQ ID NO: 32241
  Description of Artificial Sequence: Synthetic coding sequence

SEQ ID NO: 32244 - DNA, 1482 bp, Artificial Sequence
  Description of Artificial Sequence: Synthetic coding sequence
atgcacccccaccgggacccccggggcctgtggctgctgctgcccagcctgagcctgctgctgtttgaggtggcccgggccggccgggctgtggtgtcctgcccagctgcctgcctgtgtgccagcaacatcctgagctgcagcaagcagcagctgcccaacgtgccccacagcctgcccagctacacagccctgctggacctgagccacaacaacctgagccggctgcgggcagagtggacccccacccggctgacccagctgcacagcctgctgctgagccacaaccacctgaacttcatcagcagcgaggccttcagccctgtgcccaacctgcgctacctggacctgagcagcaaccagctgcggaccctggatgagttcctgttcagtgacctgcaggtgctggaggtgctgctgctgtacaacaaccacatcatggctgtggacagatgtgcctttgatgacatggcccagctgcagaagctgtacctgagccagaaccagatcagccgcttccccctggagctggtgaaggagggcgccaagctgcccaagctgaccctgctggacctgagcagcaacaagctgaagaacctgcccctgcctgacctgcagaagctgcctgcctggatcaagaatggcctgtacctgcacaacaaccccctgaactgtgactgtgagctgtaccagctgttcagccactggcagtaccggcagctgagctctgtgatggacttccaggaggacctgtactgcatgaacagcaagaagctgcacaacgtgttcaacctgtccttcctgaactgtggggagtacaaggagcgggcctgggaggcccacctgggggacaccctcatcatcaagtgtgacaccaagcagcagggcatgaccaaggtgtgggtgacccccagcaatgaaagagtgctggatgaggtgaccaatggaacagtgtctgtgtccaaggatggcagcctgctcttccagcaggtgcaggtggaggatggaggagtgtacacctgctacgccatgggagagaccttcaatgagaccctgtctgtggagctgaaggtgcacaacttcaccctgcacggccaccacgacaccctgaacacagcctacaccaccctggtgggctgcatcctgtctgtggtgctggtgctgatctacctgtacctgaccccctgccgctgctggtgccggggcgtggagaagcccagcagccaccagggcgacagcctgagcagctccatgctgagcaccacccccaaccacgaccccatggccggcggggacaaggatgatggctttgacagaagagtggccttcctggagcctgctggccctggccagggccagaatggcaagctgaagccaggcaacaccctgcctgtgcctgaggccaccgggaagggccagaggaggatgtctgaccctgagagcgtgagcagcgtcttcagtgacacccccatcgtggtgtag

SEQ ID NO: 32245 - DNA, 1482 bp, Artificial Sequence; identical to SEQ ID NO: 32244
  Description of Artificial Sequence: Synthetic coding sequence

SEQ ID NO: 32246 - DNA, 1569 bp, Artificial Sequence
  Description of Artificial Sequence: Synthetic coding sequence
atgagcctgcgggtgcacaccctgcccaccctgctgggcgctgtggtgcggcccggctgccgggagctgctgtgcctgctgatgatcaccgtgacagtgggccctggggccagcggcgtgtgccccacagcctgcatctgtgccacagacatcgtgtcctgcaccaacaagaacctgagcaaggtgcccggcaacctcttccgcctcatcaagaggctggacctgagctacaaccgcatcggcctgctggacagcgagtggatccctgtgtcctttgccaagctgaacaccctcatcctgcggcacaacaacatcaccagcatcagcacaggcagcttcagcaccacccccaacctgaagtgcctggacctgagcagcaacaagctgaagacagtgaagaatgctgtgttccaggagctgaaggtgctggaggtgctgctgctgtacaacaaccacatctcctacctggaccccagcgcctttggaggcctgagccagctgcagaagctgtacctgagcggcaacttcctgacccagttccccatggacctgtatgtgggccgcttcaagctggccgagctgatgttcctggatgtgtcctacaaccgcatccccagcatgcccatgcaccacatcaacctggtgcctgggaagcagctgcggggcatctacctgcacggcaacccctttgtgtgtgactgcagcctgtacagcctgctggtgttctggtacagaagacacttcagctctgtgatggacttcaagaatgactacacctgccgcctgtggagcgacagccgccacagccggcaggtgctgctgctgcaggacagcttcatgaactgcagcgacagcatcatcaatggcagcttccgggccctgggcttcatccacgaggcccaggtgggggagcggctgatggtgcactgtgacagcaagacaggaaatgccaacacagacttcatctgggtgggccctgacaaccggctgctggagccagacaaggagatggagaacttctacgtgttccacaacggcagcctggtgattgagagccccaggtttgaagatgctggggtgtacagctgcatcgccatgaacaagcagaggctgctgaatgaaacagtggatgtgaccatcaacgtgagcaacttcaccgtgagccgcagccacgcccacgaggccttcaacacagccttcaccaccctggccgcctgtgtggccagcatcgtgctggtgctgctgtacctgtacctgaccccctgcccctgcaagtgcaagaccaagaggcagaagaacatgctgcaccagagcaatgcccacagcagcatcctgagccctggccctgccagtgatgccagcgcagatgagaggaaggccggggccggcaagagggtggtgttcctggagcccctgaaggacacagctgctggccagaatggcaaggtgcggctcttccccagcgaggccgtgattgctgagggcatcctgaagagcacccggggcaagagtgacagcgacagcgtgaacagcgtcttcagtgacaccccatttgtggccagcacctag

SEQ ID NO: 32247 - DNA, 1569 bp, Artificial Sequence; identical to SEQ ID NO: 32246
  Description of Artificial Sequence: Synthetic coding sequence

SEQ ID NO: 32248 - DNA, 1569 bp, Artificial Sequence; identical to SEQ ID NO: 32246
  Description of Artificial Sequence: Synthetic coding sequence

SEQ ID NO: 32249 - DNA, 1569 bp, Artificial Sequence; identical to SEQ ID NO: 32246
  Description of Artificial Sequence: Synthetic coding sequence

SEQ ID NO: 32250 - DNA, 1515 bp, Artificial Sequence
  Description of Artificial Sequence: Synthetic coding sequence
atgacctggctggtgctgctgggcaccctgctgtgcatgctgcgggtgggcctgggcaccccagattctgagggcttccccccccgggccctgcacaactgcccctacaagtgcatctgtgccgctgacctgctgagctgcaccggcctgggcctgcaggatgtgcctgctgagctgcctgctgccacagctgacctggacctgagccacaatgccctgcagaggctgcggcccggctggctggcccccctcttccagctgcgggccctgcacctggaccacaatgagctggatgccctgggccggggcgtgtttgtgaatgccagcggcctgcggctgctggacctgagcagcaacaccctgcgggccctgggcagacatgacctggatggcctgggcgccctggagaagctgctgctcttcaacaaccggctggtgcacctggatgaacatgccttccacggcctgcgggccctgagccacctgtacctgggctgcaatgagctggccagcttctcctttgaccacctgcacggcctgagcgccacccacctgctgaccctggacctgagcagcaaccggctgggccacatctctgtgcctgagctggccgccctgcctgccttcctgaagaatggcctgtacctgcacaacaaccccctgccctgtgactgccgcctgtaccacctgctgcagcgctggcaccagaggggcctgtctgctgtgcgggactttgcccgggagtatgtgtgcctggccttcaaggtgcctgccagccgggtgcgcttcttccagcacagccgggtgtttgagaactgcagcagcgccccagccctgggcctggagaggcctgaggagcacctgtatgccctggtgggccgcagcctgcggctgtactgcaacacctctgtgcctgccatgagaattgcctgggtgagcccccagcaggagctgctgcgggcccctggcagcagagatggcagcattgctgtgctggctgatggcagcctggccatcggaaatgtgcaggagcagcacgccggcctgtttgtgtgcctggccaccggcccccggctgcaccacaaccagacccatgagtacaacgtgtctgtgcacttccccaggcctgagcctgaggccttcaacacaggcttcaccaccctgctgggctgtgctgtgggcctggtgctggtgctgctgtacctgtttgccccaccctgccgctgctgcagaagagcctgccgctgccgccgctggccccagacccccagccccctgcaggagctgagcgcccagagctctgtgctgagcaccaccccaccagatgcccccagcaggaaggcctctgtgcacaagcacgtggtgttcctggagcctggaagaagaggcctgaatggccgggtgcagctggccgtggccgaggagtttgacctgtacaaccctgggggcctgcagctgaaggccggcagcgagagcgccagcagcatcggcagcgagggccccatgaccacctag

SEQ ID NO: 32251 - DNA, 1515 bp, Artificial Sequence; identical to SEQ ID NO: 32250
  Description of Artificial Sequence: Synthetic coding sequence

SEQ ID NO: 32252 - DNA, 1224 bp, Artificial Sequence
  Description of Artificial Sequence: Synthetic coding sequence
atgaccaccagcggggccctcttccccagcctggtgcccggcagcagaggagccagcaacaagtacctggtggagttccgggccggcaagatgagcctgaagggcaccaccgtgaccccagacaagaggaagggcctggtgtacatccagcagacagatgacagcctcatccacttctgctggaaggacaggaccagcggaaatgtggaggatgacctgatcatcttcccagatgactgtgagttcaagagggtgccccagtgccccagcggccgggtgtatgtgctgaagttcaaggccggcagcaagaggctcttcttctggatgcaggagcccaagacagaccaggatgaggagcactgcaggaaggtgaatgagtacctgaacaacccccccatgcctggggccctgggcgccagcggcagcagcggccacgagctgagcgccctgggcggggagggcggcctgcagagcctgctgggcaacatgagccacagccagctgatgcagctgattggccctgctggcctgggcggcctgggcggcctgggcgccctgactggacctggcctggccagcctgctgggcagcagcggccccccaggcagcagcagcagcagcagcagccgcagccagagcgctgctgtgacccccagcagcaccaccagcagcacccgggccaccccagcccccagcgccccagctgctgccagcgccaccagccccagccctgcccccagcagtggaaatggagccagcacagctgccagccccacccagcccatccagctgagtgacctgcagagcatcctggccaccatgaatgtgcctgctggccctgctgggggccagcaggtggacctggcctctgtgctgaccccagagatcatggcccccatcctggccaatgctgatgtgcaggagcggctgctgccctacctgcccagcggggagagcctgccccagacagcagatgagatccagaacaccctgaccagcccccagttccagcaggccctgggcatgttttctgctgccctggccagcggccagctgggccccctgatgtgccagtttggcctgcctgctgaggccgtggaggccgccaacaagggagatgtggaggcctttgccaaggccatgcagaacaatgccaagccagagcagaaggagggggacaccaaggacaagaaggatgaggaggaggacatgagcctggactag

SEQ ID NO: 32253 - DNA, 954 bp, Artificial Sequence
  Description of Artificial Sequence: Synthetic coding sequence
atgaccaccagcggggccctcttccccagcctggtgcccggcagcagaggagccagcaacaagtacctggtggagttccgggccggcaagatgagcctgaagggcaccaccgtgaccccagacaagaggaagggcctggtgtacatccagcagacagatgacagcctcatccacttctgctggaaggacaggaccagcggaaatgtggaggatgacctgatcatcttcccagatgactgtgagttcaagagggtgccccagtgccccagcggccgggtgtatgtgctgaagttcaaggccggcagcaagaggctcttcttctggatgcaggagcccaagacagaccaggatgaggagcactgcaggaaggtgaatgagtacctgaacaacccccccatgcctggggccctgggcgccagcggcagcagcggccacgagctgagcgccctgggcgctgggggcctgggcgccctgactggacctggcctggccagcctgctgggcagcagcggccccccaggcagcagcagcagcagcagcggggccctgagcctgcggagcagccgcagccagagcgctgctgtgacccccagcagcaccaccagcagcacccgggccaccccagcccccagcgccccagctgctgccagcgccaccagccccagccctgcccccagcagtggaaatggagccagcacagctgccagccccacccagcccatccagctgagtgacctgcagagcatcctggccaccatgaatgtgcctgctggccctgctgggggccagcaggtggacctggcctctgtgctgaccccagagatcatggcccccatcctggccaatgctgatgtgcaggagcggctgctgccctacctgcccagcggggagagcctgccccagacagcagatgagatccagaacaccctgaccagcccccagttccagcagtag

SEQ ID NO: 32254 - DNA, 243 bp, Artificial Sequence
  Description of Artificial Sequence: Synthetic coding sequence
atgaagtaccccctgatgcccctggtgaatgacctgaccttctccttcctggtgttctggttctgcctgcctgtgggcctgctgctgctgctgatcatctggctgcgcttcctgctgagccaggacagtgaagaaaatgacagctctgtgtgcctggactgggagccctggagcaaaggacctgctgagttctgctggaagggcaccctgcacggccaggagaaggagcggccctgctggtag

SEQ ID NO: 32255 - DNA, 579 bp, Artificial Sequence
  Description of Artificial Sequence: Synthetic coding sequence
atgcccctggtgaatgacctgaccttctccttcctggtgttctggttctgcctgcctgtgggcctgctgctgctgctgatcatctggctgcgcttcctgctgagccaggacagcgaggagaatgacagctctgtgtgcctggactgggagccctggagcaagggccctgctgagttctgctggaagggcaccctgcacggccaggagaaggagcggccctgctgcctggtgttcctggagagcgctggccagtggcagtggcagaagtggatgggagagacctgccagggcggcaagaggaccctggccaccgtggtgcccccctggaacccccagctgatcagcagcagtgacagacatgtgaaggccagccggggccccagccccagccctgccagccagatgaccagcagccctgctggcagccgcagcagcctgggcggccacggcagcagcgagcaggcccacggggagaagctggccaacctgatccagaggggcctgaaggccggcctgggccggcgggtgtgggtgcacatcaaggaggcccgggtcttcccctacccaggggacccctag

SEQ ID NO: 32256 - DNA, 1026 bp, Artificial Sequence
  Description of Artificial Sequence: Synthetic coding sequence
atgacagatggcatcctgggcaaggccgccaccatggagatccccatccatggaaatggagaggcccggcagctgcctgaagatgatggcctggagcaggacctgcagcaggtgatggtgtctggccccaacctgaatgagaccagcatcgtgtctgggggctatggaggcagcggagatggcctcatccccactggaagtggccgccaccccagccacagcaccacccccagcggccctggagatgaggtggcccggggcattgctggggagaagtttgatattgtgaagaagtggggcatcaacacctacaagtgcaccaagcagctgctgtctgaaagatttggccggggcagcaggacagtggacctggagctggagctgcagatcgagctgctgcgggagaccaagaggaaatatgagagcgtgctgcagctgggccgggccctgacagcccacctgtacagcctgctgcagacccagcacgccctgggagatgcctttgctgacctgagccagaagagccctgagctgcaggaggagtttggctacaatgctgagacccagaagctgctgtgcaagaatggagagaccctgctgggcgctgtgaacttctttgtgagcagcatcaacaccctggtgaccaagaccatggaggacaccctgatgacagtgaagcagtatgaggccgcccggctggagtatgatgcctacagaacagacctggaggagctgagcctgggccccagagatgctggcacccggggccgcctggagagcgcccaggccaccttccaggcccaccgggacaagtatgagaagctgcggggagatgtggccatcaagctgaagttcctggaggagaacaagatcaaggtgatgcacaagcagctgctgctcttccacaatgctgtgtctgcctactttgctggcaaccagaagcagctggagcagaccctgcagcagttcaacatcaagctgcggcccccaggagctgagaagcccagctggctggaggagcagtag

SEQ ID NO: 32257 - DNA, 1026 bp, Artificial Sequence; identical to SEQ ID NO: 32256
  Description of Artificial Sequence: Synthetic coding sequence

SEQ ID NO: 32258 - DNA, 912 bp, Artificial Sequence
  Description of Artificial Sequence: Synthetic coding sequence
atggtgtctggccccaacctgaatgagaccagcatcgtgtctgggggctatggaggcagcggagatggcctcatccccactggaagtggccgccaccccagccacagcaccacccccagcggccctggagatgaggtggcccggggcattgctggggagaagtttgatattgtgaagaagtggggcatcaacacctacaagtgcaccaagcagctgctgtctgaaagatttggccggggcagcaggacagtggacctggagctggagctgcagatcgagctgctgcgggagaccaagaggaaatatgagagcgtgctgcagctgggccgggccctgacagcccacctgtacagcctgctgcagacccagcacgccctgggagatgcctttgctgacctgagccagaagagccctgagctgcaggaggagtttggctacaatgctgagacccagaagctgctgtgcaagaatggagagaccctgctgggcgctgtgaacttctttgtgagcagcatcaacaccctggtgaccaagaccatggaggacaccctgatgacagtgaagcagtatgaggccgcccggctggagtatgatgcctacagaacagacctggaggagctgagcctgggccccagagatgctggcacccggggccgcctggagagcgcccaggccaccttccaggcccaccgggacaagtatgagaagctgcggggagatgtggccatcaagctgaagttcctggaggagaacaagatcaaggtgatgcacaagcagctgctgctcttccacaatgctgtgtctgcctactttgctggcaaccagaagcagctggagcagaccctgcagcagttcaacatcaagctgcggcccccaggagctgagaagcccagctggctggaggagcagtag

SEQ ID NO: 32259 - DNA, 771 bp, Artificial Sequence
  Description of Artificial Sequence: Synthetic coding sequence
atgaagccagccctgtgcctggtggccatgggcgccctggtgatggacagcagcccccagtgcaccaagcagctgctgtctgagcgcttcggccggggcagcaggacagtggacctggagctggagctgcagatcgagctgctgcgggagaccaagaggaaatatgaatctgtgctgcagctgggccgggccctgacagcccacctgtacagcctgctgcagacccagcacgccctgggagatgcctttgctgacctgagccagaagagccctgagctgcaggaggagtttggctacaatgctgagacccagaagctgctgtgcaagaatggagagaccctgctgggcgctgtgaacttctttgtgagcagcatcaacaccctggtgaccaagaccatggaggacaccctgatgacagtgaagcagtatgaagctgcccggctggagtatgatgcctacagaacagacctggaggagctgagcctgggccccagagatgctggcacccggggccgcctggagagcgcccaggccaccttccaggcccaccgggacaagtatgagaagctgcggggagatgtggccatcaagctgaagttcctggaggagaacaagatcaaggtgatgcacaagcagctgctgctcttccacaatgctgtgtctgcctactttgctggcaaccagaagcagctggagcagaccctgcagcagttcaacatcaagctgcggcccccaggagctgagaagcccagctggctggaggagcagtag

SEQ ID NO: 32260 - DNA, 378 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttgctgtgtgggatgtgggcagccacttcaagatccggcccctgtggcagcacttcttccagaacaccaaggagctgagcgccagccagtttgcccagttcatcaagaagctgtgtggggtgacaggcaccaatgatgaggccagccctggcagcctgaccagctaccccagccacctgctggacagatag

SEQ ID NO: 32261 - DNA, 534 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttgctgtgtgggatgtgggcagccacttcaagatccggcccctgtggcagcacttcttccagaacaccaagggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgaagtag

SEQ ID NO: 32262 - DNA, 612 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttgctgtgtgggatgtgggcagccacttcaagatccggcccctgtggcagcacttcttccagaacaccaagggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtgtcctaccagctgcccagcctgcacaacagcagcagaaattatgccggcagccctgcccagatgatgaggcacctgctggaggcctag

SEQ ID NO: 32263 - DNA, 393 bp, Artificial Sequence
  Description of Artificial Sequence: Synthetic coding sequence
ggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatcacagccatctccttccctgtgtgcaccatccaccaggagatcatgaggggccaccgccacaagtag

SEQ ID NO: 32264 - DNA, 378 bp, Artificial Sequence; identical to SEQ ID NO: 32260
  Description of Artificial Sequence: Synthetic coding sequence

SEQ ID NO: 32265 - DNA, 378 bp, Artificial Sequence; identical to SEQ ID NO: 32260
  Description of Artificial Sequence: Synthetic coding sequence

SEQ ID NO: 32266 - DNA, 393 bp, Artificial Sequence
  Description of Artificial Sequence: Synthetic coding sequence
ggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatcacagccatctccttccctgtgtgcaccatccaccaggagatcatgaggggccactggcacaagtag

SEQ ID NO: 32267 - DNA, 534 bp, Artificial Sequence; identical to SEQ ID NO: 32261
  Description of Artificial Sequence: Synthetic coding sequence

SEQ ID NO: 32268 - DNA, 612 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttgctgtgtgggatgtgggcagccacttcaagatccggcccctgtggcagcacttcttccagaacaccaagggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtgtcctaccagctgcccagcctgcacaacagcagcagaaattatgccggcagcctggcccagatgatgaggcacctgctggaggcctag

SEQ ID NO: 32269 - DNA, 378 bp, Artificial Sequence; identical to SEQ ID NO: 32260
  Description of Artificial Sequence: Synthetic coding sequence

SEQ ID NO: 32270 - DNA, 534 bp, Artificial Sequence; identical to SEQ ID NO: 32261
  Description of Artificial Sequence: Synthetic coding sequence

SEQ ID NO: 32271 - DNA, 330 bp, Artificial Sequence
  Description of Artificial Sequence: Synthetic coding sequence
gcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatcacctag

SEQ ID NO: 32272 - DNA, 603 bp, Artificial Sequence
  Description of Artificial Sequence: Synthetic coding sequence
atgggaaatggcctgagtgaccagaccagcatcctgagcaacctgcccagcttccagagcttccacatcgtcatcctgggcctggactgtgccggcaagaccaccgtgctgtaccgcctgcagttcaatgaatttgtgaacacagtgcccaccaagggcttcaacacagagaagatcaaggtgaccctgggcaacagcaagacagtgaccttccacttctgggatgtgggcggccaggagaagctgcggcccctgtggaagagctacacccgctgcacagatggcatcgtgtttgtggtggacagcgtggatgtggagaggatggaggaggccaagacagagctgcacaagatcacccgcatcagcgagaaccagggcgtgcctgtgctgattgtggccaacaagcaggacctgaggaacagcctgagcctgtctgaaattgagaagctgctggccatgggagagctgagcagcagcaccccctggcacctgcagcccacctgtgccatcattggagatggcctgaaggagggcctggagaagctgcatgacatgatcatcaagaggaggaagatgctgcggcagcagaagaagaagaggtag

SEQ ID NO: 32273 - DNA, 603 bp, Artificial Sequence; identical to SEQ ID NO: 32272
  Description of Artificial Sequence: Synthetic coding sequence

SEQ ID NO: 32274 - DNA, 603 bp, Artificial Sequence; identical to SEQ ID NO: 32272
  Description of Artificial Sequence: Synthetic coding sequence

SEQ ID NO: 32275 - DNA, 603 bp, Artificial Sequence; identical to SEQ ID NO: 32272
  Description of Artificial Sequence: Synthetic coding sequence

SEQ ID NO: 32276 - DNA, 603 bp, Artificial Sequence; identical to SEQ ID NO: 32272
  Description of Artificial Sequence: Synthetic coding sequence

SEQ ID NO: 32277 - DNA, 156 bp, Artificial Sequence
  Description of Artificial Sequence: Synthetic coding sequence
atgggaaatggcctgagtgaccagaccagcatcctgagcaacctgcccagcttccagagcttccacatcgtcatcctgggcctggactgtgccggcaagaccaccgtgctgtaccgcctgcagttcaatgaatttgtgaacacagtgcccacctag

SEQ ID NO: 32278 - DNA, 606 bp, Artificial Sequence
  Description of Artificial Sequence: Synthetic coding sequence
atgggcaacatcagcagcaacatcagcgccttccagagcctgcacatcgtgatgctgggcctggacagcgctgggaagaccaccgtgctgtaccgcctgaagttcaatgaatttgtgaacacagtgcccaccatcggcttcaacacagagaagatcaagctgagcaatggaacagccaagggcatcagctgccacttctgggatgtgggcggccaggagaagctgcggcccctgtggaagagctacagccgctgcacagatggcatcatctacgtggtggacagcgtggatgtggaccggctggaggaggccaagacagagctgcacaaggtgaccaagtttgctgagaaccagggcacccccctgctggtgattgccaacaagcaggacctgcccaagagcctgcctgtggccgagattgagaagcagctggccctgcacgagctgatcccagccaccacctaccacgtgcagcctgcctgtgccatcatcggggagggcctgacagagggcatggacaagctgtatgagatgatcctgaagaggaggaagagcctgaagcagaagaagaagaggactggagacctgcggagctgtgaggtgtag

SEQ ID NO: 32279 - DNA, 579 bp, Artificial Sequence
  Description of Artificial Sequence: Synthetic coding sequence
atgggcaacatcagcagcaacatcagcgccttccagagcctgcacatcgtgatgctgggcctggacagcgctgggaagaccaccgtgctgtaccgcctgaagttcaatgaatttgtgaacacagtgcccaccatcggcttcaacacagagaagatcaagctgagcaatggaacagccaagggcatcagctgccacttctgggatgtgggcggccaggagaagctgcggcccctgtggaagagctacagccgctgcacagatggcatcatctacgtggtggacagcgtggatgtggaccggctggaggaggccaagacagagctgcacaaggtgaccaagtttgctgagaaccagggcacccccctgctggtgattgccaacaagcaggacctgcccaagagcctgcctgtggccgagattgagaagcagctggccctgcacgagctgatcccagccaccacctaccacgtgcagcctgcctgtgccatcatcggggagggcctgacagagggcatggacaagctgtatgagatgatcctgaagaggaggaagagcctgaagcagaagaagaagaggtag

SEQ ID NO: 32280 - DNA, 612 bp, Artificial Sequence
  Description of Artificial Sequence: Synthetic coding sequence
atggccgagggggacaacagaagcaccaacctgctggccgctgagacagccagcctggaggagcagctgcagggctggggcgaggtgatgctgatggctgacaaggtgctgcgctgggagcgggcctggttccccccagccatcatgggcgtggtgtccctggtgttcctgatcatctactacctggaccccagcgtgctgagcggcgtgtcctgctttgtgatgttcctgtgcctggccgactacctggtgcccatcctggccccccgcatcttcggcagcaacaagtggaccacagagcagcagcagcgcttccacgagatctgcagcaacctggtgaagaccaggagaagagctgtgggctggtggaagaggctcttcaccctgaaggaggagaagcccaagatgtacttcatgaccatgattgtgtccctggccgctgtggcctgggtgggccagcaggtgcacaacctgctgctgacctacctgattgtgaccagcctgctgctgctgcccggcctgaaccagcacggcatcatcctgaagtacatcggcatggccaagcgggagatcaacaagctgctgaagcagaaggagaagaagaatgaatag

SEQ ID NO: 32281 - DNA, 468 bp, Artificial Sequence
  Description of Artificial Sequence: Synthetic coding sequence
atgggcgtggtgtccctggtgttcctgatcatctactacctggaccccagcgtgctgagcggcgtgtcctgctttgtgatgttcctgtgcctggccgactacctggtgcccatcctggccccccgcatcttcggcagcaacaagtggaccacagagcagcagcagcgcttccacgagatctgcagcaacctggtgaagaccaggagaagagctgtgggctggtggaagaggctcttcaccctgaaggaggagaagcccaagatgtacttcatgaccatgattgtgtccctggccgctgtggcctgggtgggccagcaggtgcacaacctgctgctgacctacctgattgtgaccagcctgctgctgctgcccggcctgaaccagcacggcatcatcctgaagtacatcggcatggccaagcgggagatcaacaagctgctgaagcagaaggagaagaagaatgaatag

SEQ ID NO: 32282 - DNA, 525 bp, Artificial Sequence
  Description of Artificial Sequence: Synthetic coding sequence
atgctgatggctgacaaggtgctgcgctgggagcgggcctggttccccccagccatcatgggcgtggtgtccctggtgttcctgatcatctactacctggaccccagcgtgctgtctggagtgtcctgctttgtgatgttcctgtgcctggccgactacctggtgcccatcctggccccccgcatcttcggcagcaacaagtggaccacagagcagcagcagcgcttccacgagatctgcagcaacctggtgaagacccggcggcgggctgtgggctggtggaagaggctcttcaccctgaaggaggagaagcccaagatgtacttcatgaccatgattgtgtccctggccgctgtggcctgggtgggccagcaggtgcacaacctgctgctgacctacctgattgtgaccagcctgctgctgctgcccggcctgaaccagcacggcatcatcctgaagtacatcggcatggccaagcgggagatcaacaagctgctgaagcagaaggagaagaagaatgaatag

SEQ ID NO: 32283 - DNA, 561 bp, Artificial Sequence
  Description of Artificial Sequence: Synthetic coding sequence
atgattgccctcttcaacaagctgctggactggttcaaggccctcttctggaaggaggagatggagctgaccctggtgggcctgcagtacagcggcaagaccacctttgtgaatgtcatcgccagcggccagttcaatgaagacatgatccccaccgtgggcttcaacatgaggaagatcaccaagggaaatgtgaccatcaagctgtgggacatcggcggccagccccgcttccgctccatgtgggagcgctactgccggggcgtgtctgccatcgtgtacatggtggatgctgctgaccaggagaagattgaggccagcaagaatgagctgcacaacctgctggacaagccccagctgcagggcatccctgtgctggtgctgggcaacaagagggacctgcccggggccctggatgagaaggagctgattgagaagatgaacctgagcgccatccaggaccgggagatctgctgctacagcatcagctgcaaggagaaggacaacatcgacatcaccctgcagtggctgatccagcacagcaagagccgccgctcctag

SEQ ID NO: 32284 - DNA, 561 bp, Artificial Sequence
  Description of Artificial Sequence: Synthetic coding sequence
atgctggccctgatcagccggctgctggactggttccgcagcctcttctggaaggaggagatggagctgaccctggtgggcctgcagtacagcggcaagaccacctttgtgaatgtcatcgccagcggccagttcagcgaggacatgatccccaccgtgggcttcaacatgaggaaggtgaccaagggaaatgtgaccatcaagatctgggacatcggcggccagccccgcttccgctccatgtgggagcgctactgccggggcgtgaatgccatcgtgtacatgattgatgctgctgaccgggagaagattgaggccagcagaaatgagctgcacaacctgctggacaagccccagctgcagggcatccctgtgctggtgctgggcaacaagagggacctgcccaatgccctggatgagaagcagctgattgagaagatgaacctgagcgccatccaggaccgggagatctgctgctacagcatcagctgcaaggagaaggacaacatcgacatcaccctgcagtggctgatccagcacagcaagagccgccgctcctag

SEQ ID NO: 32285 - DNA, 492 bp, Artificial Sequence
  Description of Artificial Sequence: Synthetic coding sequence
atgctggccctgatcagccggctgctggactggttccgcagcctcttctggaaggaggagatggagctgaccctggtgggcctgcagtacagcggcaagaccacctttgtgaatgtcatcgccagcggccagttcagcgaggacatgatccccaccgtgggcttcaacatgaggaaggtgaccaagggaaatgtgaccatcaagatctgggacatcggcggccagccccgcttccgctccatgtgggagcgctactgccggggcgtgaatgccatcgtgtacatgattgatgctgctgaccgggagaagattgaggccagcagaaatgagctgcacaacctgctggacaagccccagctgcagggcatccccatcagccacttcagcggcctcttcagcatccagaacctggaggaggccgaggccagccctgaggtgttccagagcttcctggccatcatcctggagctgctgtctgtgcccctgaagtag

SEQ ID NO: 32286 - DNA, 717 bp, Artificial Sequence
  Description of Artificial Sequence: Synthetic coding sequence
atgatccgcagcgcctcctgggtgtggctgctgcccccagctggggtgcggccctgcagagctggggcccccaggagccgctggagggtgcgggcagaggcccggagctgtggcagccggcccagcagccggcccttcagcctgcctgctgccatcatgctggccctgatcagccggctgctggactggttccgcagcctcttctggaaggaggagatggagctgaccctggtgggcctgcagtacagcggcaagaccacctttgtgaatgtcatcgccagcggccagttcagcgaggacatgatccccaccgtgggcttcaacatgaggaaggtgaccaagggaaatgtgaccatcaagatctgggacatcggcggccagccccgcttccgctccatgtgggagcgctactgccggggcgtgaatgccatcgtgtacatgattgatgctgctgaccgggagaagattgaggccagcagaaatgagctgcacaacctgctggacaagccccagctgcagggcatccctgtgctggtgctgggcaacaagagggacctgcccaatgccctggatgagaagcagctgattgagaagatgaacctgagcgccatccaggaccgggagatctgctgctacagcatcagctgcaaggagaaggacaacatcgacatcaccctgcagtggctgatccagcacagcaagagccgccgctcctag

SEQ ID NO: 32287 - DNA, 681 bp, Artificial Sequence
  Description of Artificial Sequence: Synthetic coding sequence
atgagctttgctgagagcggctggaggtctgccctgcggcggcggggccctggcaccccaggccctgtggcccggcccagctacagcagcttcacccagggcgacagctggggcgagggggaggtggatgaggaggagggctgtgaccaggtggcccgggacctgcgggcagagttctctgctggggcctggagcgagcccaggaagaggtctgtgctgcccccagatggaaatggcagccctgtgctgcctgacaagagaaatggcatcttccctgctgctgctggcagccgggcccagccccggcgctggcctgtgcaggtgctgagcatcctgtgcagcctgctgtttgccatcctgctggccttcctgctggccatcgcctacctgattgtgaaggagctgcatgctgagaacctgaagaatgaagatgatgtggacaccggcctgctgggcttctggaccctgctgatcatcagcctgacagctggcttcagctgctgcagcttctcctggacagtgacctactttgacagctttgagcccggcatgttcccccccacccccctgagccctgcccgcttcaagaagctgaccggccacagcttccacatgggctacagcatggccatcctgaatggaattgtggccgccctgactgtggcctggtgcctgatgtag

SEQ ID NO: 32288 - DNA, 3492 bp, Artificial Sequence
  Description of Artificial Sequence: Synthetic coding sequence
atgaaccgggaggacagaaatgtgctgaggatgaaggagcgggagaggaggaaccaggagatccagcagggagaagatgccttcccccccagcagccccctgtttgctgagccctacaaggtgaccagcaaagaagacaagctgagcagccgcatccagagcatgctgggcaactatgatgagatgaaggacttcatcggggacaggagcatccccaagctggtggccatccccaagcccaccgtgcccccatctgcagatgagaagagcaaccccaacttctttgagcagagacatggaggcagccaccagagcagcaagtggacccctgtgggccctgcccccagcaccagccagagccagaagaggagcagcggcctgcagagcggccacagcagccagaggaccagcgctggcagcagcagcggcaccaacagcagcggccagagacatgaccgggagagctacaacaacagcggcagcagcagcaggaagaagggccagcacggcagcgagcacagcaagagccgcagcagcagccctgggaagccccaggccgtgagcagcctgaacagcagccacagccgcagccacggcaatgaccaccacagcaaggagcaccagaggagcaagagcccccgggaccctgatgccaactgggacagccccagccgggtgcccttcagcagcggccagcacagcacccagagcttcccccccagcctgatgagcaagagcaacagcatgctgcagaagcccacagcctacgtgcggcccatggatggccaggagagcatggagcccaagctgagcagcgagcactacagcagccagagccacggcaacagcatgacagagctgaagcccagcagcaaggcccacctgaccaagctgaagatccccagccagcccctggatgccagcgccagcggagatgtgtcctgtgtggatgagatcctgaaggagatgacccacagctggcccccacccctgacagccatccacaccccctgcaagacagagcccagcaagttccccttccccaccaaggagagccagcagagcaactttggaactggagagcagaagcgctacaaccccagcaagaccagcaatggccaccagagcaagtccatgctgaaggatgacctgaagctgagcagcagcgaggacagtgatggagagcaggactgtgacaagaccatgcccaggagcaccccaggcagcaacagcgagcccagccaccacaacagcgagggcgctgacaacagcagagatgacagcagcagccacagcggcagcgagagcagcagcggcagtgacagcgagagcgagagcagcagcagtgacagcgaggccaatgagcccagccagagcgccagccctgagcctgagcccccacccaccaacaagtggcagctggacaactggctgaacaaggtgaacccccacaaggtgtccccagccagctctgtggacagcaacatccccagcagccagggctacaagaaggagggccgggagcagggcactggaaacagctacacagacaccagcggccccaaggagaccagcagcgccaccccaggccgggacagcaagaccatccagaagggcagcgagagcggccggggccggcagaagagccctgcccagagcgacagcaccacccagaggagaacagtgggcaagaagcagcccaagaaggccgagaaggctgctgctgaggagccccggggcggcctgaagattgagagcgagacccctgtggacctggccagctccatgcccagcagccgccacaaggccgccaccaagggcagcaggaagcccaacatcaagaaggagagcaagagcagcccccggcccacagctgagaagaagaagtacaagagcaccagcaagagcagccagaagagccgggagatcatcgagacagacaccagcagcagtgacagtgatgagagcgagagcctgccccccagcagccagacccccaagtacccagagagcaacagaacacctgtgaagcccagctctgtggaggaggaggacagcttcttccggcagaggatgttcagccccatggaggagaaggagctgctgagccccctgtctgagccagatgaccgctaccccctgattgtgaagattgacctgaacctgctgacccgcatccctgggaagccctacaaggagacagagccccccaagggggagaagaagaatgtgcctgagaagcacacccgggaggcccagaagcaggccagcgagaaggtgagcaacaagggcaagaggaagcacaagaatgaagatgacaacagagccagcgagagcaagaagcccaagacagaggacaagaacagcgctggccacaagcccagcagcaaccgggagagcagcaagcagagcgctgccaaggagaaggacctgctgcccagccctgctggccctgtgcccagcaaggaccccaagacagagcacggcagcaggaagaggaccatcagccagagcagcagcctgaagagcagcagcaacagcaacaaggagaccagcggcagcagcaagaacagcagcagcaccagcaagcagaagaagacagagggcaagaccagcagcagcagcaaggaggtgaaggagaaggcccccagcagcagcagcaactgcccccccagcgcccccaccctggacagcagcaagcccaggaggaccaagctggtgtttgatgacaggaactacagcgctgaccactacctgcaggaggccaagaagctgaagcacaatgctgatgccctgagtgacagatttgagaaggctgtgtactacctggatgctgtggtgtccttcattgaatgtggaaatgccctggagaagaatgcccaggagagcaagagccccttccccatgtacagcgagaccgtggacctgatcaagtacaccatgaagctgaagaactacctggccccagatgccacagctgctgacaagaggctgactgtgctgtgcctgcgctgtgagagcctgctgtacctgcggctcttcaagctgaagaaggaaaatgccctgaagtacagcaagaccctgacagagcacctgaagaacagctacaacaacagccaggcccccagccctggcctgggcagcaaggctgtgggcatgcccagccctgtgagccccaagctgagccctggcaacagcggcaactacagcagcggggccagcagcgccagcgccagcggcagctctgtgaccatcccccagaagatccaccagatggccgccagctatgtgcaggtgaccagcaacttcctgtatgccacagagatctgggaccaggccgagcagctgagcaaggagcagaaggagttctttgctgagctggacaaggtgatgggccccctcatcttcaatgccagcatcatgacagacctggtgcgctacacccggcagggcctgcactggctgcggcaggatgccaagctgatctcctag

SEQ ID NO: 32289 - DNA, 447 bp, Artificial Sequence
  Description of Artificial Sequence: Synthetic coding sequence
atgaaccgggaggacagaaatgtgctgaggatgaaggagcgggagaggaggaaccaggagatccagcagggagaagatgccttcccccccagcagccccctgtttgctgagccctacaaggtgaccagcaaagaagacaagctgagcagccgcatccagagcatgctgggcaactatgatgagatgaaggacttcatcggggacaggagcatccccaagctggtggccatccccaagcccaccgtgcccccatctgcagatgagaagagcaaccccaacttctttgagcagagacatggaggcagccaccagagcagcaagtggacccctgtgggccctgcccccagcaccagccagagccagaagaggagcagcggcctgcagagcggccacagcagccagaggaccagcgctggcagcagcagcggcaccaacagcagtggatag

SEQ ID NO: 32290 - DNA, 1059 bp, Artificial Sequence
  Description of Artificial Sequence: Synthetic coding sequence
atgctgcggctgctggccagcggctgtgcccggggccctggccctggggtgggcgcccggcctgctgctggcctcttccaccctggccggcggcagagccggcaggccagtgatgcccccaggaaccagccccccagccctgagtttgtggcccggcctgtgggcgtgtgcagcatgatgaggctgcctgtgcagaccagccctgagggcctggatgctgccttcatcggcgtgcccctggacaccggcaccagcaacagacctggggcccgcttcggcccccggcgcatccgggaggagagcgtgatgctgggcaccgtgaaccccagcactggagccctgcccttccagagcctgatggtggccgacctgggagatgtgaatgtgaacctgtacaacctgcaggacagctgccgccgcatccaggaggcctatgagaagatcgtggccgccggctgcatccccctgaccctgggcggggaccacaccatcacctaccccatcctgcaggccatggccaagaagcacggccctgtgggcctgctgcacgtggatgcccacacagacaccacagacaaggccctgggggagaagctgtaccatggagcccccttccgccgctgtgtggatgagggcctgctggactgcaagagggtggtgcagatcggcatccggggcagcagcaccaccctggacccctaccgctacaacagaagccagggcttccgggtggtgctggccgaggactgctggatgaagagcctggtgcccctgatgggagaggtgcggcagcagatgggcggcaagcccatctacatcagctttgatattgatgccctggaccctgcctatgcccctggcaccggcaccccagaaattgctggcctgacccccagccaggccctggagatcatccggggctgccagggcctgaatgtgatgggctgtgacctggtggaggtgtccccaccctatgacctgagcggcaacacagccctgctggccgccaacctgctgtttgagatgctgtgtgccctgcccaaggtgaccaccgtgtag

SEQ ID NO: 32291 - DNA, 1617 bp, Artificial Sequence
  Description of Artificial Sequence: Synthetic coding sequence
atggagcggctgggggagaaggccagccggctgctggagaagtttggaagaagaaaaggagagagcagccgcagcggcagtgatggcaccccaggccctgggaagggccgcctgagcggcctgggcggccccaggaagagcggccccaggggggccactggaggccctggagatgagcccctggagcccgcccgggagcagggcagcctggatgctgagaggaaccagaggggcagctttgaggcccccaggtatgagggcagcttccctgctggccccccacccacccgggccctgcccctgccccagagcctgcccccagacttccggctggagcccacagccccagccctgagccccaggagcagctttgccagcagcagcgccagtgatgccagcaagcccagcagcccccggggcagcctgctgctggatggagctggagctggaggagctgggggcagccggccctgcagcaacagaacatctggcatctccatgggctatgaccagagacatggcagccccctgcctgctggcccctgcctgtttggcccccccctggccggggccccagctggctacagccctggaggagtgcccagcgcctacccagagctgcatgctgccctggaccggctgtatgcccagaggcctgctggcttcggctgccaggagagccgccacagctaccccccagccctgggcagccctggggccctggccggggccggcgtgggcgctgctggccccctggagcggcggggggcccagcccggccgccacagcgtgacaggctatggagactgtgctgtgggcgcccgctaccaggatgagctgacagccctgctgcggctgactgtgggcaccggcggccgggaggccggggcccggggggagcccagcggcatcgagcccagcggcctggaggagcccccaggcccctttgtgcctgaggccgcccgggccaggatgagggagcctgaggcccgggaggactacttcggcacctgcatcaagtgcaacaagggcatctacggccagagcaatgcctgccaggccctggacagcctgtaccacacccagtgctttgtgtgctgcagctgtggccgcaccctgcgctgcaaggccttctacagcgtgaatggatctgtgtactgtgaggaggactacctgttcagcggcttccaggaggccgctgagaagtgctgcgtgtgtggccacctgatcctggagaagatcctgcaggccatgggcaagagctaccaccctggctgcttccgctgcatcgtgtgcaacaagtgcctggatggcatccccttcaccgtggacttcagcaaccaggtgtactgtgtgacagactaccacaagaactatgcccccaagtgtgccgcctgtggccagcccatcctgcccagcgagggctgtgaagatattgtgcgggtcatctccatggaccgggactaccactttgagtgctaccactgtgaggactgcaggatgcagctgagtgatgaggagggctgctgctgcttccccctggatggccacctgctgtgccacggctgccacatgcagaggctgaatgcccggcagcccccagccaactacatctag

SEQ ID NO: 32292 - DNA, 1617 bp, Artificial Sequence; identical to SEQ ID NO: 32291
  Description of Artificial Sequence: Synthetic coding sequence

SEQ ID NO: 32293 - DNA, 366 bp, Artificial Sequence
  Description of Artificial Sequence: Synthetic coding sequence
atgggcaagagctaccaccctggctgcttccgctgcatcgtgtgcaacaagtgcctggatggcatccccttcaccgtggacttcagcaaccaggtgtactgtgtgacagactaccacaagaactatgcccccaagtgtgccgcctgtggccagcccatcctgcccagcgagggctgtgaggacatcgtgcgggtcatctccatggaccgggactaccactttgagtgctaccactgtgaggactgcaggatgcagctgagtgatgaggagggctgctgctgcttccccctggatggccacctgctgtgccacggctgccacatgcagaggctgaatgcccggcagcccccagccaactacatctag

SEQ ID NO: 32294 - DNA, 243 bp, Artificial Sequence
  Description of Artificial Sequence: Synthetic coding sequence
atgggcaagagctaccaccctggctgcttccgctgcatcgtgtgcaacaagtgcctggatggcatccccttcaccgtggacttcagcaaccaggtgtactgtgtgacagactaccacaagaactatgcccccaagtgtgccgcctgtggccagcccatcctgcccagcgagggctgtgaggacatcgtgcgggtcatctccatggaccgggactaccactttgagtgctaccactgtgagtag

SEQ ID NO: 32295 - DNA, 198 bp, Artificial Sequence
  Description of Artificial Sequence: Synthetic coding sequence
atgggcaagagctaccaccctggctgcttccgctgcatcgtgtgcaacaagtgcctggatggcatccccttcaccgtggacttcagcaaccaggtgtactgtgtgacagactaccacaagaactatgcccccaagtgtgccgcctgtggccagcccatcctgcccagcgagggctgtgaggacatcgtgcgggtgtag

SEQ ID NO: 32296 - DNA, 243 bp, Artificial Sequence; identical to SEQ ID NO: 32294
  Description of Artificial Sequence: Synthetic coding sequence

SEQ ID NO: 32297 - DNA, 309 bp, Artificial Sequence
  Description of Artificial Sequence: Synthetic coding sequence
atggccaacacccagctggaccacctgcactacaccacagagttcaccagaaatgacctgctgatcatctgcaagaagttcaacctgatgctgatggatgaggacatcatcagcctgctggccatcttcatcaagatgtgcctgtggctgtggaagcagttcctgaagaggggcagcaagtgcagcgagaccagcgagctgctggagaaggtgaagctgcagctggccttcaccgcctacaagtatgtggacatctgcttccctgagcagatggcctacagccgctacatccgctggtacatccactag

SEQ ID NO: 32298 - DNA, 1500 bp, Artificial Sequence
  Description of Artificial Sequence: Synthetic coding sequence
atgtgtgagctgtacagcaagagggacaccctgggcctgaggaagaagcacatcggccccagctgcaaggtgttctttgccagtgaccccatcaagatcgtgcgggcccagaggcagtacatgtttgatgaaaatggagagcagtacctggactgcatcaacaacgtggcccacgtgggccactgccaccctggggtggtgaaggccgccctgaagcagatggagctgctgaacaccaacagccgcttcctgcatgacaacatcgtggagtatgccaagaggctgagcgccaccctgcctgagaagctgtctgtgtgctacttcaccaacagcggcagcgaggccaatgacctggccctgcggctggcccggcagttccggggccaccaggatgtgatcaccctggaccacgcctaccacggccacctgagcagcctgattgagatcagcccctacaagttccagaagggcaaggatgtgaagaaggagtttgtgcacgtggcccccaccccagacacctaccggggcaagtaccgggaggaccatgctgacagcgccagcgcctatgcagatgaggtgaagaagatcattgaagatgcccacaacagcggcaggaagattgctgccttcatcgccgagagcatgcagagctgtggcggccagatcatccccccagctggctacttccagaaggtggccgagtatgtgcatggagctggaggagtcttcatcgcagatgaggtgcaggtgggcttcggccgggtgggcaagcacttctggagcttccagatgtatggagaagattttgtgcctgacatcgtgaccatgggcaagcccatgggaaatggccaccctgtggcctgtgtggtgaccaccaaggagattgctgaggccttcagcagcagcggcatggagtacttcaacacctacggcggcaaccctgtgtcctgtgctgtgggcctggccgtgctggacatcattgaaaatgaagacctgcagggcaatgccaagagggtgggcaactacctgacagagctgctgaagaagcagaaggccaagcacaccctgattggagacatccggggcatcggcctcttcatcggcatcgacctggtgaaggaccacctgaagaggaccccagccacagctgaggcccagcacatcatctacaagatgaaggagaagagggtgctgctgtctgcagatggcccccacagaaatgtgctgaagatcaagccacccatgtgcttcacagaggaggatgccaagttcatggtggaccagctggaccgcatcctgactgtgctggaggaggccatgggcaccaagacagagagcgtgaccagcgagaacaccccctgcaagaccaagatgctgaaggaggcccacatcgagctgctgcgggacagcaccacagacagcaaggagaaccccagcaggaagagaaatggcatgtgcacagacacccacagcctgctgagcaagaggctgaagacctag

SEQ ID NO: 32299 - DNA, 1482 bp, Artificial Sequence
  Description of Artificial Sequence: Synthetic coding sequence
atgtgtgagctgtacagcaagagggacaccctgggcctgaggaagaagcacatcggccccagctgcaaggtgttctttgccagtgaccccatcaagatcgtgcgggcccagaggcagtacatgtttgatgaaaatggagagcagtacctggactgcatcaacaacgtggcccacggcgtggtgaaggccgccctgaagcagatggagctgctgaacaccaacagccgcttcctgcatgacaacatcgtggagtatgccaagaggctgagcgccaccctgcctgagaagctgtctgtgtgctacttcaccaacagcggcagcgaggccaatgacctggccctgcggctggcccggcagttccggggccaccaggatgtgatcaccctggaccacgcctaccacggccacctgagcagcctgattgagatcagcccctacaagttccagaagggcaaggatgtgaagaaggagtttgtgcacgtggcccccaccccagacacctaccggggcaagtaccgggaggaccatgctgacagcgccagcgcctatgcagatgaggtgaagaagatcattgaagatgcccacaacagcggcaggaagattgctgccttcatcgccgagagcatgcagagctgtggcggccagatcatccccccagctggctacttccagaaggtggccgagtatgtgcatggagctggaggagtcttcatcgcagatgaggtgcaggtgggcttcggccgggtgggcaagcacttctggagcttccagatgtatggagaagattttgtgcctgacatcgtgaccatgggcaagcccatgggaaatggccaccctgtggcctgtgtggtgaccaccaaggagattgctgaggccttcagcagcagcggcatggagtacttcaacacctacggcggcaaccctgtgtcctgtgctgtgggcctggccgtgctggacatcattgaaaatgaagacctgcagggcaatgccaagagggtgggcaactacctgacagagctgctgaagaagcagaaggccaagcacaccctgattggagacatccggggcatcggcctcttcatcggcatcgacctggtgaaggaccacctgaagaggaccccagccacagctgaggcccagcacatcatctacaagatgaaggagaagagggtgctgctgtctgcagatggcccccacagaaatgtgctgaagatcaagccacccatgtgcttcacagaggaggatgccaagttcatggtggaccagctggaccgcatcctgactgtgctggaggaggccatgggcaccaagacagagagcgtgaccagcgagaacaccccctgcaagaccaagatgctgaaggaggcccacatcgagctgctgcgggacagcaccacagacagcaaggagaaccccagcaggaagagaaatggcatgtgcacagacacccacagcctgctgagcaagaggctgaagacctag

SEQ ID NO: 32300 - DNA, 1326 bp, Artificial Sequence
  Description of Artificial Sequence: Synthetic coding sequence
atgggccactgccaccctggggtggtgaaggccgccctgaagcagatggagctgctgaacaccaacagccgcttcctgcatgacaacatcgtggagtatgccaagaggctgagcgccaccctgcctgagaagctgtctgtgtgctacttcaccaacagcggcagcgaggccaatgacctggccctgcggctggcccggcagttccggggccaccaggatgtgatcaccctggaccacgcctaccacggccacctgagcagcctgattgagatcagcccctacaagttccagaagggcaaggatgtgaagaaggagtttgtgcacgtggcccccaccccagacacctaccggggcaagtaccgggaggaccatgctgacagcgccagcgcctatgcagatgaggtgaagaagatcattgaagatgcccacaacagcggcaggaagattgctgccttcatcgccgagagcatgcagagctgtggcggccagatcatccccccagctggctacttccagaaggtggccgagtatgtgcatggagctggaggagtcttcatcgcagatgaggtgcaggtgggcttcggccgggtgggcaagcacttctggagcttccagatgtatggagaagattttgtgcctgacatcgtgaccatgggcaagcccatgggaaatggccaccctgtggcctgtgtggtgaccaccaaggagattgctgaggccttcagcagcagcggcatggagtacttcaacacctacggcggcaaccctgtgtcctgtgctgtgggcctggccgtgctggacatcattgaaaatgaagacctgcagggcaatgccaagagggtgggcaactacctgacagagctgctgaagaagcagaaggccaagcacaccctgattggagacatccggggcatcggcctcttcatcggcatcgacctggtgaaggaccacctgaagaggaccccagccacagctgaggcccagcacatcatctacaagatgaaggagaagagggtgctgctgtctgcagatggcccccacagaaatgtgctgaagatcaagccacccatgtgcttcacagaggaggatgccaagttcatggtggaccagctggaccgcatcctgactgtgctggaggaggccatgggcaccaagacagagagcgtgaccagcgagaacaccccctgcaagaccaagatgctgaaggaggcccacatcgagctgctgcgggacagcaccacagacagcaaggagaaccccagcaggaagagaaatggcatgtgcacagacacccacagcctgctgagcaagaggctgaagacctag

SEQ ID NO: 32301 - DNA, 1353 bp, Artificial Sequence
  Description of Artificial Sequence: Synthetic coding sequence
atggctgctgaccagaggcccaaggctgacaccctggccctgcggcagaggctcatcagcagcagctgccgcctcttcttcccagaagatcctgtgaagatcgtgcgggcccagggccagtacatgtatgatgagcagggcgctgagtacatcgactgcatcagcaatgtggcccacgtgggccactgccaccccctggtggtgcaggccgcccacgagcagaaccaggtgctgaacaccaacagccgctacctgcatgacaacatcgtggactatgcccagaggctgtctgagaccctgcctgagcagctgtgtgtgttctacttcctgaacagcggcagcgaggccaatgacctggccctgcggctggcccggcactacacaggccaccaggatgtggtggtgctggaccacgcctaccacggccacctgagcagcctgattgacatcagcccctacaagttcaggaacctggatggccagaaggagtgggtgcacgtggcccccctgcctgacacctaccggggcccctaccgggaggaccaccccaacccagccatggcctatgccaatgaggtgaagagggtggtgtcctctgcccaggagaagggcaggaagattgctgccttctttgctgagagcctgcccagcgtgggcggccagatcatccccccagctggctacttcagccaggtggccgagcacatcaggaaggccggcggcgtgtttgtggctgatgagatccaggtgggcttcggccgggtgggcaagcacttctgggccttccagctgcagggcaaggactttgtgcctgacatcgtgaccatgggcaagagcattggaaatggccaccctgtggcctgtgtggccgccacccagcctgtggcccgggcctttgaggccaccggggtggagtacttcaacaccttcggcggcagccctgtgtcctgtgctgtgggcctggccgtgctgaatgtgctggagaaggagcagctgcaggaccacgccacctctgtgggcagcttcctgatgcagctgctgggccagcagaagatcaagcaccccatcgtgggagatgtgcggggcgtgggcctcttcatcggcgtggacctgatcaaggatgaggccaccaggaccccagccacagaggaggccgcctacctggtgtcccggctgaaggagaactacgtgctgctgagcacagatggccctggcaggaacatcctgaagttcaagccacccatgtgcttcagcctggacaatgcccggcaggtggtggccaagctggatgccatcctgacagacatggaggagaaggtgcgcagctgtgagaccctgcggctgcagccctag

SEQ ID NO: 32302 - DNA, 519 bp, Artificial Sequence
  Description of Artificial Sequence: Synthetic coding sequence
atgatctacagctgctgcatctttgtgtactgcatgtttgagtgcttcaagatcaagaacagcgtgaactaccacctgctcttcaccctggtgctcttcagcctcatcgtgaccaccgtgtacctgaaggtgaaggagcccatcttccaccaggtgatgtatggcatgctggtgttcaccctggtgctgcggagcatctacatcgtgacctgggtgtacccctggctgcggggcctgggctacaccagcctgggcatcttcctgctgggcttcctgttctggaacatcgacaacatcttctgtgagagcctgaggaacttcaggaagaaggtgccccccatcatcggcatcaccacccagttccacgcctggtggcacatcctgaccggcctgggcagctacctgcacatcctcttcagcctgtacaccaggaccctgtacctgcgctaccggcccaaggtgaagttcctgtttggcatctggcctgtgatcctgtttgagcccctgaggaagcactag

SEQ ID NO: 32303 - DNA, 804 bp, Artificial Sequence
  Description of Artificial Sequence: Synthetic coding sequence
atggccccagctgctgaccgggagggctactggggccccaccaccagcaccctggactggtgtgaggagaactacagcgtgacctggtacatcgccgagttctggaacacagtgagcaacctgatcatgatcatcccccccatgtttggagctgtgcagagcgtgagagatggcctggagaagcgctacatcgccagctacctggccctgactgtggtgggcatgggctcctggtgcttccacatgaccctgaagtatgagatgcagctgctggatgagctgcccatgatctacagctgctgcatctttgtgtactgcatgtttgagtgcttcaagatcaagaacagcgtgaactaccacctgctcttcaccctggtgctcttcagcctgattgtgaccaccgtgtacctgaaggtgaaggagcccatcttccaccaggtgatgtatggcatgctggtgttcaccctggtgctgcggagcatctacatcgtgacctgggtgtacccctggctgcggggcctgggctacaccagcctgggcatcttcctgctgggcttcctgttctggaacatcgacaacatcttctgtgagagcctgaggaacttcaggaagaaggtgccccccatcatcggcatcaccacccagttccacgcctggtggcacatcctgaccggcctgggcagctacctgcacatcctcttcagcctgtacaccaggaccctgtacctgcgctaccggcccaaggtgaagttcctgtttggcatctggcctgtgatcctgtttgagcccctgaggaagcactag

SEQ ID NO: 32304 - DNA, 693 bp, Artificial Sequence
  Description of Artificial Sequence: Synthetic coding sequence
atggccccagctgctgaccgggagggctactggggccccaccaccagcaccctggactggtgtgaggagaactacagcgtgacctggtacatcgccgagttcctggtgggcatgggctcctggtgcttccacatgaccctgaagtatgagatgcagctgctggatgagctgcccatgatctacagctgctgcatctttgtgtactgcatgtttgagtgcttcaagatcaagaacagcgtgaactaccacctgctcttcaccctggtgctcttcagcctcatcgtgaccaccgtgtacctgaaggtgaaggagcccatcttccaccaggtgatgtatggcatgctggtgttcaccctggtgctgcggagcatctacatcgtgacctgggtgtacccctggctgcggggcctgggctacaccagcctgggcatcttcctgctgggcttcctgttctggaacatcgacaacatcttctgtgagagcctgaggaacttcaggaagaaggtgccccccatcatcggcatcaccacccagttccacgcctggtggcacatcctgaccggcctgggcagctacctgcacatcctcttcagcctgtacaccaggaccctgtacctgcgctaccggcccaaggtgaagttcctgtttggcatctggcctgtgatcctgtttgagcccctgaggaagcactag

SEQ ID NO: 32305 - DNA, 678 bp, Artificial Sequence
  Description of Artificial Sequence: Synthetic coding sequence
atgatcatcccccccatgtttggagctgtgcagagcgtgagagatggcctggagaagcgctacatcgccagctacctggccctgactgtggtgggcatgggctcctggtgcttccacatgaccctgaagtatgagatgcagctgctggatgagctgcccatgatctacagctgctgcatctttgtgtactgcatgtttgagtgcttcaagatcaagaacagcgtgaactaccacctgctcttcaccctggtgctcttcagcctgattgtgaccaccgtgtacctgaaggtgaaggagcccatcttccaccaggtgatgtatggcatgctggtgttcaccctggtgctgcggagcatctacatcgtgacctgggtgtacccctggctgcggggcctgggctacaccagcctgggcatcttcctgctgggcttcctgttctggaacatcgacaacatcttctgtgagagcctgaggaacttcaggaagaaggtgccccccatcatcggcatcaccacccagttccacgcctggtggcacatcctgaccggcctgggcagctacctgcacatcctcttcagcctgtacaccaggaccctgtacctgcgctaccggcccaaggtgaagttcctgtttggcatctggcctgtgatcctgtttgagcccctgaggaagcactag

SEQ ID NO: 32306 - DNA, 405 bp, Artificial Sequence
  Description of Artificial Sequence: Synthetic coding sequence
atggcccagagccggctgattggcaccagcaccagccaggtgatgtatggcatgctggtgttcaccctggtgctgcggagcatctacatcgtgacctgggtgtacccctggctgcggggcctgggctacaccagcctgggcatcttcctgctgggcttcctgttctggaacatcgacaacatcttctgtgagagcctgaggaacttcaggaagaaggtgccccccatcatcggcatcaccacccagttccacgcctggtggcacatcctgaccggcctgggcagctacctgcacatcctcttcagcctgtacaccaggaccctgtacctgcgctaccggcccaaggtgaagttcctgtttggcatctggcctgtgatcctgtttgagcccctgaggaagcactag

SEQ ID NO: 32307 - DNA, 453 bp, Artificial Sequence
  Description of Artificial Sequence: Synthetic coding sequence
atgtctggagagctgagcaaccgcttccagggcggcaaggccttcggcctgctgaaggcccggcaggagcggcggctggccgagatcaaccgggagttcctgtgtgaccagaagtacagtgatgaggagaacctgcctgagaagctgacagccttcaaggagaagtacatggagtttgacctgaacaatgaaggagaaattgacctgatgagcctgaagaggatgatggagaagctgggcgtgcccaagacccacctggagatgaagaagatgatcagcgaggtgactggaggagtgtctgacaccatctcctacagagactttgtgaacatgatgctgggcaagaggtctgctgtgctgaagctggtgatgatgtttgagggcaaggccaatgaaagcagccccaagcctgtgggccccccacctgagcgggacatcgccagcctgccctag

SEQ ID NO: 32308 - DNA, 309 bp, Artificial Sequence
  Description of Artificial Sequence: Synthetic coding sequence
atgtctggagagctgagcaaccgcttccagggcggcaaggccttcggcctgctgaaggcccggcaggagcggcggctggccgagatcaaccgggagttcctgtgtgaccagaagtacagtgatgaggagaacctgcctgagaagctgacagccttcaaggagaagtacatggagtttgacctgaacaatgaaggagaaattgacctgatgagcctgaagaggatgatggagaagctgggcgtgcccaagacccacctggagatgaagaagatgatcagcgaggtgactggaggcagccatgatgtgtag

SEQ ID NO: 32309 - DNA, 285 bp, Artificial Sequence
  Description of Artificial Sequence: Synthetic coding sequence
atggagtttgacctgaacaatgaaggagaaattgacctgatgagcctgaagaggatgatggagaagctgggcgtgcccaagacccacctggagatgaagaagatgatcagcgaggtgactggaggagtgtctgacaccatctcctacagagactttgtgaacatgatgctgggcaagaggtctgctgtgctgaagctggtgatgatgtttgagggcaaggccaatgaaagcagccccaagcctgtgggccccccacctgagcgggacatcgccagcctgccctag

SEQ ID NO: 32310 - DNA, 429 bp, Artificial Sequence
  Description of Artificial Sequence: Synthetic coding sequence
atgtctggagagctgagcaaccgcttccagggcggcaaggccttcggcctgctgaaggcccggcaggagcggcggctggccgagatcaaccgggagttcctgtgtgaccagaagtacagtgatgaggagaacctgcctgagaagctgacagccttcaaggagaagtacatggagtttgacctgatgagcctgaagaggatgatggagaagctgggcgtgcccaagacccacctggagatgaagaagatgatcagcgaggtgactggaggagtgtctgacaccatctcctacagagactttgtgaacatgatgctgggcaagaggtctgctgtgctgaagctggtgatgatgtttgagggcaaggccaatgaaagcagccccaagcctgtgggccccccacctgagcgggacatcgccagcctgccctag

SEQ ID NO: 32311 - DNA, 531 bp, Artificial Sequence
  Description of Artificial Sequence: Synthetic coding sequence
atgtctggagagctgagcaaccgcttccagggcggcaaggccttcggcctgctgaaggcccggcaggagcggcggctggccgagatcaaccgctactgtgccggccgggagccccagctgcagaggatcagctgcagccagcacagctgcctgctggccctgctcttccaggagttcctgtgtgaccagaagtacagtgatgaggagaacctgcctgagaagctgacagccttcaaggagaagtacatggagtttgacctgaacaatgaaggagaaattgacctgatgagcctgaagaggatgatggagaagctgggcgtgcccaagacccacctggagatgaagaagatgatcagcgaggtgactggaggagtgtctgacaccatctcctacagagactttgtgaacatgatgctgggcaagaggtctgctgtgctgaagctggtgatgatgtttgagggcaaggccaatgaaagcagccccaagcctgtgggccccccacctgagcgggacatcgccagcctgccctag

SEQ ID NO: 32312 - DNA, 468 bp, Artificial Sequence
  Description of Artificial Sequence: Synthetic coding sequence
atggccagcaagatggtgatcagcgcccaccccaagatcctgctgcagctgatccagaaggacaagccaggcggccctggggcccgggtgcggcagaaggtgctggaggagttcctgtgtgaccagaagtacagtgatgaggagaacctgcctgagaagctgacagccttcaaggagaagtacatggagtttgacctgaacaatgaaggagaaattgacctgatgagcctgaagaggatgatggagaagctgggcgtgcccaagacccacctggagatgaagaagatgatcagcgaggtgactggaggagtgtctgacaccatctcctacagagactttgtgaacatgatgctgggcaagaggtctgctgtgctgaagctggtgatgatgtttgagggcaaggccaatgaaagcagccccaagcctgtgggccccccacctgagcgggacatcgccagcctgccctag

SEQ ID NO: 32313 - DNA, 1023 bp, Artificial Sequence
  Description of Artificial Sequence: Synthetic coding sequence
atgaggaaggagctgcagctgagcctgtctgtgaccctgctgctggtgtgtggcttcctgtaccagttcaccctgaagagcagctgcctcttctgcctgcccagcttcaagagccaccagggcctggaggccctgctgagccacagaagaggcatcgtgttcctggagaccagcgagaggatggagcccccccacctggtgtcctgcagcgtggagagcgctgccaagatctacccagagtggcctgtggtgttcttcatgaagggcctgacagacagcacccccatgcccagcaacagcacctacccagccttctccttcctgagcgccatcgacaacgtgttcctgttccccctggacatgaagaggctgctggaggacacccccctcttctcctggtacaaccagatcaatgccagcgctgagaggaactggctgcacatcagcagtgatgccagccggctggccatcatctggaagtatggaggcatctacatggacacagatgtgatcagcatccggcccatccctgaggagaacttcctggccgcccaggccagccgctacagcagcaatggcatcttcggcttcctgccccaccaccccttcctgtgggagtgcatggagaactttgtggagcactacaacagcgccatctggggcaaccagggccctgagctgatgaccaggatgctgcgggtgtggtgcaagctggaggacttccaggaggtgtctgacctgcgctgcctgaacatctccttcctgcacccccagcgcttctaccccatctcctaccgggagtggaggcgctactatgaggtgtgggacacagagcccagcttcaacgtgtcctatgccctgcacctgtggaaccacatgaaccaggagggccgggctgtgatccggggcagcaacaccctggtggagaacctgtacaggaagcactgccccaggacctacagagacctgatcaagggccctgagggctctgtgactggagagctgggccctggcaacaagtag

SEQ ID NO: 32314 - DNA, 1518 bp, Artificial Sequence
  Description of Artificial Sequence: Synthetic coding sequence
atggagcagacagagaagagcaaggtgtatgcagaaaatggcctgctggagaagatcaagctgtgcctgagcaagaagcccctgcccagccccacagagaggaagaagtttgaccatgactttgccatcagcaccagcttccacggcatccacaacatcgtgcagaacagaagcaagatcagaagagtgctgtggctggtggtggtgctgggctctgtgtccctggtgacctggcagatctacatccggctgctgaactacttcacctggcccaccaccaccagcattgaggtgcagtatgtggagaagatggagttccctgctgtgaccttctgcaacctgaaccgcttccagacagatgctgtggccaagtttggagtcatcttcttcctgtggcacatcgtgtccaaggtgctgcacctgcaggagatcacagccaacagcacaggcagccgggaggccacagactttgctgccagccaccagaacttcagcatcgtggagttcatcagaaataaaggcttctacctgaacaacagcaccctgctggactgtgagttcttcggcaagccctgcagccccaaggactttgcccacgtgttcacagaatatggcaactgcttcaccttcaaccacggggagaccctgcaggccaagaggaaggtgtctgtgtctggccggggcctgagcctgctcttcaacgtgaaccaggaggccttcacagacaacccagccctgggctttgtggatgctggcatcatctttgtgatccacagccccaagaaggtgccccagtttgatggcctgggcctgctgagccctgtgggcatgcacgcccgggtgaccatccggcaggtgaagacagtgcaccaggagtacccctggggcgagtgcaaccccaacatcaagctgcagaacttcagcagctacagcaccagcggctgcctgaaggagtgcaaggcccagcacatcaagaagcagtgtggctgtgtgcccttcctgctgcccggctacggcattgaatgtgacctgcagaagtacttcagctgtgtgtcccctgtgctggaccacatcgagttcaaggacctgtgcaccgtgggcacccacaacagcagctgccctgtgtcctgtgaggagattgagtacccagccaccatctcctacagcagcttccccagccagaaggccctgaagtacctgagcaagaagctgaaccagagcaggaagtacatccgggagaacctggtgaagattgagatcaactacagcgacctgaactacaagatcacccagcagcagaaggctgtgtctgtgtctgagctgctggccgacctgggcggccagctgggcctcttctgtggggccagcctcatcaccatcatcgagatcatcgagtacctgttcaccaacttctactggatctgcatcttcttcctgctgaagatcagcgagatgacccagtggaccccaccaccccagaaccacctgggcaacaagaaccgcatcgaggagtgctag

SEQ ID NO: 32315 - DNA, 2973 bp, Artificial Sequence
  Description of Artificial Sequence: Synthetic coding sequence
atgggcccccccagcagcagcggcttctacgtgtccagagctgtggccctgctgctggccggcctggtggccgccctgctgctggccctggccgtgctggccgccctgtatggccactgtgagcgggtgccccccagcgagctgcccggcctgcgggacctggaggccgagagcagcccccccctgcggcagaagcccacccccacccccaagcccagcagcgcccgggagctggccgtgaccaccacccccagcaactggaggcctcctggcccctgggaccagctgcggctgcccccctggctggtgcccctgcactatgacctggagctgtggccccagctgcggccagatgagctgcctgctggcagcctgcccttcaccggccgggtgaacatcaccgtgcgctgcaccgtggccaccagccggctgctgctgcacagcctcttccaggactgtgagcgggcagaggtgcggggccccctgagccctggcactggaaatgccaccgtgggccgggtgcctgtggatgatgtgtggtttgccctggacacagagtacatggtgctggagctgtctgagcccctgaagccaggcagcagctatgagctgcagctgtccttcagcggcctggtgaaggaggacctgcgggagggcctcttcctgaatgtgtacacagaccagggcgagcggcgggccctgctggccagccagctggagcccacctttgcccgctacgtgttcccctgctttgatgagcccgccctgaaggccaccttcaacatcaccatgatccaccaccccagctatgtggccctgagcaacatgcccaagctgggccagagcgagaaggaggatgtgaatggcagcaagtggacagtgaccaccttcagcaccaccccccacatgcccacctacctggtggccttcgtcatctgtgactatgaccacgtgaacagaacagagcggggcaaggagatccgcatctgggccaggaaggatgccatcgccaacggcagcgctgactttgccctgaacatcaccggccccatcttctccttcctggaggacctcttcaacatctcctacagcctgcccaagacagacatcatcgccctgcccagctttgacaaccacgccatggagaactggggcctgatgatctttgatgagagcggcctgctgctggagcccaaggaccagctgacagagaagaagaccctcatctcctatgtggtgtcccatgaaattggccaccagtggtttggaaacctggtgaccatgaactggtggaacaacatctggctgaatgaaggatttgccagctactttgaatttgaggtgatcaactacttcaaccccaagctgcccagaaatgagatcttcttcagcaacatcctgcacaacatcctgagagaagatcatgccctggtgaccagggctgtggccatgaaggtggagaacttcaagaccagcgagatccaggagctgtttgacatcttcacctacagcaaaggagcctccatggccaggatgctgagctgcttcctgaatgagcacctgtttgtgtctgccctgaagagctacctgaagaccttctcctacagcaatgctgagcaggatgacctgtggaggcacttccagatggccattgatgaccagagcaccgtcatcctgcctgccaccatcaagaacatcatggacagctggacccaccagagcggcttccctgtgatcaccctgaatgtgtccactggagtgatgaagcaggagcccttctacctggagaacatcaagaacagaaccctgctgaccagcaatgacacctggatcgtgcccatcctgtggatcaagaatggcaccacccagcccctggtgtggctggaccagagcagcaaggtgtttcctgagatgcaggtgtctgacagcgaccatgactgggtgatcctgaacctgaacatgacaggctactacagagtgaactatgacaagctgggctggaagaagctgaaccagcagctggagaaggaccccaaggccatccctgtgatccaccggctgcagctgattgatgatgccttcagcctgagcaagaacaactacatcgagattgaaacagccctggagctgaccaagtacctggccgaggaggatgagatcatcgtgtggcacacagtgctggtgaacctggtgacccgggacctggtgtctgaggtgaacatctatgacatctacagcctgctgaagcgctacctgctgaagaggctgaacctgatctggaacatctacagcaccatcatcagagaaaatgtgctggccctgcaggatgactacctggccctgatcagcctggagaagctgtttgtgacagcctgctggctgggcctggaggactgcctgcagctgagcaaggagctgtttgccaagtgggtggaccacccagaaaatgagatcccctaccccatcaaggatgtggtgctgtgctatggaattgccctgggcagtgacaaggagtgggacatcctgctgaacacctacaccaacaccaccaacaaggaggagaagatccagctggcctatgccatgagctgcagcaaggacccctggatcctgaaccgctacatggagtatgccatcagcaccagccccttcaccagcaatgagaccaacatcatcgaggtggtggccagcagcgaggtgggccgctacgtggccaaggacttcctggtgaacaactggcaggccgtgtccaagagatatggcacccagagcctcatcaacctgatctacaccatcggccgcacagtgaccacagacctgcagatcgtggagctgcagcagttcttcagcaacatgctggaggagcaccagaggatccgggtgcacgccaacctgcagaccatcaagaatgaaaacctgaagaacaagaagctgagcgccagaattgctgcctggctgcggaggaacacctag

SEQ ID NO: 32316 - DNA, 2940 bp, Artificial Sequence
  Description of Artificial Sequence: Synthetic coding sequence
atgggcccccccagcagcagcggcttctacgtgtccagagctgtggccctgctgctggccggcctggtggccgccctgctgctggccctggccgtgctggccgccctgtatggccactgtgagcgggtgccccccagcgagctgcccggcctgcgggacctggaggccgagagcagcccccccctgcggcagaagcccacccccacccccaagcccagcagcgcccgggagctggccgtgaccaccacccccagcaactggaggcctcctggcccctgggaccagctgcggctgcccccctggctggtgcccctgcactatgacctggagctgtggccccagctgcggccagatgagctgcctgctggcagcctgcccttcaccggccgggtgaacatcaccgtgcgctgcaccgtggccaccagccggctgctgctgcacagcctcttcctgagccctggcactggaaatgccaccgtgggccgggtgcctgtggatgatgtgtggtttgccctggacacagagtacatggtgctggagctgtctgagcccctgaagccaggcagcagctatgagctgcagctgtccttcagcggcctggtgaaggaggacctgcgggagggcctcttcctgaatgtgtacacagaccagggcgagcggcgggccctgctggccagccagctggagcccacctttgcccgctacgtgttcccctgctttgatgagcccgccctgaaggccaccttcaacatcaccatgatccaccaccccagctatgtggccctgagcaacatgcccaagctgggccagagcgagaaggaggatgtgaatggcagcaagtggacagtgaccaccttcagcaccaccccccacatgcccacctacctggtggcctttgtgatctgtgactatgaccacgtgaacagaacagagcggggcaaggagatccgcatctgggccaggaaggatgccatcgccaatggatctgctgactttgccctgaacatcaccggccccatcttctccttcctggaggacctcttcaacatctcctacagcctgcccaagacagacatcatcgccctgcccagctttgacaaccacgccatggagaactggggcctgatgatctttgatgaaagtggcctgctgctggagcccaaggaccagctgacagagaagaagaccctcatctcctatgtggtgtcccatgagatcggccaccagtggtttggaaacctggtgaccatgaactggtggaacaacatctggctgaatgaaggatttgccagctactttgaatttgaagtcatcaactacttcaaccccaagctgcccagaaatgagatcttcttcagcaacatcctgcacaacatcctgcgggaggaccacgccctggtgaccagggctgtggccatgaaggtggagaacttcaagaccagcgagatccaggagctgtttgacatcttcacctacagcaagggggcctccatggccaggatgctgagctgcttcctgaatgagcacctgtttgtgtctgccctgaagagctacctgaagaccttctcctacagcaatgctgagcaggatgacctgtggaggcacttccagatggccattgatgaccagagcaccgtcatcctgcctgccaccatcaagaacatcatggacagctggacccaccagagcggcttccctgtgatcaccctgaatgtgtccactggagtgatgaagcaggagcccttctacctggagaacatcaagaacagaaccctgctgaccagcaatgacacctggatcgtgcccatcctgtggatcaagaatggcaccacccagcccctggtgtggctggaccagagcagcaaggtgtttcctgagatgcaggtgtctgacagcgaccatgactgggtgatcctgaacctgaacatgacaggctactacagagtgaactatgacaagctgggctggaagaagctgaaccagcagctggagaaggaccccaaggccatccctgtgatccaccggctgcagctgattgatgatgccttcagcctgagcaagaacaactacattgaaattgaaacagccctggagctgaccaagtacctggccgaggaggatgagatcatcgtgtggcacacagtgctggtgaacctggtgacccgggacctggtgtctgaggtgaacatctatgacatctacagcctgctgaagcgctacctgctgaagaggctgaacctgatctggaacatctacagcaccatcatccgggagaatgtgctggccctgcaggatgactacctggccctgatcagcctggagaagctgtttgtgacagcctgctggctgggcctggaggactgcctgcagctgagcaaggagctgtttgccaagtgggtggaccacccagaaaatgagatcccctaccccatcaaggatgtggtgctgtgctacggcatcgccctgggcagtgacaaggagtgggacatcctgctgaacacctacaccaacaccaccaacaaggaggagaagatccagctggcctatgccatgagctgcagcaaggacccctggatcctgaaccgctacatggagtatgccatcagcaccagccccttcaccagcaatgagaccaacatcatcgaggtggtggccagcagcgaggtgggccgctacgtggccaaggacttcctggtgaacaactggcaggccgtgtccaagagatatggcacccagagcctcatcaacctgatctacaccatcggccgcacagtgaccacagacctgcagatcgtggagctgcagcagttcttcagcaacatgctggaggagcaccagaggatccgggtgcacgccaacctgcagaccatcaagaatgaaaacctgaagaacaagaagctgagcgccagaattgctgcctggctgcggaggaacacctag

SEQ ID NO: 32317 - DNA, 681 bp, Artificial Sequence
  Description of Artificial Sequence: Synthetic coding sequence
atgaaggtggagaacttcaagaccagcgagatccaggagctgtttgacatcttcacctacagcaagggggcctccatggccaggatgctgagctgcttcctgaatgagcacctgtttgtgtctgccctgaagagctacctgaagaccttctcctacagcaatgctgagcaggatgacctgtggaggcacttccagatggccattgatgaccagagcaccgtcatcctgcctgccaccatcaagaacatcatggacagctggacccaccagagcggcttccctgtgatcaccctgaatgtgtccactggagtgatgaagcaggagcccttctacctggagaacatcaagaacagaaccctgctgaccagcaatgacacctggatcgtgcccatcctgtggatcaagaatggcaccacccagcccctggtgtggctggaccagagcagcaaggtgtttcctgagatgcaggtgtctgacagcgaccatgactgggtgatcctgaacctgaacatgacaggctactacagagtgaactatgacaagctgggctggaagaagctgaaccagcagctggagaaggaccccaaggccatccctgtgatccaccggctgcagctgattgatgatgccttcagcctgagcaacctgcaggactttggccacctgaaggtgcccaactag

SEQ ID NO: 32318 - DNA, 519 bp, Artificial Sequence
  Description of Artificial Sequence: Synthetic coding sequence
atgggagagagcagcgaggacatcgaccagatgttcagcaccctgctgggggagatggacctgctgacccagagcctgggcgtggacaccctgcccccaccagaccccaacccccccagggctgagttcaactacagcgtgggcttcaaggacctgaatgaaagcctgaatgccctggaggaccaggacctggatgccctgatggctgacctggtggccgacatcagcgaggccgagcagaggaccatccaggcccagaaggagagcctgcagaaccagcaccacagcgccagcctgcaggccagcatcttctctggagctgccagcctgggctacggcaccaacgtggccgccaccggcatcagccagtatgaagatgacctgcccccacctcctgctgaccctgtgctggacctgcccctgcccccacctcctcctgagcccctgagccaggtgtccatgtgggaccagcgctggcaggaccaccagcccctgctgcccatcacagatgtgccctag

SEQ ID NO: 32319 - DNA, 2001 bp, Artificial Sequence
  Description of Artificial Sequence: Synthetic coding sequence
atgggagagagcagcgaggacatcgaccagatgttcagcaccctgctgggggagatggacctgctgacccagagcctgggcgtggacaccctgcccccaccagaccccaacccccccagggctgagttcaactacagcgtgggcttcaaggacctgaatgaaagcctgaatgccctggaggaccaggacctggatgccctgatggctgacctggtggccgacatcagcgaggccgagcagaggaccatccaggcccagaaggagagcctgcagaaccagcaccacagcgccagcctgcaggccagcatcttctctggagctgccagcctgggctacggcaccaacgtggccgccaccggcatcagccagtatgaagatgacctgcccccacctcctgctgaccctgtgctggacctgcccctgcccccacctcctcctgagcccctgagccaggaggaggaggaggcccaggccaaggctgacaagatcaagctggccctggagaagctgaaggaggccaaggtgaagaagctggtggtgaaggtgcacatgaatgacaacagcaccaagagcctgatggtggatgagcggcagctggccagagatgtgctggacaacctgtttgagaagacccactgtgactgcaatgtggactggtgcctgtatgagatctacccagagctgcagatcgagcgcttctttgaagatcatgaaaatgtggtggaggtgctgagtgactggacccgggacacagagaacaagatcctcttcctggagaaggaggagaagtatgctgtgttcaagaacccccagaacttctacctggacaacagaggcaagaaggagagcaaggagaccaatgagaagatgaatgccaagaacaaggagagcctgctggaggagagcttctgtggcaccagcatcatcgtgcctgagctggagggcgccctgtacctgaaggaggatggcaagaagtcctggaagaggcgctacttcctgctgcgggccagcggcatctactacgtgcccaagggcaagaccaagaccagccgggacctggcctgcttcatccagtttgaaaatgtgaacatctactacggcacccagcacaagatgaagtacaaggcccccacagactactgctttgtgctgaagcacccccagatccagaaggagagccagtacatcaagtacctgtgctgtgatgacaccaggaccctgaaccagtgggtgatgggcatccgcatcgccaagtatggcaagaccctgtatgacaactaccagagagctgtggccaaggccggcctggccagccgctggaccaacctgggcaccgtgaatgctgctgccccagcccagcccagcacaggccccaagacaggcaccacccagcccaacggccagatcccccaggccacccacagcgtgtctgctgtgctgcaggaggcccagagacatgctgagaccagcaaggacaagaagccagccctgggcaaccaccacgaccctgctgtgccccgggccccccacgcccccaagagcagcctgcccccacctcctcctgtgagaagaagcagtgacaccagcggcagccctgccacccccctgaaggccaagggcactggaggcggcggcctgcctgcccccccagatgacttcctgcccccacctcctcctcctccacccctggatgatcctgagctgcccccacctcctccagacttcatggagcccccaccagactttgtgcccccacctcctccttcctatgccggcattgctggcagcgagctgcccccacctcctcctcctcctccagccccagccccagcccctgtgcctgacagcgcccggcccccacctgctgtggccaagaggcctcctgtgccccccaagaggcaggagaaccctggccaccctgggggcgccggcggcggggagcaggacttcatgtctgacctgatgaaggccctgcagaagaagagaggaaatgtgtcctag

SEQ ID NO: 32320 - DNA, 1908 bp, Artificial Sequence
  Description of Artificial Sequence: Synthetic coding sequence
atgggagagagcagcgaggacatcgaccagatgttcagcaccctgctgggggagatggacctgctgacccagagcctgggcgtggacaccctgcccccaccagaccccaacccccccagggctgagttcaactacagcgtgggcttcaaggacctgaatgaaagcctgaatgccctggaggaccaggacctggatgccctgatggctgacctggtggccgacatcagcgaggccgagcagaggaccatccaggcccagaaggagagcctgcagaaccagcaccacagcgccagcctgcaggccagcatcttctctggagctgccagcctgggctacggcaccaacgtggccgccaccggcatcagccagtatgaagatgacctgcccccacctcctgctgaccctgtgctggacctgcccctgcccccacctcctcctgagcccctgagccaggaggaggaggaggcccaggccaaggctgacaagatcaagctggccctggagaagctgaaggaggccaaggtgaagaagctggtggtgaaggtgcacatgaatgacaacagcaccaagagcctgatggtggatgagcggcagctggccagagatgtgctggacaacctgtttgagaagacccactgtgactgcaatgtggactggtgcctgtatgagatctacccagagctgcagatcgagcgcttctttgaagatcatgaaaatgtggtggaggtgctgagtgactggacccgggacacagagaacaagatcctcttcctggagaaggaggagaagtatgctgtgttcaagaacccccagaacttctacctggacaacagaggcaagaaggagagcaaggagaccaatgagaagatgaatgccaagaacaaggagagcctgctggaggagagcttctgtggcaccagcatcatcgtgcctgagctggagggcgccctgtacctgaaggaggatggcaagaagtcctggaagaggcgctacttcctgctgcgggccagcggcatctactacgtgcccaagggcaagaccaagaccagccgggacctggcctgcttcatccagtttgaaaatgtgaacatctactacggcacccagcacaagatgaagtacaaggcccccacagactactgctttgtgctgaagcacccccagatccagaaggagagccagtacatcaagtacctgtgctgtgatgacaccaggaccctgaaccagtgggtgatgggcatccgcatcgccaagtatggcaagaccctgtatgacaactaccagagagctgtggccaaggccggcctggccagccgctggaccaacctgggcaccgtgaatgctgctgccccagcccagcccagcacaggccccaagacaggcaccacccagcccaacggccagatcccccaggccacccacagcgtgtctgctgtgctgcaggaggcccagagacatgctgagaccagcaaggacaagaagccagccctgggcaaccaccacgaccctgctgtgccccgggccccccacgcccccaagagcagcctgcccccacctcctcctgtgagaagaagcagtgacaccagcggcagccctgccacccccctgaaggccaagggcactggaggcggcggcctgcctgctgcccgggcccgggcccggccccggccccggctgcggcaggccgccccccggggcggccaggaggccagctgtgccccccaggaggcccgggagccccgggccccccggcgcagcagaagaagaggagcccgcttccacgtgcggccccatgagagctttgccaaggaggagcggcagagggtgctgggcaccggcatgatgtctgtgcctgagggggaggccagcctgaccccatctgctggctttgccagccggctgccctag

SEQ ID NO: 32321 - DNA, 738 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctggtgatccaggccgtgttcttcggcatctgtgtgctgacagacctgagcagcctgctgacccggggcagcggcaaccaggagcaggagcggcagctgaagaagctgatcagcctgcgggactggatgctggccgtgctggccttccctgtgggcgtgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggcccgcatcatcttcttcggcagcaccaccatcctgatgaacttcctgtacctgctgggggaggtgctgaacaactacatctgggacacccagaagaagccacccagctggcaggacatgaagatcaagttcatgtacctgggccccagcagctag

SEQ ID NO: 32322 - DNA, 561 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggcccgcatcatcttcttcggcagcaccaccatcctgatgaacttcctgtacctgctgggggaggtgctgaacaactacatctgggacacccagaagtccatggaggaggagaaggagaagcccaagctggagtag

SEQ ID NO: 32323 - DNA, 717 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctggtgatccaggccgtgttcttcggcatctgtgtgctgacagacctgagcagcctgctgacccggggcagcggcaaccaggagcaggagcggcagctgaagaagctgatcagcctgcgggactggatgctggccgtgctggccttccctgtgggcgtgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggcccgcatcatcttcttcggcagcaccaccatcctgatgaacttcctgtacctgctgggggaggtgctgaacaactacatctgggacacccagaagtccatggaggaggagaaggagaagcccaagctggagtag

SEQ ID NO: 32324 - DNA, 144 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctgtag

SEQ ID NO: 32325 - DNA, 405 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctggtgatccaggccgtgttcttcggcatctgtgtgctgacagacctgagcagcctgctgacccggggcagcggcaaccaggagcaggagcggcagctgaagaagctgatcagcctgcgggactggatgctggccgtgctggccttccctgtgggcgtgtttgtggtggccgtgttctggatcatctatgcctatgaccgggagatgatctaccccaagctgctggacaacttcatccctggctggctgaaccacggcatgctgtag

SEQ ID NO: 32326 - DNA, 579 bp, Artificial Sequence
  Description of Artificial Sequence: Synthetic coding sequence
atgaccaaggtgctgaggatggccatcctgctgagctactgcagcatcctgtgcaactacaaggccatcgagatgcccagccaccagacctatggaggctcctggaagttcctgaccttcatcgacctggtgatccaggccgtgttcttcggcatctgtgtgctgacagacctgagcagcctgctgacccggggcagcggcaaccaggagcaggagcggcagctgaagaagctgatcagcctgcgggactggatgctggccgtgctggccttccctgtgggcgtgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggccaggtag

SEQ ID NO: 32327 - DNA, 705 bp, Artificial Sequence
  Description of Artificial Sequence: Synthetic coding sequence
atgaccaaggtgctgaggatggccatcctgctgagctactgcagcatcctgtgcaactacaaggccatcgagatgcccagccaccagacctatggaggctcctggaagttcctgaccttcatcgacctggtgatccaggccgtgttcttcggcatctgtgtgctgacagacctgagcagcctgctgacccggggcagcggcaaccaggagcaggagcggcagctgaagaagctgatcagcctgcgggactggatgctggccgtgctggccttccctgtgggcgtgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggcccgcatcatcttcttcggcagcaccaccatcctgatgaacttcctgtacctgctgggggaggtgctgaacaactacatctgggacacccagaagtccatggaggaggagaaggagaagcccaagctggagtag

SEQ ID NO: 32328 - DNA, 375 bp, Artificial Sequence
  Description of Artificial Sequence: Synthetic coding sequence
atggccctggtgccctgccaggtgctgaggatggccatcctgctgagctactgcagcatcctgtgcaactacaaggccatcgagatgcccagccaccagacctatggaggctcctggaagttcctgaccttcatcgacctgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgtag

SEQ ID NO: 32329 - DNA, 417 bp, Artificial Sequence
  Description of Artificial Sequence: Synthetic coding sequence
atgctggccgtgctggccttccctgtgggcgtgtttgtggtggccgtgttctggatcatctatgcctatgaccgggagatgatctaccccaagctgctggacaacttcatccctggctggctgaaccacggcatgcacaccaccgtgctgcccttcatcctgattgagatgaggaccagccaccaccagtaccccagccgcagcagcggcctgacagccatctgcaccttctctgtgggctacatcctgtgggtgtgctgggtgcaccacgtgacaggcatgtgggtgtaccccttcctggagcacatcggccctggggcccgcatcatcttcttcggcagcaccaccatcctgatgaacttcctgtacctgctgggggaggtgctgaacaactacatctgggacacccagaagtag

SEQ ID NO: 32330 - DNA, 1305 bp, Artificial Sequence
  Description of Artificial Sequence: Synthetic coding sequence
atggagagcgagagcgagagcggggctgctgctgacaccccacccctggagaccctgtccttccatggagatgaggagatcatcgaggtggtggagctggaccccggccccccagaccctgatgacctggcccaggagatggaggatgtggactttgaggaggaggaggaggaggagggcaatgaggagggctgggtgctggagccccaggagggcgtggtgggctccatggagggcccagatgattctgaggtgacctttgccctgcacagcgcctctgtgttctgtgtgtccctggaccccaagaccaacaccctggccgtgactggaggagaagatgacaaggcctttgtgtggaggctgagtgatggagagctgctgtttgaatgtgccggccacaaggacagcgtgacctgtgccggcttcagccatgacagcaccctggtggccactggagacatgagcggcctgctgaaggtgtggcaggtggacaccaaggaggaggtgtggagctttgaggccggggacctggagtggatggagtggcacccccgggcccctgtgctgctggccggcacagcagatggcaacacctggatgtggaaggtgcccaatggagactgcaagaccttccagggccccaactgcccagccacctgtggccgggtgctgcctgatggcaagagagctgtggtgggctatgaagatggcaccatccgcatctgggacctgaagcagggcagccccatccacgtgctgaagggcacagagggccaccagggccccctgacctgtgtggccgccaaccaggacggcagcctcatcctgactggatctgtggactgccaggccaagctggtgtctgccaccaccgggaaggtggtgggcgtcttccggcctgagaccgtggccagccagcccagcctgggggagggggaggagagcgagagcaacagcgtggagagcctgggcttctgcagcgtgatgcccctggccgctgtgggctacctggatggcaccctggccatctatgacctggccacccagaccctgcggcaccagtgccagcaccagagcggcatcgtgcagctgctgtgggaggccggcacagctgtggtgtacacctgcagcctggatggcatcgtgcggctgtgggatgccaggacaggccgcctgctgacagactaccggggccacacagctgagatcctggactttgccctgagcaaggatgccagcctggtggtgaccaccagcggggaccacaaggccaaggtgttctgtgtgcagaggccagacagatag

SEQ ID NO: 32331 - DNA, 2721 bp, Artificial Sequence
  Description of Artificial Sequence: Synthetic coding sequence
atgtggagggccaagctgcggcggggcacctgtgagcctgctgtgaaggtggaggaccccctgtgcaacttccacagccccaacttcctgcgcatcagcgaggtggagatgaggggctctgaagatgctgctgctggcaccgtgctgcagaggctcatccaggagcagctgcgctatggcacccccacagagaacatgaacctgctggccatccagcaccaggccaccggcagcgctggccctgcccaccccaccaacaacttcagcagcacagagaacctgacccaggaggacccccagatggtgtaccagagcgcccggcaggagccccagggccaggagcaccaggtggacaacacagtgatggagaagcaggtgcgcagcacccagccccagcagaacaatgaggagctgcccacctatgaggaggccaaggcccagagccagttcttccggggccagcagcagcagcagcagcagcagggcgctgtgggccacggctactacatggccggcggcaccagccagaagagcaggacagagggccggcccaccgtgaacagagccaacagcggccaggcccacaaggatgaggccctgaaggagctgaagcagggccacgtgcgcagcctgtctgagcgcatcatgcagctgagcctggagagaaatggagccaagcagcacctgcccggcagcggaaatggcaagggcttcaaggtgggcggcggccccagccctgcccagcctgctgggaaggtgctggacccccggggccccccacctgagtaccccttcaagaccaagcagatgatgagccctgtgtccaagacccaggagcacggcctcttctacggggaccagcaccctggcatgctgcacgagatggtgaagccctacccagccccccagcctgtgaggacagatgtggccgtgctgcgctaccagcccccaccagaatatggagtgaccagccggccctgccagctgcccttccccagcaccatgcagcagcacagccccatgagcagccagaccagcagcgccagcggccccctgcacagcgtgtccctgcccctgcccctgcccatggccctgggcgccccccagcccccacctgctgccagccccagccagcagctgggcccagatgcctttgccatcgtggagcgggcccagcagatggtggagatcctgacagaagaaaatagagtgctgcaccaggagctgcagggctactatgacaatgctgacaagctgcacaagtttgagaaggagctgcagaggatcagcgaggcctatgagagcctggtgaagagcaccaccaagcgggagagcctggacaaggccatgaggaacaagctggagggggagatccggcggctgcatgacttcaacagagacctgcgggaccggctggagacagccaaccggcagctgagcagccgggagtatgagggccacgaggacaaggctgctgagggccactacgccagccagaacaaggagttcctgaaggagaaggagaagctggagatggagctggccgctgtgaggacagccagcgaggaccacagaagacacatcgagatcctggaccaggccctgagcaatgcccaggcccgggtcatcaagctggaggaggagctgcgggagaagcaggcctacgtggagaaggtggagaagctgcagcaggccctgacccagctgcagagcgcctgtgagaagcgggagcagatggagcggcggctgcggacctggctggagcgggagctggatgccctgcggacccagcagaagcacggcaatggccagcctgccaacatgcctgagtacaatgccccagccctgctggagctggtgcgggagaaggaggagcgcatcctggccctggaggccgacatgaccaagtgggagcagaagtacctggaggagagcaccatccgccactttgccatgaatgctgctgccacagctgctgctgagcgggacaccaccatcatcaaccacagcagaaatggcagctatggagagagcagcctggaggcccacatctggcaggaggaggaggaggtggtgcaggccaacagacgctgccaggacatggagtacaccatcaagaacctgcacgccaagatcatcgagaaggatgccatgatcaaggtgctgcagcagaggagcaggaaggatgctgggaagacagacagcagcagcctgcggcctgcccggtctgtgcccagcattgctgctgccaccggcacccacagccggcagaccagcctgaccagcagccagctggccgaggagaagaaggaggagaagacctggaagggcagcatcggcctgctgctgggcaaggagcaccacgagcacgccagcgcccccctgctgcccccaccacccaccagcgccctgagcagcatcgccagcaccacagctgccagcagcgcccacgccaagacaggcagcaaggacagcagcacccagacagacaagtctgctgagctgttctggcccagcatggccagcctgcccagccggggccgcctgagcaccaccccagcccacagccctgtgctgaagcaccctgctgccaagggcacagctgagaagctggagaacagccctggccacggcaagagcccagaccaccggggccgggtgagcagcctgctgcacaagccagagttcccagatggagagatgatggaggtgctgatctag

SEQ ID NO: 32332 - DNA, 1632 bp, Artificial Sequence
  Description of Artificial Sequence: Synthetic coding sequence
atgtggagggccaagctgcggcggggcacctgtgagcctgctgtgaagggcagccccagcgcctgctacagccccagcagccctgtgcaggtgctggaggacagcacctacttctccccagacttccagctgtacagcggcagacatgagaccagcgccctgactgtggaggccaccagcagcatccgggagaaggtggtggaggaccccctgtgcaacttccacagccccaacttcctgcgcatcagcgaggtggagatgaggggctctgaagatgctgctgctggcaccgtgctgcagaggctcatccaggagcagctgcgctatggcacccccacagagaacatgaacctgctggccatccagcaccaggccaccggcagcgctggccctgcccaccccaccaacaacttcagcagcacagagaacctgacccaggaggacccccagatggtgtaccagagcgcccggcaggagccccagggccaggagcaccaggtggacaacacagtgatggagaagcaggtgcgcagcacccagccccagcagaacaatgaggagctgcccacctatgaggaggccaaggcccagagccagttcttccggggccagcagcagcagcagcagcagcagggcgctgtgggccacggctactacatggccggcggcaccagccagaagagcaggacagagggccggcccaccgtgaacagagccaacagcggccaggcccacaaggatgaggccctgaaggagctgaagcagggccacgtgcgcagcctgtctgagcgcatcatgcagctgagcctggagagaaatggagccaagcagcacctgcccggcagcggaaatggcaagggcttcaaggtgggcggcggccccagccctgcccagcctgctgggaaggtgctggacccccggggccccccacctgagtaccccttcaagaccaagcagatgatgagccctgtgtccaagacccaggagcacggcctcttctacggggaccagcaccctggcatgctgcacgagatggtgaagccctacccagccccccagcctgtgaggacagatgtggccgtgctgcgctaccagcccccaccagaatatggagtgaccagccggccctgccagctgcccttccccagcaccatgcagcagcacagccccatgaacttccgcaccagcctgaccagcagccagctggccgaggagaagaaggaggagaagacctggaagggcagcatcggcctgctgctgggcaaggagcaccatgaacatgccagcgcccccctgctgcccccaccacccaccagcgccctgagcagcatcgccagcaccacagctgccagcagcgcccacgccaagacaggcagcaaggacagcagcacccagacagacaagtctgctgagctgttctggcccagcatggccagcctgcccagccggggccgcctgagcaccaccccagcccacagccctgtgctgaagcaccctgctgccaagggcacagctgagaagctggagaacagccctggccacggcaagagcccagaccaccggggccgggtgagcagcctgctgcacaagccagagttcccagatggagagatgatggaggtgctgatctag

SEQ ID NO: 32333 - DNA, 2871 bp, Artificial Sequence
  Description of Artificial Sequence: Synthetic coding sequence
atgtggagggccaagctgcggcggggcacctgtgagcctgctgtgaagggcagccccagcgcctgctacagccccagcagccctgtgcaggtgctggaggacagcacctacttctccccagacttccagctgtacagcggcagacatgagaccagcgccctgactgtggaggccaccagcagcatccgggagaaggtggtggaggaccccctgtgcaacttccacagccccaacttcctgcgcatcagcgaggtggagatgaggggctctgaagatgctgctgctggcaccgtgctgcagaggctcatccaggagcagctgcgctatggcacccccacagagaacatgaacctgctggccatccagcaccaggccaccggcagcgctggccctgcccaccccaccaacaacttcagcagcacagagaacctgacccaggaggacccccagatggtgtaccagagcgcccggcaggagccccagggccaggagcaccaggtggacaacacagtgatggagaagcaggtgcgcagcacccagccccagcagaacaatgaggagctgcccacctatgaggaggccaaggcccagagccagttcttccggggccagcagcagcagcagcagcagcagggcgctgtgggccacggctactacatggccggcggcaccagccagaagagcaggacagagggccggcccaccgtgaacagagccaacagcggccaggcccacaaggatgaggccctgaaggagctgaagcagggccacgtgcgcagcctgtctgagcgcatcatgcagctgagcctggagagaaatggagccaagcagcacctgcccggcagcggaaatggcaagggcttcaaggtgggcggcggccccagccctgcccagcctgctgggaaggtgctggacccccggggccccccacctgagtaccccttcaagaccaagcagatgatgagccctgtgtccaagacccaggagcacggcctcttctacggggaccagcaccctggcatgctgcacgagatggtgaagccctacccagccccccagcctgtgaggacagatgtggccgtgctgcgctaccagcccccaccagaatatggagtgaccagccggccctgccagctgcccttccccagcaccatgcagcagcacagccccatgagcagccagaccagcagcgccagcggccccctgcacagcgtgtccctgcccctgcccctgcccatggccctgggcgccccccagcccccacctgctgccagccccagccagcagctgggcccagatgcctttgccatcgtggagcgggcccagcagatggtggagatcctgacagaagaaaatagagtgctgcaccaggagctgcagggctactatgacaatgctgacaagctgcacaagtttgagaaggagctgcagaggatcagcgaggcctatgagagcctggtgaagagcaccaccaagcgggagagcctggacaaggccatgaggaacaagctggagggggagatccggcggctgcatgacttcaacagagacctgcgggaccggctggagacagccaaccggcagctgagcagccgggagtatgagggccacgaggacaaggctgctgagggccactacgccagccagaacaaggagttcctgaaggagaaggagaagctggagatggagctggccgctgtgaggacagccagcgaggaccacagaagacacatcgagatcctggaccaggccctgagcaatgcccaggcccgggtcatcaagctggaggaggagctgcgggagaagcaggcctacgtggagaaggtggagaagctgcagcaggccctgacccagctgcagagcgcctgtgagaagcgggagcagatggagcggcggctgcggacctggctggagcgggagctggatgccctgcggacccagcagaagcacggcaatggccagcctgccaacatgcctgagtacaatgccccagccctgctggagctggtgcgggagaaggaggagcgcatcctggccctggaggccgacatgaccaagtgggagcagaagtacctggaggagagcaccatccgccactttgccatgaatgctgctgccacagctgctgctgagcgggacaccaccatcatcaaccacagcagaaatggcagctatggagagagcagcctggaggcccacatctggcaggaggaggaggaggtggtgcaggccaacagacgctgccaggacatggagtacaccatcaagaacctgcacgccaagatcatcgagaaggatgccatgatcaaggtgctgcagcagaggagcaggaaggatgctgggaagacagacagcagcagcctgcggcctgcccggtctgtgcccagcattgctgctgccaccggcacccacagccggcagaccagcctgaccagcagccagctggccgaggagaagaaggaggagaagacctggaagggcagcatcggcctgctgctgggcaaggagcaccacgagcacgccagcgcccccctgctgcccccaccacccaccagcgccctgagcagcatcgccagcaccacagctgccagcagcgcccacgccaagacaggcagcaaggacagcagcacccagacagacaagtctgctgagctgttctggcccagcatggccagcctgcccagccggggccgcctgagcaccaccccagcccacagccctgtgctgaagcaccctgctgccaagggcacagctgagaagctggagaacagccctggccacggcaagagcccagaccaccggggccgggtgagcagcctgctgcacaagccagagttcccagatggagagatgatggaggtgctgatctag

SEQ ID NO: 32334 - DNA, 1836 bp, Artificial Sequence
  Description of Artificial Sequence: Synthetic coding sequence
accagccatgaccggctgatgtggagggccaagctgcggcggggcacctgtgagcctgctgtgaagggcagccccagcgcctgctacagccccagcagccctgtgcaggtgctggaggacagcacctacttctccccagacttccagctgtacagcggcagacatgagaccagcgccctgactgtggaggccaccagcagcatccgggagaaggtggtggaggaccccctgtgcaacttccacagccccaacttcctgcgcatcagcgaggtggagatgaggggctctgaagatgctgctgctggcaccgtgctgcagaggctcatccaggagcagctgcgctatggcacccccacagagaacatgaacctgctggccatccagcaccaggccaccggcagcgctggccctgcccaccccaccaacaacttcagcagcacagagaacctgacccaggaggacccccagatggtgtaccagagcgcccggcaggagccccagggccaggagcaccaggtggacaacacagtgatggagaagcaggtgcgcagcacccagccccagcagaacaatgaggagctgcccacctatgaggaggccaaggcccagagccagttcttccggggccagcagcagcagcagcagcagcagggcgctgtgggccacggctactacatggccggcggcaccagccagaagagcaggacagagggccggcccaccgtgaacagagccaacagcggccaggcccacaaggatgaggccctgaaggagctgaagcagggccacgtgcgcagcctgtctgagcgcatcatgcagctgagcctggagagaaatggagccaagcagcacctgcccggcagcggaaatggcaagggcttcaaggtgggcggcggccccagccctgcccagcctgctgggaaggtgctggacccccggggccccccacctgagtaccccttcaagaccaagcagatgatgagccctgtgtccaagacccaggagcacggcctcttctacggggaccagcaccctggcatgctgcacgagatggtgaagccctacccagccccccagcctgtgaggacagatgtggccgtgctgcgctaccagcccccaccagaatatggagtgaccagccggccctgccagctgcccttccccagcaccatgcagcagcacagccccatgagcagccagaccagcagcgccagcggccccctgcacagcgtgtccctgcccctgcccctgcccatggccctgggcgccccccagcccccacctgctgccagccccagccagcagctgggcccagatgcctttgccatcgtggagcgggcccagcagatggtggagatcctgacagaagaaaatagagtgctgcaccaggagctgcagggctactatgacaatgctgacaagctgcacaagtttgagaaggagctgcagaggatcagcgaggcctatgagagcctggtgaagagcaccaccaagcgggagagcctggacaaggccatgaggaacaagctggagggggagatccggcggctgcatgacttcaacagagacctgcgggaccggctggagacagccaaccggcagctgagcagccgggagtatgagggccacgaggacaaggctgctgagggccactacgccagccagaacaaggagttcctgaaggagaaggagaagctggagatggagctggccgctgtgaggacagccagcgaggaccacagaagacacatcgagatcctggaccaggccctgagcaatgcccaggcccggcaccaggccggccggggcgtgacccgggaggccagcatctgctag

SEQ ID NO: 32335 - DNA, 2343 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgcggcacggccacgtgcgcagcctgtctgagcggctgctgcagctgagcctggagagaaatggagcccgggcccccagccacatgagcagcagccacagcttcccccagctggccaggaaccagcagggcccccccctgcggggccccccagctgagggccctgagagccggggccccccaccccagtacccccacgtggtgctggcccacgagaccaccacagctgtgacagacccccgctaccgggcccggggcagcccccacttccagcacgccgaggtgcgcatcctgcaggcccaggtgccccctgtgttcctgcagcagcagcagcagtaccagtacctgcagcagagccaggagcaccccccaccaccccaccctgctgccctgggccacggccccctgagcagcctgagccccccagctgtggagggccctgtgtctgcccaggccagcagcgccaccagcggcagcgcccacctggcccagatggaggccgtgctgcgggagaatgcccggctgcagagggacaatgaaaggctgcagcgggagctggagagcagcgctgagaaggccggcagaattgagaagctggagagcgagatccagaggctgtctgaggcccacgagagcctgacccgggccagcagcaagcgggaggccctggagaagaccatgaggaacaagatggacagcgagatgaggcggctgcaggacttcaacagagacctgcgggagcggctggagagcgccaacagaaggctggccagcaagacccaggaggcccaggccggcagccaggacatggtggccaagctgctggcccagagctatgagcagcagcaggagcaggagaagctggagcgggagatggccctgctgcggggggccatcgaggaccagaggagaagagctgagctgctggagcaggccctgggcaatgcccagggccgggccgcccgggcagaggaggagctgaggaagaagcaggcctacgtggagaaggtggagcggctgcagcaggccctgggccagctgcaggccgcctgtgagaagcgggagcagctggagctgcggctgcggacccggctggagcaggagctgaaggccctgcgggcccagcagaggcaggccggggcccctgggggcagcagcggcagcggcggcagccctgagctgagcgccctgcggctgtctgagcagctgcgggagaaggaggagcagatcctggccctggaggccgacatgaccaagtgggagcagaagtacctggaggagcgggccatgaggcagtttgccatggatgctgctgccacagctgctgcccagagggacaccaccctcatccgccacagcccccagcccagccccagcagcagcttcaatgaaggcctgctgactggaggccaccgccaccaggagatggagagccggctgaaggtgctgcacgcccagatcctggagaaggatgctgtgatcaaggtgctgcagcagaggagcagaagagaccccgggaaggccatccagggcagcctgcggcctgccaagtctgtgcccagcgtgtttgctgctgctgctgctggcacccagggctggcagggcctgagcagcagcgagcggcagacagcagatgccccagcccggctgaccacagctgaccgggcccccacagaggagcctgtggtgacagcccctcctgctgcccacgccaagcacggcagcagagatggcagcacccagacagagggccccccagacagcaccagcacctgcctgcccccagagccagacagcctgctgggctgcagcagcagccagagagctgccagcctggacagcgtggccaccagccgggtgcaggacctgagtgacatggtggagatcctgatctag

SEQ ID NO: 32336 - DNA, 2340 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgcggcacggccacgtgcgcagcctgtctgagcggctgctgcagctgagcctggagagaaatggagcccgggcccccagccacatgagcagcagccacagcttcccccagctggccaggaaccagcagggcccccccctgcggggccccccagctgagggccctgagagccggggccccccaccccagtacccccacgtggtgctggcccacgagaccaccacagctgtgacagacccccgctaccgggcccggggcagcccccacttccagcacgccgaggtgcgcatcctgcaggcccaggtgccccctgtgttcctgcagcagcagcagcagtaccagtacctgcagcagagccaggagcaccccccaccaccccaccctgctgccctgggccacggccccctgagcagcctgagccccccagctgtggagggccctgtgtctgcccaggccagcagcgccaccagcggcagcgcccacctggcccagatggaggccgtgctgcgggagaatgcccggctgcagagggacaatgaaaggctgcagcgggagctggagagcagcgctgagaaggccggcagaattgagaagctggagagcgagatccagaggctgtctgaggcccacgagagcctgacccgggccagcagcaagcgggaggccctggagaagaccatgaggaacaagatggacagcgagatgaggcggctgcaggacttcaacagagacctgcgggagcggctggagagcgccaacagaaggctggccagcaagacccaggaggcccaggccggcagccaggacatggtggccaagctgctggcccagagctatgagcagcagcaggagcaggagaagctggagcgggagatggccctgctgcggggggccatcgaggaccagaggagaagagctgagctgctggagcaggccctgggcaatgcccagggccgggccgcccgggcagaggaggagctgaggaagaagcaggcctacgtggagaaggtggagcggctgcagcaggccctgggccagctgcaggccgcctgtgagaagcgggagcagctggagctgcggctgcggacccggctggagcaggagctgaaggccctgcgggcccagcagaggcaggccggggcccctgggggcagcagcggcagcggcggcagccctgagctgagcgccctgcggctgtctgagcagctgcgggagaaggaggagcagatcctggccctggaggccgacatgaccaagtgggagcagaagtacctggaggagcgggccatgaggcagtttgccatggatgctgctgccacagctgctgcccagagggacaccaccctcatccgccacagcccccagcccagccccagcagcagcttcaatgaaggcctgctgactggaggccaccgccaccaggagatggagagccggctgaaggtgctgcacgcccagatcctggagaaggatgctgtgatcaaggtgctgcagcagaggagcagaagagaccccgggaaggccatccagggcagcctgcggcctgccaagtctgtgcccagcgtgtttgctgctgctgctgctggcacccagggctggcagggcctgagcagcagcgagcggcagacagcagatgccccagcccggctgaccacagaccgggcccccacagaggagcctgtggtgacagcccccccagctgcccacgccaagcacggcagcagagatggcagcacccagacagagggccccccagacagcaccagcacctgcctgcccccagagccagacagcctgctgggctgcagcagcagccagagagctgccagcctggacagcgtggccaccagccgggtgcaggacctgagtgacatggtggagatcctgatctag

SEQ ID NO: 32337 - DNA, 102 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggcctag

SEQ ID NO: 32338 - DNA, 456 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgaggtag

SEQ ID NO: 32339 - DNA, 435 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggactag

SEQ ID NO: 32340 - DNA, 384 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccactag

SEQ ID NO: 32341 - DNA, 597 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgcggcacggccacgtgcgcagcctgtctgagcggctgctgcagctgagcctggagagaaatggagcccgggcccccagccacatgagcagcagccacagcttcccccagctggccaggaaccagcagggcccccccctgcggggctag

SEQ ID NO: 32342 - DNA, 2334 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgcggcacggccacgtgcgcagcctgtctgagcggctgctgcagctgagcctggagagaaatggagcccgggcccccagccacatgagcagcagccacagcttcccccagctggccaggaaccagcagggcccccccctgcggggccccccagctgagggccctgagagccggggccccccaccccagtacccccacgtggtgctggcccacgagaccaccacagctgtgacagacccccgctaccgggcccggggcagcccccacttccagcacgccgaggtgcgcatcctgcaggcccaggtgccccctgtgttcctgcagcagcagcagcagtaccagtacctgcagcagagccaggagcaccccccaccaccccaccctgctgccctgggccacggccccctgagcagcctgagccccccagctgtggagggccctgtgtctgcccaggccagcagcgccaccagcggcagcgcccacctggcccagatggaggccgtgctgcgggagaatgcccggctgcagagggacaatgaaaggctgcagcgggagctggagagcagcgctgagaaggccggcagaattgagaagctggagagcgagatccagaggctgtctgaggcccacgagagcctgacccgggccagcagcaagcgggaggccctggagaagaccatgaggaacaagatggacagcgagatgaggcggctgcaggacttcaacagagacctgcgggagcggctggagagcgccaacagaaggctggccagcaagacccaggaggcccaggccggcagccaggacatggtggccaagctgctggcccagagctatgagcagcagcaggagcaggagaagctggagcgggagatggccctgctgcggggggccatcgaggaccagaggagaagagctgagctgctggagcaggccctgggcaatgcccagggccgggccgcccgggcagaggaggagctgaggaagaagcaggcctacgtggagaaggtggagcggctgcagcaggccctgggccagctgcaggccgcctgtgagaagcgggagcagctggagctgcggctgcggacccggctggagcaggagctgaaggccctgcgggcccagcaggccggggcccctgggggcagcagcggcagcggcggcagccctgagctgagcgccctgcggctgtctgagcagctgcgggagaaggaggagcagatcctggccctggaggccgacatgaccaagtgggagcagaagtacctggaggagcgggccatgaggcagtttgccatggatgctgctgccacagctgctgcccagagggacaccaccctcatccgccacagcccccagcccagccccagcagcagcttcaatgaaggcctgctgactggaggccaccgccaccaggagatggagagccggctgaaggtgctgcacgcccagatcctggagaaggatgctgtgatcaaggtgctgcagcagaggagcagaagagaccccgggaaggccatccagggcagcctgcggcctgccaagtctgtgcccagcgtgtttgctgctgctgctgctggcacccagggctggcagggcctgagcagcagcgagcggcagacagcagatgccccagcccggctgaccacagaccgggcccccacagaggagcctgtggtgacagcccccccagctgcccacgccaagcacggcagcagagatggcagcacccagacagagggccccccagacagcaccagcacctgcctgcccccagagccagacagcctgctgggctgcagcagcagccagagagctgccagcctggacagcgtggccaccagccgggtgcaggacctgagtgacatggtggagatcctgatctag

SEQ ID NO: 32343 - DNA, 2514 bp, Artificial Sequence
  Description of Artificial Sequence: Synthetic coding sequence
atgacaggcaggaaggccagcggcggcaccccctgcaccctgaggaagggggcccccatcatcaccctgggcaagaactggacagagcggctggccgccggggacagcgtgggctgcagcggggcccgctgccaccggcccctgagccggcagctgtgtgccagccagaggtccatgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggcacccggccccacgccggggaccgggaccccaggggggcccctgggggcagccggcggcaggatgaggccctgcgggagctgcggcacggccacgtgcgcagcctgtctgagcggctgctgcagctgagcctggagagaaatggagcccgggcccccagccacatgagcagcagccacagcttcccccagctggccaggaaccagcagggcccccccctgcggggccccccagctgagggccctgagagccggggccccccaccccagtacccccacgtggtgctggcccacgagaccaccacagctgtgacagacccccgctaccgggcccggggcagcccccacttccagcacgccgaggtgcgcatcctgcaggcccaggtgccccctgtgttcctgcagcagcagcagcagtaccagtacctgcagcagagccaggagcaccccccaccaccccaccctgctgccctgggccacggccccctgagcagcctgagccccccagctgtggagggccctgtgtctgcccaggccagcagcgccaccagcggcagcgcccacctggcccagatggaggccgtgctgcgggagaatgcccggctgcagagggacaatgaaaggctgcagcgggagctggagagcagcgctgagaaggccggcagaattgagaagctggagagcgagatccagaggctgtctgaggcccacgagagcctgacccgggccagcagcaagcgggaggccctggagaagaccatgaggaacaagatggacagcgagatgaggcggctgcaggacttcaacagagacctgcgggagcggctggagagcgccaacagaaggctggccagcaagacccaggaggcccaggccggcagccaggacatggtggccaagctgctggcccagagctatgagcagcagcaggagcaggagaagctggagcgggagatggccctgctgcggggggccatcgaggaccagaggagaagagctgagctgctggagcaggccctgggcaatgcccagggccgggccgcccgggcagaggaggagctgaggaagaagcaggcctacgtggagaaggtggagcggctgcagcaggccctgggccagctgcaggccgcctgtgagaagcgggagcagctggagctgcggctgcggacccggctggagcaggagctgaaggccctgcgggcccagcagaggcaggccggggcccctgggggcagcagcggcagcggcggcagccctgagctgagcgccctgcggctgtctgagcagctgcgggagaaggaggagcagatcctggccctggaggccgacatgaccaagtgggagcagaagtacctggaggagcgggccatgaggcagtttgccatggatgctgctgccacagctgctgcccagagggacaccaccctcatccgccacagcccccagcccagccccagcagcagcttcaatgaaggcctgctgactggaggccaccgccaccaggagatggagagccggctgaaggtgctgcacgcccagatcctggagaaggatgctgtgatcaaggtgctgcagcagaggagcagaagagaccccgggaaggccatccagggcagcctgcggcctgccaagtctgtgcccagcgtgtttgctgctgctgctgctggcacccagggctggcagggcctgagcagcagcgagcggcagacagcagatgccccagcccggctgaccacagaccgggcccccacagaggagcctgtggtgacagcccccccagctgcccacgccaagcacggcagcagagatggcagcacccagacagagggccccccagacagcaccagcacctgcctgcccccagagccagacagcctgctgggctgcagcagcagccagagagctgccagcctggacagcgtggccaccagccgggtgcaggacctgagtgacatggtggagatcctgatctag

SEQ ID NO: 32344 - DNA, 372 bp, Artificial Sequence
  Description of Artificial Sequence: Synthetic coding sequence
atgaggaccctggaggacagcagcggcaccgtgctgcacaggctcatccaggagcagctgcgctatggcaacctgacagagaccaggaccctgctggccatccagcagcaggccctgcggggcggggccggcactggaggcaccggcagcccccaggccagcctggagatcctggcccctgaggacagccaggtgctgcagcaggccacccggcaggagccccagggccaggagcaccagggcggggagaaccacctggccgagaacaccctgtaccgcctgtgcccccagcccagcaagggggaggagctgcccacctatgaggaggccaaggcccacagccagtactatgctgcccagcaggccggctag

SEQ ID NO: 32345 - DNA, 480 bp, Artificial Sequence
  Description of Artificial Sequence: Synthetic coding sequence
atggagctgcctgctgtgaacctgaaggtgatcctgctgggccactggctgctgaccacctggggctgcatcgtgttttctggcagctatgcctgggccaacttcaccatcctggccctgggcgtgtgggccgtggcccagagggacagcattgatgccatctccatgttcctgggcggcctgctggccaccatcttcctggacatcgtgcacatcagcatcttctacccccgggtgtccctgacagacaccggccgctttggagtgggcatggccatcctgagcctgctgctgaagcccctgagctgctgctttgtgtaccacatgtaccgggagcggggcggggagctgctggtgcacacaggcttcctgggcagcagccaggacagaagtgcctaccagaccatcgacagcgctgaggccccagctgacccctttgctgtgcctgagggccgcagccaggatgcccggggctactag

SEQ ID NO: 32346 - DNA, 459 bp, Artificial Sequence
  Description of Artificial Sequence: Synthetic coding sequence
atggagctgcctgctgtgaacctgaaggtgatcctgctgggccactggctgctgaccacctggggctgcatcgtgttttctggcagctatgcctgggccaacttcaccatcctggccctgggcgtgtgggccgtggcccagagggacagcattgatgccatctccatgttcctgggcggcctgctggccaccatcttcctggacatcgtgcacatcagcatcttctacccccgggtgtccctgacagacaccggccgctttggagtgggcatggccatcctgagcctgctgctgaagcccctgagctgctgctttgtgtaccacatgtaccgggagcggggcggcttcctgggcagcagccaggacagaagtgcctaccagaccattgattctgctgaggccccagctgacccctttgctgtgcctgagggccgcagccaggatgcccggggctactag

SEQ ID NO: 32347 - DNA, 336 bp, Artificial Sequence
  Description of Artificial Sequence: Synthetic coding sequence
atggagctgcctgctgtgaacctgaagggcctgcactgcatcctgcggctgctgtgcctgggccagctgcaccaccctggcctgggccgggtgggctgcggcagcgctggcctgcaccggcggcacaagcacgtgtctggctggctggccggccaccacctgcccggccaccgggcccaccagcacctgctgcctgctggccagccccacggccacggccccctgtggaggggccacggccacccccagctggccgcccaggccgccctgctgctgctgcggctgccccacgtgcctggggcccggggcttcccctgggtgttttctggcccctag

SEQ ID NO: 32348 - DNA, 444 bp, Artificial Sequence
  Description of Artificial Sequence: Synthetic coding sequence
atggagctgcctgctgtgaacctgaaggtgatcctgctgggccactggctgctgaccacctgcttctggaggcacttcagcgccaagccccggctggagaccatcgagctgacctgtgccctgtgcaagctgcggtctgctgcccaccgggccacagctggcctgcactgcatcctgcggctgctgtgcctgggccagctgcaccaccctggcctgggccgggtgggctgcggcagcgctggcctgcaccggcggcacaagcacgtgtctggctggctggccggccaccacctgcccggccaccgggcccaccagcacctgctgcctgctggccagccccacggccacggccccctgtggaggggccacggccacccccagctggccgcccaggccgccctgctgctgctgcggctgccccacgtgcctggggcccggggctag

SEQ ID NO: 32349 - DNA, 468 bp, Artificial Sequence
  Description of Artificial Sequence: Synthetic coding sequence
atggagctgcctgctgtgaacctgaaggtgatcctgctgggccactggctgctgaccacctgcttctggaggcacttcagcgccaagccccggctggagaccatcgagctgacctgtgccctgtgcaagctgcggtctgctgcccaccgggccacagctggcctgcactgcatcctgcggctgctgtgcctgggccagctgcaccaccctggcctgggccgggtgggctgcggcagcgctggcctgcaccggcggcacaagcacgtgtctggctggctggccggccaccacctgcccggccaccgggcccaccagcacctgctgcctgctggccagccccacggccacggccccctgtggaggggccacggccacccccagctggccgcccaggccgccctgctgctgctgcggctgccccacgtgcctggggcccggggcttcccctgggtgttttctggcccctag

SEQ ID NO: 32350 - DNA, 2406 bp, Artificial Sequence
  Description of Artificial Sequence: Synthetic coding sequence
atgaagtatgcagagaacatcatgctgaagctgaccttcagcaccacccagatccagcagtatgaaaatgtgttcatctttgaaacaggctactggctgaccaatgccatcaagtacaaccaggactacctggacatctgcacctaccagaggctgcagcagaggctgtacctgcagaagaagatcatccagaagcactttgagaagaagaaggacatccggcggggcatcggctacctgaagctgatctgcttcctgatccccttcctgctgagcctgaagaagaagatgaaggtgccctacctgagcagcctgctgcagcccttcagtgatgacaaggtgaagacagagcgggagctgccccccttcatctacggccgggacttcaagtgccagaacttccactacaaggagaaccagtacttccacgtgcatggaggcatcgagtttgacatcagcacccccagcattgaaaatgccctggaggacttccagaagaacctggagaagatccgggactgtgccgccaacaccttcattgaagattctggctacaaggagtactacagcatccctgtgatggagttccacggcaagagctactacgtgatctactttgagctggagaccttctaccagcagctgtacaagacccagtggtggggcgccatcaatgaaattgtgaacaacctgcggctgaagaggctgcccctgacagatgcccagctgcacgagcagttcaagaagaagctgggcttcaagagggccatgaagtgcaagagcatccccttcggcatgaagtctgctgtggagcggggcctgtctgctgtgttccacaccttcagcaggaagaccagcagcagcaccatcaacgtgtctgatgaggccggctacaccatcttccaccacgccgccctgcacaacagagtgtccatcatctgccagctgtgcaatgccaacttcaaggtgaaccagaggagatttgtgaccttcagccagggccccacccccctgcacctggccgcccaggcctgcagcctggagaccaccgtgtgcctgctgtgcagcaaggctgactacaccctgtctgagaagaggggctggatgcccatccactttgctgccttctatgacaacgtgtgcatcatcatcgccctgtgcaggaaggaccccagcctgctggaggccgaggccacagctgagaaccagtgcacccccctgctgctggccgccaccagcggggccctggacaccatccagtacctgttcagcattggagccaactggaggaagacagacatcaagggcaacaacatcatccacctgtctgtgctgaccttccacacagaggtgctgaagtacatcatcaagctgaacatccctgagctgcctgtgtggaagaccctggtggagatgctgcagtgtgagagctacaagaggaggatgatggctgtgatgagcctggaggtgatctgcctggccaatgaccagtactggcgctgcatcctggatgctggcaccatcccagccctgatcaacctgctgaagagcagcaagatcaagctgcagtgcaagacagtgggcctgctgagcaacatcagcacccacaagtctgctgtgcacgccctggtggaggccggcggcatccccagcctcatcaacctgctggtgtgtgatgagcctgaggtgcacagccgctgtgccgtcatcctgtatgacatcgcccagtgtgagaacaaggatgtgattgccaagtacaacggcatccccagcctcatcaacctgctgaacctgaacattgaaaatgtgctggtgaatgtgatgaactgcatccgggtgctgtgcattggaaatgaaaacaaccagagagctgtgcgggagcacaagggcctgccctacctgatccgcttcctgagcagtgacagcggcctcttcaacctcttcctgaacagctttgaagatgtgctgaaggctgtgtcctctgctgccatcgccgaggtgggccgggacaacaaggagatccaggatgccatcgccatggagggcgccatcccccccctggtggccctcttcaagggcaagcagatctctgtgcagatgaagggggccatggctgtggagagcctggccagccacaatgccctgatccagaaggccttcctggagaagagcctgaccaagtacctgctgaagctgctgaaggccttccagattgatgtgaaggagcagggcgctgtggccctgtgggccctggccggccagaccctgaagcagcagaagtacatggccgagcagatcggctacagcttcatcatcaacatgctgctgagccccagcgccaagatgcagtatgtgggctacctgctgaagagccggctgtgcatcaacaccttctgcctgcagtag

SEQ ID NO: 32351 - DNA, 4305 bp, Artificial Sequence
  Description of Artificial Sequence: Synthetic coding sequence
atgctgcggctgcccaagaagggcctgcccaggtttgagcaggtgcaggatgaggacacctacctggagaacctggccatccagagaaatgccagcgccttctttgagaagtatgacagaagtgagatccaggagctgctgaccacagccctggtgtcctggctgagcgccaaggaggatgtgcgcagccaggtggacctgccctgtggcatcatgagccagatgaacaacgtgggcttcagcacagccatcctgctgacccctgtggaccccacagccctgctggactaccgggaggtgcaccagatgatccgggagctggccatcggcatctactgcctgaaccagatccccagcatcagcctggaggccaactatgaccagagcagcagctgccagctgcccccagcctactatgacaccagaattggccagatcctgatcaacatcgactacatgctgaaggccctgtggcacggcatctacatgcccaaggagaagagggcccgcttcagcgagctgtggagggccatcatggacattgatcctgatggcaagccccagaccaacaaggacatcttcagcgagttcagcagcgctggcctgacagacatcaccaaggaccctgacttcaatgagatctatgatgaagatgtgaatgaagaccccacctatgaccccaacagccctgaggagacagctgtgttcatgaagtatgcagagaacatcatgctgaagctgaccttcagcaccacccagatccagcagtatgaaaatgtgttcatctttgaaacaggctactggctgaccaatgccatcaagtacaaccaggactacctggacatctgcacctaccagaggctgcagcagaggctgtacctgcagaagaagatcatccagaagcactttgagaagaagaaggacatccggcggggcatcggctacctgaagctgatctgcttcctgatccccttcctgctgagcctgaagaagaagatgaaggtgccctacctgagcagcctgctgcagcccttcagtgatgacaaggtgaagacagagcgggagctgccccccttcatctacggccgggacttcaagtgccagaacttccactacaaggagaaccagtacttccacgtgcatggaggcatcgagtttgacatcagcacccccagcattgaaaatgccctggaggacttccagaagaacctggagaagatccgggactgtgccgccaacaccttcattgaagattctggctacaaggagtactacagcatccctgtgatggagttccacggcaagagctactacgtgatctactttgagctggagaccttctaccagcagctgtacaagacccagtggtggggcgccatcaatgaaattgtgaacaacctgcggctgaagaggctgcccctgacagatgcccagctgcacgagcagttcaagaagaagctgggcttcaagagggccatgaagtgcaagagcatccccttcggcatgaagtctgctgtggagcggggcctgtctgctgtgttccacaccttcagcaggaagaccagcagcagcaccatcaacgtgtctgatgaggccggctacaccatcttccaccacgccgccctgcacaacagagtgtccatcatctgccagctgtgcaatgccaacttcaaggtgaaccagaggagatttgtgaccttcagccagggccccacccccctgcacctggccgcccaggcctgcagcctggagaccaccgtgtgcctgctgtgcagcaaggctgactacaccctgtctgagaagaggggctggatgcccatccactttgctgccttctatgacaacgtgtgcatcatcatcgccctgtgcaggaaggaccccagcctgctggaggccgaggccacagctgagaaccagtgcacccccctgctgctggccgccaccagcggggccctggacaccatccagtacctgttcagcattggagccaactggaggaagacagacatcaagggcaacaacatcatccacctgtctgtgctgaccttccacacagaggtgctgaagtacatcatcaagctgaacatccctgagctgcctgtgtggaagaccctggtggagatgctgcagtgtgagagctacaagaggaggatgatggctgtgatgagcctggaggtgatctgcctggccaatgaccagtactggcgctgcatcctggatgctggcaccatcccagccctgatcaacctgctgaagagcagcaagatcaagctgcagtgcaagacagtgggcctgctgagcaacatcagcacccacaagtctgctgtgcacgccctggtggaggccggcggcatccccagcctcatcaacctgctggtgtgtgatgagcctgaggtgcacagccgctgtgccgtcatcctgtatgacatcgcccagtgtgagaacaaggatgtgattgccaagtacaacggcatccccagcctcatcaacctgctgaacctgaacattgaaaatgtgctggtgaatgtgatgaactgcatccgggtgctgtgcattggaaatgaaaacaaccagagagctgtgcgggagcacaagggcctgccctacctgatccgcttcctgagcagtgacagtgatgtgctgaaggctgtgagcagcgctgccatcgccgaggtgggccgggacaacaaggagatccaggatgccatcgccatggagggcgccatcccccccctggtggccctcttcaagggcaagcagatctctgtgcagatgaagggggccatggctgtggagagcctggccagccacaatgccctgatccagaaggccttcctggagaagagcctgaccaagtacctgctgaagctgctgaaggccttccagattgatgtgaaggagcagggcgctgtggccctgtgggccctggccggccagaccctgaagcagcagaagtacatggccgagcagatcggctacagcttcatcatcaacatgctgctgagccccagcgccaagatgcagtatgtgggcggggaggccgtcatcgccctgagcaaggacagcaggatgcaccagaaccagatctgtgagggcaatggaattgcccccctggtgcggctgctgcgcatcagcaccatcgccgagggcaccctgctgagcgtcatccgggctgtgggcagcatctgcatcggcgtggcccacaccagcaaccctgtgtcccagcagctggtggtggatgaaaatgccttccctgtgctgatccagctgctgaggaaccaccccagccccaacatcaaggtggaggtggccttcagcctggcctgcatcgtgctgggcaatgatgtgctgcagaaggacctgcatgaaaatgaaggatttgaatatgcagatgtgctgtacctgctgcacagcacagagaaggacatctgcctgcgggccggctacgccctgaccctgtttgccttcaacaaccgcttccagcagtacctgatcctggagagcggcatcatgaccatcagcatctttgagcgcttcctggagagcacagtggagacagagaaggccatggccgccttccagatcgtggtgctggccaaggtgatccgggacatggaccacatcaccctgagcgcccggggcgtgaccatcctggtggacagcctgtacagcgtgcagaccagcaccatcgtgctgactggaaacctgattgccagcctggcccacagcagagctggcatccctgaggccttcaccaccctgggcaccatccagaggctgtgctaccacctgtacagcggcatcgaggaggtgcgggccgcctgcagcagcgccctgggctacctgacctacaatgccaatgccttccgcatcctgctgaaggaatgtagaaacaagcccaaccagttcatccgcatcaagaacaacatcagcagagatgccagcatcaacccagccttcctgaaggagttccagatgcagcagaccctggtgggcctgcccagcctgagcctggagaagaatggaggccccagcatcatccccatcttcaagaggggcaaggagcacaggaggaagctgaagcccaagatccagcccaaggacagcctgaccctgctgccccctgtgaccaacttcatgggcctcttcaaggccaccaagaagaccaaggacagccacaacatcttctccttcagcagcaccatcaccagtgacatcaccaacgtgtcccggccccgcatcgtgtgcctgaaccagctgggcaagcacgtgcagaaggccaaccctgagcctgctgagggctag

SEQ ID NO: 32352 - DNA, 1080 bp, Artificial Sequence
  Description of Artificial Sequence: Synthetic coding sequence
atgaagggggccatggctgtggagagcctggccagccacaatgccctgatccagaaggccttcctggagaagagcctgaccaagtacctgctgaagctgctgaaggccttccagattgatgtgaaggagcagggcgctgtggccctgtgggccctggccggccagaccctgaagcagcagaagtacatggccgagcagatcggctacagcttcatcatcaacatgctgctgagccccagcgccaagatgcagtatgtgggcggggaggccgtcatcgccctgagcaaggacagcaggatgcaccagaaccagatctgtgagggcaatggaattgcccccctggtgcggctgctgcgcatcagcaccatcgccgagggcaccctgctgagcgtcatccgggctgtgggcagcatctgcatcggcgtggcccacaccagcaaccctgtgtcccagcagctggtggtggatgaaaatgccttccctgtgctgatccagctgctgaggaaccaccccagccccaacatcaaggtggaggtggccttcagcctggcctgcatcgtgctgggcaatgatgtgctgcagaaggacctgcatgaaaatgaaggatttgaatatgcagatgtgctgtacctgctgcacagcacagagaaggacatctgcctgcgggccggctacgccctgaccctgtttgccttcaacaaccgcttccagcagtacctgatcctggagagcggcatcatgaccatcagcatctttgagcgcttcctggagagcacagtggagacagagaaggccatggccgccttccagatcgtggtgctggccaaggtgatccgggacatggaccacatcaccctgagcgcccggggcgtgaccatcctggtggacagcctgtacagcgtgcagaccagcaccatcgtgctgactggaaacctgattgccagcctggcccacagcagagctggcatccctgaggccttcaccaccctgggcaccatccagaggctgtgctaccacctgtacagcggcatcgaggagagcggggaggagtggaggaccatccacaacagctacctgtag

SEQ ID NO: 32353 - DNA, 4092 bp, Artificial Sequence
  Description of Artificial Sequence: Synthetic coding sequence
atgagccagatgaacaacgtgggcttcagcacagccatcctgctgacccctgtggaccccacagccctgctggactaccgggaggtgcaccagatgatccgggagctggccatcggcatctactgcctgaaccagatccccagcatcagcctggaggccaactatgaccagagcagcagctgccagctgcccccagcctactatgacacccgcatcggccagatcctgatcaacatcgactacatgctgaaggccctgtggcacggcatctacatgcccaaggagaagagggcccgcttcagcgagctgtggagggccatcatggacatcgaccctgatggcaagccccagaccaacaaggacatcttcagcgagttcagcagcgctggcctgacagacatcaccaaggaccctgacttcaatgagatctatgatgaagatgtgaatgaagaccccacctatgaccccaacagccctgaggagacagctgtgttcatgaagtatgcagagaacatcatgctgaagctgaccttcagcaccacccagatccagcagtatgaaaatgtgttcatctttgagaccggctactggctgaccaatgccatcaagtacaaccaggactacctggacatctgcacctaccagaggctgcagcagaggctgtacctgcagaagaagatcatccagaagcactttgagaagaagaaggacatcagaagaggcatcggctacctgaagctgatctgcttcctgatccccttcctgctgagcctgaagaagaagatgaaggtgccctacctgagcagcctgctgcagcccttcagtgatgacaaggtgaagacagagcgggagctgccccccttcatctacggccgggacttcaagtgccagaacttccactacaaggagaaccagtacttccacgtgcacggcggcattgaatttgacatcagcacccccagcattgaaaatgccctggaggacttccagaagaacctggagaagatccgggactgtgccgccaacaccttcatcgaggacagcggctacaaggagtactacagcatccctgtgatggagttccacggcaagagctactacgtgatctactttgagctggagaccttctaccagcagctgtacaagacccagtggtggggcgccatcaatgagatcgtgaacaacctgcggctgaagaggctgcccctgacagatgcccagctgcacgagcagttcaagaagaagctgggcttcaagagggccatgaagtgcaagagcatccccttcggcatgaagtctgctgtggagcggggcctgtctgctgtgttccacaccttcagcaggaagaccagcagcagcaccatcaacgtgtctgatgaagctggctacaccatcttccaccacgccgccctgcacaacagagtgtccatcatctgccagctgtgcaatgccaacttcaaggtgaaccagaggagatttgtgaccttcagccagggccccacccccctgcacctggccgcccaggcctgcagcctggagaccaccgtgtgcctgctgtgcagcaaggctgactacaccctgtctgagaagaggggctggatgcccatccactttgctgccttctatgacaacgtgtgcatcatcatcgccctgtgcaggaaggaccccagcctgctggaggccgaggccacagctgagaaccagtgcacccccctgctgctggccgccaccagcggggccctggacaccatccagtacctgttcagcatcggggccaactggaggaagacagacatcaagggcaacaacatcatccacctgtctgtgctgaccttccacacagaggtgctgaagtacatcatcaagctgaacatccctgagctgcctgtgtggaagaccctggtggagatgctgcagtgtgagagctacaagaggaggatgatggctgtgatgagcctggaggtgatctgcctggccaatgaccagtactggcgctgcatcctggatgctggcaccatcccagccctgatcaacctgctgaagagcagcaagatcaagctgcagtgcaagacagtgggcctgctgagcaacatcagcacccacaagtctgctgtgcacgccctggtggaggccggcggcatccccagcctcatcaacctgctggtgtgtgatgagcctgaggtgcacagccgctgtgctgtgatcctgtatgacatcgcccagtgtgagaacaaggatgtgattgccaagtacaacggcatccccagcctcatcaacctgctgaacctgaacattgaaaatgtgctggtgaatgtgatgaactgcatccgggtgctgtgcattggaaatgaaaacaaccagagagctgtgcgggagcacaagggcctgccctacctgatccgcttcctgagcagtgacagtgatgtgctgaaggctgtgtcctctgctgccatcgccgaggtgggccgggacaacaaggagatccaggatgccatcgccatggagggcgccatcccccccctggtggccctcttcaagggcaagcagatctctgtgcagatgaagggggccatggctgtggagagcctggccagccacaatgccctgatccagaaggccttcctggagaagagcctgaccaagtacctgctgaagctgctgaaggccttccagattgatgtgaaggagcagggcgctgtggccctgtgggccctggccggccagaccctgaagcagcagaagtacatggccgagcagatcggctacagcttcatcatcaacatgctgctgagccccagcgccaagatgcagtatgtgggcggggaggccgtgattgccctgagcaaggacagcaggatgcaccagaaccagatctgtgagggcaatggcatcgcccccctggtgcggctgctgcgcatcagcaccatcgccgagggcaccctgctgagcgtcatccgggctgtgggcagcatctgcattggagtggcccacaccagcaaccctgtgtcccagcagctggtggtggatgaaaatgccttccctgtgctgatccagctgctgaggaaccaccccagccccaacatcaaggtggaggtggccttcagcctggcctgcatcgtgctgggcaatgatgtgctgcagaaggacctgcatgaaaatgaaggatttgaatatgcagatgtgctgtacctgctgcacagcacagagaaggacatctgcctgcgggccggctacgccctgaccctgtttgccttcaacaaccgcttccagcagtacctgatcctggagagcggcatcatgaccatcagcatctttgagcgcttcctggagagcacagtggagacagagaaggccatggccgccttccagatcgtggtgctggccaaggtgatccgggacatggaccacatcaccctgagcgcccggggcgtgaccatcctggtggacagcctgtacagcgtgcagaccagcaccatcgtgctgaccggcaacctgattgccagcctggcccacagccgggccggcatccctgaggccttcaccaccctgggcaccatccagaggctgtgctaccacctgtacagcggcatcgaggaggtgcgggccgcctgcagcagcgccctgggctacctgacctacaatgccaatgccttccgcatcctgctgaaggagtgcaggaacaagcccaaccagttcatccgcatcaagaacaacatcagcagagatgccagcatcaacccagccttcctgaaggagttccagatgcagcagaccctggtgggcctgcccagcctgagcctggagaagaatggaggccccagcatcatccccatcttcaagaggggcaaggagcacaggaggaagctgaagcccaagatccagcccaaggacagcctgaccctgctgccccctgtgaccaacttcatgggcctcttcaaggccaccaagaagaccaaggacagccacaacatcttctccttcagcagcaccatcaccagtgacatcaccaacgtgtcccggcccagaattgtgtgcctgaaccagctgggcaagcacgtgcagaaggccaaccctgagcctgctgagggctag

SEQ ID NO: 32354 - DNA, 3243 bp, Artificial Sequence
  Description of Artificial Sequence: Synthetic coding sequence
atgctgcggctgcccaagaagggcctgcccaggtttgagcaggtgcaggatgaggacacctacctggagaacctggccatccagagaaatgccagcgccttctttgagaagtatgacagaagtgagatccaggagctgctgaccacagccctggtgtcctggctgagcgccaaggaggatgtgcgcagccaggtggacctgccctgtggcatcatgagccagatgaacaacgtgggcttcagcacagccatcctgctgacccctgtggaccccacagccctgctggactaccgggaggtgcaccagatgatccgggagctggccatcggcatctactgcctgaaccagatccccagcatcagcctggaggccaactatgaccagagcagcagctgccagctgcccccagcctactatgacaccagaattggccagatcctgatcaacatcgactacatgctgaaggccctgtggcacggcatctacatgcccaaggagaagagggcccgcttcagcgagctgtggagggccatcatggacattgatcctgatggcaagccccagaccaacaaggacatcttcagcgagttcagcagcgctggcctgacagacatcaccaaggaccctgacttcaatgagatctatgatgaagatgtgaatgaagaccccacctatgaccccaacagccctgaggagacagctgtgttcatgaagtatgcagagaacatcatgctgaagctgaccttcagcaccacccagatccagcagtatgaaaatgtgttcatctttgaaacaggctactggctgaccaatgccatcaagtacaaccaggactacctggacatctgcacctaccagaggctgcagcagaggctgtacctgcagaagaagatcatccagaagcactttgagaagaagaaggacatccggcggggcatcggctacctgaagctgatctgcttcctgatccccttcctgctgagcctgaagaagaagatgaaggtgccctacctgagcagcctgctgcagcccttcagtgatgacaaggtgaagacagagcgggagctgccccccttcatctacggccgggacttcaagtgccagaacttccactacaaggagaaccagtacttccacgtgcatggaggcatcgagtttgacatcagcacccccagcattgaaaatgccctggaggacttccagaagaacctggagaagatccgggactgtgccgccaacaccttcattgaagattctggctacaaggagtactacagcatccctgtgatggagttccacggcaagagctactacgtgatctactttgagctggagaccttctaccagcagctgtacaagacccagtggtggggcgccatcaatgaaattgtgaacaacctgcggctgaagaggctgcccctgacagatgcccagctgcacgagcagttcaagaagaagctgggcttcaagagggccatgaagtgcaagagcatccccttcggcatgaagtctgctgtggagcggggcctgtctgctgtgttccacaccttcagcaggaagaccagcagcagcaccatcaacgtgtctgatgaggccggctacaccatcttccaccacgccgccctgcacaacagagtgtccatcatctgccagctgtgcaatgccaacttcaaggtgaaccagaggagatttgtgaccttcagccagggccccacccccctgcacctggccgcccaggcctgcagcctggagaccaccgtgtgcctgctgtgcagcaaggctgactacaccctgtctgagaagaggggctggatgcccatccactttgctgccttctatgacaacgtgtgcatcatcatcgccctgtgcaggaaggaccccagcctgctggaggccgaggccacagctgagaaccagtgcacccccctgctgctggccgccaccagcggggccctggacaccatccagtacctgttcagcattggagccaactggaggaagacagacatcaagggcaacaacatcatccacctgtctgtgctgaccttccacacagaggtgctgaagtacatcatcaagctgaacatccctgagctgcctgtgtggaagaccctggtggagatgctgcagtgtgagagctacaagaggaggatgatggctgtgatgagcctggaggtgatctgcctggccaatgaccagtactggcgctgcatcctggatgctggcaccatcccagccctgatcaacctgctgaagagcagcaagatcaagctgcagtgcaagacagtgggcctgctgagcaacatcagcacccacaagtctgctgtgcacgccctggtggaggccggcggcatccccagcctcatcaacctgctggtgtgtgatgagcctgaggtgcacagccgctgtgccgtcatcctgtatgacatcgcccagtgtgagaacaaggatgtgattgccaagtacaacggcatccccagcctcatcaacctgctgaacctgaacattgaaaatgtgctggtgaatgtgatgaactgcatccgggtgctgtgcattggaaatgaaaacaaccagagagctgtgcgggagcacaagggcctgccctacctgatccgcttcctgagcagtgacagtgatgtgctgaaggctgtgagcagcgctgccatcgccgaggtgggccgggacaacaaggagatccaggatgccatcgccatggagggcgccatcccccccctggtggccctcttcaagggcaagcagatctctgtgcagatgaagggggccatggctgtggagagcctggccagccacaatgccctgatccagaaggccttcctggagaagagcctgaccaagtacctgctgaagctgctgaaggccttccagattgatgtgaaggagcagggcgctgtggccctgtgggccctggccggccagaccctgaagcagcagaagtacatggccgagcagatcggctacagcttcatcatcaacatgctgctgagccccagcgccaagatgcagtatgtgggcggggaggccgtcatcgccctgagcaaggacagcaggatgcaccagaaccagatctgtgagggcaatggaattgcccccctggtgcggctgctgcgcatcagcaccatcgccgagggcaccctgctgagcgtcatccgggctgtgggcagcatctgcatcggctacctgctgaagagccggctgtgcatcaacaccttctgcctgcagtag

SEQ ID NO: 32355 - DNA, 4305 bp, Artificial Sequence; identical to SEQ ID NO: 32351
  Description of Artificial Sequence: Synthetic coding sequence

SEQ ID NO: 32356 - DNA, 3513 bp, Artificial Sequence
  Description of Artificial Sequence: Synthetic coding sequence
atggccgaggaggaggtggccaagctggagaagcacctgatgctgctgcggcaggagtatgtgaagctgcagaagaagctggccgagacagagaagagatgtgccctgctggccgcccaggccaacaaggagagcagcagcgagagcttcatcagccggctgctggccatcgtggccgacctgtatgagcaggagcagtacagcgacctgaagatcaaggtgggggacagacacatcagcgcccacaagtttgtgctggccgcccggagtgacagctggagcctggccaacctgagcagcaccaaggagctggacctgagtgatgccaaccctgaggtgaccatgaccatgctgcgctggatctacacagatgagctggagttccgggaggatgatgtgttcctgacagagctgatgaagctggccaaccgcttccagctgcagctgctgcgggagcgctgtgagaagggcgtgatgagcctggtgaatgtgaggaactgcatccgcttctaccagacagctgaggagctgaatgccagcaccctgatgaactactgtgccgagatcatcgccagccactgggatgacctgaggaaggaggacttcagctccatgtctgcccagctgctgtacaagatgatcaagagcaagacagagtaccccctgcacaaggccatcaaggtggagagagaagatgtggtgttcctgtacctgattgagatggacagccagctgcccgggaagctgaatgaggccgaccacaatggagacctggccctggacctggccctgagccggcggctggagagcatcgccaccaccctggtgagccacaaggcagatgtggacatggtggacaagagcggctggagcctgctgcacaagggcatccagagaggagacctgtttgctgccaccttcctgatcaagaatggagcctttgtgaatgctgccaccctgggcgcccaggagacccccctgcacctggtggccctgtacagcagcaagaagcacagcgcagatgtgatgtctgagatggcccagattgctgaggccctgctgcaggccggggccaaccccaacatgcaggacagcaagggccgcacccccctgcacgtgtccatcatggctggaaatgaatatgtgttcagccagctgctgcagtgcaagcagctggacctggagctgaaggaccacgagggcagcacagccctgtggctggccgtgcagcacatcaccgtgtccagtgaccagagcgtgaacccctttgaagatgtgcctgtggtgaatggcaccagctttgatgagaacagctttgctgcccggctcatccagaggggcagccacacagatgccccagacacagccactggaaactgcctgctgcagagagctgctggagctggaaatgaggccgccgccctcttcctggccaccaacggggcccacgtgaaccacaggaacaagtggggcgagacccccctgcacacagcctgcagacatggcctggccaacctgacagctgagctgctgcagcagggcgccaaccccaacctgcagacagaggaggccctgcccctgcccaaggaggccgccagcctgaccagcctggccgacagcgtgcacctgcagacccccctgcacatggccatcgcctacaaccacccagatgtggtgtctgtcatcctggagcagaaggccaatgccctgcacgccaccaacaacctgcagatcatcccagacttcagcctgaaggacagccgggaccagacagtgctgggcctggccctgtggacaggcatgcacaccatcgccgcccagctgctgggcagcggggccgccatcaatgacaccatgtctgatggccagaccctgctgcacatggccatccagaggcaggacagcaagagcgccctcttcctgctggagcaccaggccgacatcaacgtgtccaggacccaggatggagaaacagccctgcagctggccatccggaaccagctgcccctggtggtggatgccatctgcaccagaggagctgacatgtctgtgcctgatgagaagggcaacccccccctgtggctggccctggccaacaacctggaggacatcgccagcaccctggtgagacatggctgtgatgccacctgctggggccctggccctgggggctgcctgcagaccctgctgcaccgggccattgatgagaacaatgagcccacagcctgcttcctgatccgcagcggctgtgatgtgaacagcccccggcagcccggggccaatggagagggggaggaggaggccagagatggccagacccccctgcacctggccgcctcctggggcctggaggagaccgtgcagtgcctgctggagtttggagccaacgtgaatgcccaggatgctgagggccgcacccccatccacgtggccatcagcagccagcacggcgtcatcatccagctgctggtgagccacccagacatccacctgaatgtgcgggaccggcagggcctgaccccatttgcctgtgccatgaccttcaagaacaacaagtctgctgaggccatcctgaagcgggagagcggggctgctgagcaggtggacaacaagggcaggaacttcctgcacgtggccgtgcagaacagcgacattgaatctgtgctcttcctgatctctgtgcacgccaacgtgaacagccgggtgcaggatgccagcaagctgacccccctgcacctggccgtgcaggccggcagcgagatcatcgtgaggaacctgctgctggccggggccaaggtgaatgagctgaccaagcaccggcagacagccctgcacctggccgcccagcaggacctgcccaccatctgcagcgtgctgctggagaatggagtggactttgctgctgtggatgaaaatggaaataatgccctgcacctggccgtgatgcacggccgcctgaacaacatccgggtgctgctgacagaatgtactgtggatgctgaggccttcaacctgcggggccagagccccctgcacatcctgggccagtatggcaaggaaaatgctgctgccatctttgacctcttcctggagtgcatgcctggctaccccctggacaagccagatgctgatggcagcacagtgctgctgctggcctacatgaagggaaatgccaacctgtgccgggccatcgtgcgcagcggggcccggctgggcgtgaacaacaaccagggcgtgaacatcttcaactaccaggtggccaccaagcagctgctcttccggctgctggacatgctgagcaaggagcccccctggtgtgatggcagctactgctatgaatgtacagcccgcttcggcgtgaccaccaggaagcaccactgccgccactgcggccgcctgctgtgccacaagtgcagcaccaaggagatccccatcatcaagtttgacctgaacaagcctgtgcgggtgtgcaacatctgctttgatgtgctgaccctgggcggcgtgtcctag

SEQ ID NO: 32357 - DNA, 1464 bp, Artificial Sequence
  Description of Artificial Sequence: Synthetic coding sequence
atggccgaggaggaggtggccaagctggagaagcacctgatgctgctgcggcaggagtatgtgaagctgcagaagaagctggccgagacagagaagagatgtgccctgctggccgcccaggccaacaaggagagcagcagcgagagcttcatcagccggctgctggccatcgtggccgacctgtatgagcaggagcagtacagcgacctgaagatcaaggtgggggacagacacatcagcgcccacaagtttgtgctggccgcccggagtgacagctggagcctggccaacctgagcagcaccaaggagctggacctgagtgatgccaaccctgaggtgaccatgaccatgctgcgctggatctacacagatgagctggagttccgggaggatgatgtgttcctgacagagctgatgaagctggccaaccgcttccagctgcagctgctgcgggagcgctgtgagaagggcgtgatgagcctggtgaatgtgaggaactgcatccgcttctaccagacagctgaggagctgaatgccagcaccctgatgaactactgtgccgagatcatcgccagccactgggatgacctgaggaaggaggacttcagctccatgtctgcccagctgctgtacaagatgatcaagagcaagacagagtaccccctgcacaaggccatcaaggtggagagagaagatgtggtgttcctgtacctgattgagatggacagccagctgcccgggaagctgaatgaggccgaccacaatggagacctggccctggacctggccctgagccggcggctggagagcatcgccaccaccctggtgagccacaaggcagatgtggacatggtggacaagagcggctggagcctgctgcacaagggcatccagagaggagacctgtttgctgccaccttcctgatcaagaatggagcctttgtgaatgctgccaccctgggcgcccaggagacccccctgcacctggtggccctgtacagcagcaagaagcacagcgcagatgtgatgtctgagatggcccagattgctgaggccctgctgcaggccggggccaaccccaacatgcaggacagcaagggccgcacccccctgcacgtgtccatcatggctggaaatgaatatgtgttcagccagctgctgcagtgcaagcagctggacctggagctgaaggaccacgagggcagcacagccctgtggctggccgtgcagcacatcaccgtgtccagtgaccagagcgtgaacccctttgaagatgtgcctgtggtgaatggcaccagctttgatgagaacagctttgctgcccggctcatccagaggggcagccacacagatgccccagacacagccaccgggaaggcccgggccagcagaagaggagatgctggggtgtgccggcggcaggagatggcctgcaagtgcctgcaccccaagttcaggaactag

SEQ ID NO: 32358 - DNA, 3336 bp, Artificial Sequence
  Description of Artificial Sequence: Synthetic coding sequence
atgagcagctgcagaagatcctggaggcggcagaggtctgctgccctgtcctggctgcggcggcagacccggcgggctgctgccagccccagcagcgctgtgtgctggcccagctggcagaccagcaccagccgcagcagcacagatgccaaccctgaggtgaccatgaccatgctgcgctggatctacacagatgagctggagttcagagaagatgatgtgttcctgacagagctgatgaagctggccaaccgcttccagctgcagctgctgcgggagcgctgtgagaagggcgtgatgagcctggtgaatgtgaggaactgcatccgcttctaccagacagctgaggagctgaatgccagcaccctgatgaactactgtgccgagatcatcgccagccactgggatgacctgaggaaagaagacttcagctccatgtctgcccagctgctgtacaagatgatcaagagcaagacagagtaccccctgcacaaggccatcaaggtggagcgggaggatgtggtgttcctgtacctgattgagatggacagccagctgcccgggaagctgaatgaagctgaccacaacggggacctggccctggacctggccctgagccggcggctggagagcatcgccaccaccctggtgagccacaaggcagatgtggacatggtggacaagagcggctggagcctgctgcacaagggcatccagagaggagacctgtttgctgccaccttcctgatcaagaatggagcctttgtgaatgctgccaccctgggcgcccaggagacccccctgcacctggtggccctgtacagcagcaagaagcacagcgcagatgtgatgtctgagatggcccagattgctgaggccctgctgcaggccggggccaaccccaacatgcaggacagcaaaggaagaacacccctgcacgtgtccatcatggctggaaatgaatatgtgttcagccagctgctgcagtgcaagcagctggacctggagctgaaggaccacgagggcagcacagccctgtggctggccgtgcagcacatcaccgtgtccagtgaccagagcgtgaacccctttgaagatgtgcctgtggtgaatggcaccagctttgatgaaaattcctttgctgcccggctcatccagaggggcagccacacagatgccccagacacagccaccggcaactgcctgctgcagagagctgctggagctggaaatgaagctgctgccctcttcctggccaccaatggagcccacgtgaaccacaggaacaagtggggcgagacccccctgcacacagcctgccgccacggcctggccaacctgacagctgagctgctgcagcagggcgccaaccccaacctgcagacagaggaggccctgcccctgcccaaggaggccgccagcctgaccagcctggccgacagcgtgcacctgcagacccccctgcacatggccatcgcctacaaccacccagatgtggtgtctgtcatcctggagcagaaggccaatgccctgcacgccaccaacaacctgcagatcatcccagacttcagcctgaaggacagccgggaccagacagtgctgggcctggccctgtggacaggcatgcacaccatcgccgcccagctgctgggcagcggggccgccatcaatgacaccatgtctgatggccagaccctgctgcacatggccatccagaggcaggacagcaagagcgccctcttcctgctggagcaccaggccgacatcaacgtgtccaggacccaggatggagaaacagccctgcagctggccatccggaaccagctgcccctggtggtggatgccatctgcaccagaggagctgacatgtctgtgcctgatgagaagggcaacccccccctgtggctggccctggccaacaacctggaggacatcgccagcaccctggtgcgccacggctgtgatgccacctgctggggccctggccctgggggctgcctgcagaccctgctgcaccgggccattgatgaaaataatgagcccacagcctgcttcctgatccgcagcggctgtgatgtgaacagcccccggcagcccggggccaacggggagggggaggaggaggccagagatggccagacccccctgcacctggccgcctcctggggcctggaggagaccgtgcagtgcctgctggagtttggagccaacgtgaatgcccaggatgctgagggccgcacccccatccacgtggccatcagcagccagcacggcgtcatcatccagctgctggtgagccacccagacatccacctgaatgtgcgggaccggcagggcctgaccccatttgcctgtgccatgaccttcaagaacaacaagtctgctgaggccatcctgaagcgggagagcggggctgctgagcaggtggacaacaagggcaggaacttcctgcacgtggccgtgcagaacagcgacatcgagagcgtgctcttcctgatctctgtgcacgccaacgtgaacagccgggtgcaggatgccagcaagctgacccccctgcacctggccgtgcaggccggcagcgagatcatcgtgaggaacctgctgctggccggggccaaggtgaatgagctgaccaagcaccggcagacagccctgcacctggccgcccagcaggacctgcccaccatctgcagcgtgctgctggagaatggagtggactttgctgctgtggatgaaaatggaaataatgccctgcacctggccgtgatgcacggccgcctgaacaacatccgggtgctgctgacagagtgcaccgtggatgctgaggccttcaacctgcggggccagagccccctgcacatcctgggccagtatggcaaggaaaatgctgctgccatctttgacctcttcctggagtgcatgcctggctaccccctggacaagccagatgctgatggcagcacagtgctgctgctggcctacatgaagggaaatgccaacctgtgccgggccatcgtgcgcagcggggcccggctgggcgtgaacaacaaccagggcgtgaacatcttcaactaccaggtggccaccaagcagctgctcttccggctgctggacatgctgagcaaggagcccccctggtgtgatggcagctactgctatgagtgcacagccaggtttggagtgaccaccaggaagcaccactgccgccactgcggccgcctgctgtgccacaagtgcagcaccaaggagatccccatcatcaagtttgacctgaacaagcctgtgcgggtgtgcaacatctgctttgatgtgctgaccctgggcggcgtgtcctag

SEQ ID NO: 32359 - DNA, 3513 bp, Artificial Sequence; identical to SEQ ID NO: 32356
  Description of Artificial Sequence: Synthetic coding sequence

SEQ ID NO: 32360 - DNA, 2472 bp, Artificial Sequence
  Description of Artificial Sequence: Synthetic coding sequence
atgaagctgtttggcttcggcagcagaagaggccagacagcccagggcagcattgaccacgtgtacacaggcagcggctaccgcatccgggacagcgagctgcagaagatccacagagctgctgtgaagggagatgctgctgaggtggagcgctgcctggccaggagaagtggggacctggatgccctggacaagcagcacaggacagccctgcacctggcctgcaccagcggccacgtgcaggtggtgaccctgctggtgaacaggaagtgccagattgatgtgtgtgacaaggaaaatagaacacccctcatccaggccgtgcactgccaggaggaggcctgtgccgtcatcctgctggagcacggggccaaccccaacctgaaggacatctacggcaacacagccctgcactatgctgtgtacagcgagagcaccagcctggccgagaagctgctgagccatggagcccacatcgaggccctggacaaggacaacaacacccccctgctgtttgccatcatctgcaagaaggagaagatggtggagttcctgctgaagaagaaggccagcagccatgctgtggaccggctgcggcgcagcgccctgatgctggccgtgtactatgacagccctggcatcgtgaacatcctgctgaagcagaacattgatgtgtttgcccaggacatgtgtggcagagatgctgaggactatgccatcagccaccacctgaccaagatccagcagcagatcctggagcacaagaagaagatcctgaagaaggagaagagtgatgtgggcagcagtgatgagagcgctgtgtccatcttccacgagctgcgggtggacagcctgcctgccagtgatgacaaggacctgaatgtggccaccaagcagtgtgtgcctgagaaggtgtctgagcccctgcccggcagcagccatgagaagggcaaccgcatcgtgaatggccagggcgagggccccccagccaagcaccccagcctgaagcccagcacagaggtggaggaccctgctgtgaagggagctgtgcagaggaagaatgtgcagaccctgcgggcagagcaggccctgcctgtggccagcgaggaggagcaggagagacatgagaggtctgagaagaagcagccccaggtgaaggagggcaacaacaccaacaagtctgagaagatccagctgtctgagaacatctgtgacagcaccagcagcgctgctgctggccgcctgacccagcagaggaagattggcaagacctacccccagcagttccccaagaagctgaaggaggagcatgaccgctgcaccctgaagcaggagaatgaggagaagaccaacgtgaacatgctgtacaagaagaaccgggaggagctggagaggaaggagaagcagtacaagaaggaggtggaggccaagcagctggagcccaccgtgcagagcctggagatgaagagcaagacagccaggaacacccccaactgggacttccacaaccacgaggagatgaagggcctgatggatgagaactgcatcctgaaggctgacatcgccatcctgcggcaggagatctgcaccatgaagaatgacaacctggagaaggagaacaagtacctgaaggacatcaagatcgtgaaggagaccaatgctgccctggagaagtacatcaagctgaatgaggagatgatcacagaaacagccttccgctaccagcaggagctgaatgacctgaaggccgagaacacccggctgaatgctgagctgctgaaggagaaggagagcaagaagaggctggaggccgacatcgagagctaccagagccggctggccgccgccatcagcaagcacagcgagagcgtgaagacagagaggaacctgaagctggccctggagaggaccagagatgtgtctgtgcaggtggagatgagcagcgccatcagcaaggtgaaggccgagaatgagttcctgacagagcagctgtctgagacccagatcaagttcaatgccctgaaggacaagttcaggaagacccgggacagcctgaggaagaagagcctggccctggagaccgtgcagaatgacctgagccagacccagcagcagacccaggagatgaaggagatgtaccagaatgctgaggccaaggtgaacaacagcacaggcaagtggaactgtgtggaggagcgcatctgccacctgcagcgggagaatgcctggctggtgcagcagctggatgatgtgcaccagaaggaggaccacaaggagatcgtgaccaacatccagaggggcttcattgaaagtggcaagaaggacctggtgctggaggagaagagcaagaagctgatgaatgaatgtgaccacctgaaggagagcctcttccagtatgagcgggagaagacagagggcgtggtgtccatcaaggaggacaagtacttccagaccagcaggaagaccatctag

SEQ ID NO: 32361 - DNA, 1359 bp, Artificial Sequence
  Description of Artificial Sequence: Synthetic coding sequence
atgaaggtgcagcccagcgtgacctgtgtggcctcctggggcggcatcgtgcacctggaggccttcggggaccctgtgattgtgctgcggggggcctgggccgtgccccgggtggactgcctgattgacaccctgcggaccccaaatgccagctgcatgaggaagggcacccacctgctggtgccctgcctggaggaggaggagctggccctgcacagaagaaggctggacatgtctgaggccctgccctgccctgggaaggagacccccaccccaggctgccgcctgggcgccctgtactgggcctgtgtgcacaatgaccccacccagctgcaggccatcctggatggcggcgtgtccccagaggaggccacccaggtggacagcaatggccgcacaggcctgatggtggcctgctaccacggcttccagagcgtggtggccctgctgagccactgccccttcctggatgtgaaccagcaggacaagggcggggacacagccctgatgctggccgcccaggccggccacgtgcccctggtgtccctgctgctgaactactacgtgggcctggacctggagcggcgggaccagaggggcctgacagccctgatgaaggccgccatgaggaacagatgtgccgacctgacagctgtggaccctgtgcggggcaagacagccctggagtgggccgtgctgacagacagctttgacacagtgtggaggatccggcagctgctgcggcggccccaggtggagcagctgagccagcactacaagccagagtggccagccctgagcggcctggtggcccaggcccaggcccaggcccaggtggcccccagcctgctggagcggctgcaggccaccctgagcctgccctttgcccccagcccccaggagggcggcgtgctggaccacctggtgacagccaccaccagcctggccagcccctttgtgaccacagcctgccacaccctgtgcccagaccacccccccagcctgggcaccaggagcaagtctgtgcctgagctgctgggcacagcccctcctccacccctggtgccccagagccccccaggcagcccccagaggagcccctgggtgtttgtgccctaccagagcccccagggcatcctgagcaagtgcctgcagtggctgcagccccgggacagcaccagcccccggccccaggtgcccaagatcctgctgagcaaggccagcagcagcagccaccagtgccagcccaagcccagccccagcggccaccagagcctggccctgcccctgtggagataccaggagctgcgcatcgagaagaggaagcaggaggaggaggccaggatggcccagaagtag

SEQ ID NO: 32362 - DNA, 687 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgcacctgtgtggccacgtggacaccatccagttcctggtgtccaatggcctgaagattgacatctgcaaccaccagggcgccacccccctggtgctggccaagagaagaggagtgaacaaggatgtgatccggctgctggagagcctggaggagcaggaggtgaagggcttcaacagaggcacccacagcaagctggagaccatgcagacagctgagagcgagagcgccatggagagccacagcctgctgaaccccaacctgcagcagggcgagggcgtgctgagcagcttccgcaccacctggcaggagtttgtggaggacctgggcttctggagggtgctgctgctgatcttcgtcatcgccctgctgagcctgggcatcgcctactacgtgtctggagtgctgccctttgtggagaaccagcctgagctggtgcactag

SEQ ID NO: 32363 - DNA, 588 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgcacctgtgtggccacgtggacaccatccagttcctggtgtccaatggcctgaagattgacatctgcaaccaccagggcgccacccccctggtgctggccaagagaagaggagtgaacaaggatgtgatccggctgctggagagcctggaggagcaggaggtgaagggcttcaacagaggcacccacagcaagctggagaccatgcagacagctgagagcgagagcgccatggagagccacagcctgctgaaccccaacctgcagcagggcgagggcgtgctgagcagcttccgcaccacctggcaggagtttgtggaggacctgggcttctggagggtgtag

SEQ ID NO: 32364 - DNA, 687 bp, Artificial Sequence; identical to SEQ ID NO: 32362
  Description of Artificial Sequence: Synthetic coding sequence

SEQ ID NO: 32365 - DNA, 687 bp, Artificial Sequence; identical to SEQ ID NO: 32362
  Description of Artificial Sequence: Synthetic coding sequence

SEQ ID NO: 32366 - DNA, 699 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgcacctgtgtggccacgtggacaccatccagttcctggtgtccaatggcctgaagattgacatctgcaaccaccagggcgccacccccctggtgctggccaagagaagaggagtgaacaaggatgtgatccggctgctggagagcctggaggagcaggaggtgaagggcttcaacagaggcacccacagcaagctggagaccatgcagacagctgagagcgagagcgccatggagagccacagcctgctgaaccccaacctgcagcagggcgagggcgtgctgagcagcttccgcaccacctggcaggagtttgtggaggacctgggcttctggagggtgctgctgctgatcttcgtcatcgccctgctgagcctgggcatcgcctactacagaaggaccctgcggctgggcagctttgcccggcaggacaggagccgcatccaggccatctag

SEQ ID NO: 32367 - DNA, 249 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgtag

SEQ ID NO: 32368 - DNA, 261 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgcacctgtgtggctag

SEQ ID NO: 32369 - DNA, 312 bp, Artificial Sequence
  Description of Artificial Sequence: Synthetic coding sequence
atgtcctatgtgtttgtgaatgacagcagccagaccaacgtgcccctgctgcaggcctgcattgatggagacttcaactacagcaagaggctgctggagagcggctttgaccccaacatccgggacagccggggccgcacaggcctgcacctggccgccgcccggggaaatgtggacatctgccagctgctgcacaagtttggagctgacctgctggccacagactaccagggcaacacagccctgcacctgtgtggccacgtggacaccatccagttcctggtgtccaatggcctgaagattgacatctag

SEQ ID NO: 32370 - DNA, 1074 bp, Artificial Sequence
  Description of Artificial Sequence: Synthetic coding sequence
atgggcaacagacacagccagagctacaccctgtctgagggcagccagcagctgcccaagggggacagccagcccagcacagtggtgcagcccctgagccaccccagcagaaatggagagcctgaggccccccagcctgccaaggccagcagcccccagggctttgatgtggacagagatgccaagaagctgaacaaggcctgcaagggcatgggcaccaatgaggccgccatcatcgagatcctgagcggccgcaccagtgatgagcggcagcagatcaagcagaagtacaaggccacctacggcaaggagctggaggaggtgctgaagtctgagctgagcggcaactttgagaagacagccctggccctgctggaccggcccagtgaatatgctgcccggcagctgcagaaggccatgaagggcctgggcacagatgagagcgtgctgattgaggtgctgtgcaccaggaccaacaaggagatcatcgccatcaaggaggcctaccagaggctgtttgacaggagcctggagagtgatgtgaagggggacaccagcggcaacctgaagaagatcctggtgtccctgctgcaggccaacagaaatgaaggagatgatgtggacaaggacctggccggccaggatgccaaggacctgtatgatgctggggagggccgctggggcacagatgagctggccttcaatgaggtgctggccaagaggagctacaagcagctgcgggccaccttccaggcctaccagatcctgattggcaaggacatcgaggaggccatcgaggaggagaccagcggggacctgcagaaggcctacctgaccctggtgcgctgtgcccaggactgtgaggactactttgctgagcggctgtacaagtccatgaagggggccggcacagatgaggagaccctcatccgcatcgtggtgaccagggctgaggtggacctgcagggcatcaaggccaagttccaggagaagtaccagaagagcctgagtgacatggtgcggagtgacaccagcggggacttcaggaagctgctggtggccctgctgcactag

SEQ ID NO: 32371 - DNA, 951 bp, Artificial Sequence
  Description of Artificial Sequence: Synthetic coding sequence
atgggcaacagacatgccaaggccagcagcccccagggctttgatgtggacagagatgccaagaagctgaacaaggcctgcaagggcatgggcaccaatgaagctgccatcatcgagatcctgagcggccgcaccagtgatgagcggcagcagatcaagcagaagtacaaggccacctacggcaaggagctggaggaggtgctgaagtctgagctgagcggcaactttgagaagacagccctggccctgctggaccggcccagtgaatatgctgcccggcagctgcagaaggccatgaagggcctgggcacagatgaatctgtgctgattgaggtgctgtgcaccaggaccaacaaggagatcatcgccatcaaggaggcctaccagaggctgtttgacaggagcctggagagtgatgtgaagggggacaccagcggcaacctgaagaagatcctggtgtccctgctgcaggccaacagaaatgaaggagatgatgtggacaaggacctggccggccaggatgccaaggacctgtatgatgctggggagggccgctggggcacagatgagctggccttcaatgaggtgctggccaagaggagctacaagcagctgcgggccaccttccaggcctaccagatcctgattggcaaggacatcgaggaggccatcgaggaggagaccagcggggacctgcagaaggcctacctgaccctggtgcgctgtgcccaggactgtgaggactactttgctgagcggctgtacaagtccatgaagggagctggaacagatgaggagaccctcatcagaattgtggtgaccagggctgaggtggacctgcagggcatcaaggccaagttccaggagaagtaccagaagagcctgagtgacatggtgcggagtgacaccagcggggacttcaggaagctgctggtggccctgctgcactag

SEQ ID NO: 32372 - DNA, 2946 bp, Artificial Sequence
  Description of Artificial Sequence: Synthetic coding sequence
atggtgcaccacagcggcagcatccagagcttcaagcagcagaagggcatgaacatcagcaagtctgagatcaccaaggagaccagcctgaagcccagccgccgcagcctgccctgcctggcccagagctatgcctacagcaagagcctgagccagagcaccagcctcttccagagcacagagagcgagagccaggcccccaccagcatcaccctcatcagcacagacaaggccgagcaggtgaacacagaggagaacaagaatgacagcgtgctgcgctgcagctttgctgacctgagtgacttctgcctggccctgggcaaggacaaggactacacagatgagagcgagcacgccacctatgacaggagccgcctcatcaatgactttgtgatcaaggacaagtctgagttcaagaccaagctgagcaagaatgacatgaactacatcgccagcagcggccccctcttcaaggatggcaagaagagaattgactacatcctggtgtacaggaagaccaacatccagtatgacaagaggaacacctttgagaagaacctgcgggcagagggcctgatgctggagaaggagcccgccatcgccagcccagacatcatgttcatcaagatccacatcccctgggacaccctgtgcaagtatgcagagcggctgaacatccgcatgcccttcaggaagaagtgctactacacagatggccgcagcaagtccatgggccgcatgcagacctacttccgccgcatcaagaactggatggcccagaaccccatggtgctggacaagagcgccttcccagacctggaggagagtgactgctacacaggccccttcagccgggcccgcatccaccacttcatcatcaacaacaaggacaccttcttcagcaatgccaccaggagccgcatcgtgtaccacatgctggagaggaccaagtatgaaaatggcatcagcaaggtgggcatcaggaagctgatcaacaacggcagctacatcgccgccttcccccctcatgaaggagcctacaagagcagccagcccatcaagacccacggcccccagaacaacagacacctgctgtatgagcgctgggcccgctggggcatgtggtacaagcaccagcccctggacctgatccggctgtactttggagagaagattggcctgtactttgcctggctgggctggtacacaggcatgctgatcccagctgccatcgtgggcctgtgtgtgttcttctacggcctcttcaccatgaacaacagccaggtgtcccaggagatctgcaaggccacagaggtgttcatgtgccccctgtgtgacaagaactgcagcctgcagaggctgaatgacagctgcatctatgccaaggtgacctacctgtttgacaatggaggcaccgtcttctttgccatcttcatggccatctgggccaccgtcttcctggagttctggaagagaagaagaagcatcctgacctacacctgggacctgattgagtgggaggaggaggaggagaccctgcggccccagtttgaggccaagtactacaagatggagatcgtgaaccccatcaccgggaagccagagccccaccagcccagcagtgacaaggtgacccggctgctggtgtctgtgtctggcatcttcttcatgatcagcctggtgatcacagctgtgtttggagtggtggtgtaccgcctggtggtgatggagcagtttgccagcttcaagtggaacttcatcaagcagtactggcagtttgccaccagcgctgctgctgtgtgcatcaacttcatcatcatcatgctgctgaacctggcctatgagaagatcgcctacctgctgaccaacctggagtaccccaggacagaaagtgagtgggagaacagctttgccctgaagatgttcctgttccagtttgtgaacctgaacagcagcatcttctacatcgccttcttcctgggccgctttgtgggccaccctgggaagtacaacaagctgtttgaccgctggaggctggaggagtgccaccccagcggctgcctgattgacctgtgcctgcagatgggcgtcatcatgttcctgaagcagatctggaacaacttcatggagctgggctaccccctcatccagaactggtggagccgccacaagatcaagaggggcatccatgatgccagcatcccccagtgggagaatgactggaacctgcagcccatgaacctgcacggcctgatggatgagtacctggagatggtgctgcagtttggcttcaccaccatctttgtggccgccttccccctggcccccctgctggccctgctgaacaacatcatcgagatccggctggatgcctacaagtttgtgacccagtggaggcggcccctgcctgcccgggccacagacatcggcatctggctgggcatcctggagggcatcggcatcctggccgtcatcaccaatgcctttgtgattgccatcaccagtgactacatccccaggtttgtgtatgagtacaagtatggcccctgtgccaaccacgtggagcccagcgagaactgcctgaagggctacgtgaacaacagcctgtccttctttgacctgtctgagctgggcatgggcaagagcggctactgccgctacagagactaccggggccccccctggagcagcaagccctatgagttcaccctgcagtactggcacatcctggccgcccggctggccttcatcatcgtgtttgagcacctggtgtttggcatcaagagcttcatcgcctacctgatcccagatgtgcccaagggcctgcatgaccgcatcagaagagagaagtacctggtgcaggagatgatgtatgaggccgagctggagcacctgcagcagcagaggaggaagagcggccagcctgtgcaccacgagtggccctag

SEQ ID NO: 32373 - DNA, 2898 bp, Artificial Sequence
  Description of Artificial Sequence: Synthetic coding sequence
atgaacatcagcaagtctgagatcaccaaggagaccagcctgaagcccagccgccgcagcctgccctgcctggcccagagctatgcctacagcaagagcctgagccagagcaccagcctcttccagagcacagagagcgagagccaggcccccaccagcatcaccctcatcagcacagacaaggccgagcaggtgaacacagaggagaacaagaatgacagcgtgctgcgctgcagctttgctgacctgagtgacttctgcctggccctgggcaaggacaaggactacacagatgagagcgagcacgccacctatgacaggagccgcctcatcaatgactttgtgatcaaggacaagtctgagttcaagaccaagctgagcaagaatgacatgaactacatcgccagcagcggccccctcttcaaggatggcaagaagagaattgactacatcctggtgtacaggaagaccaacatccagtatgacaagaggaacacctttgagaagaacctgcgggcagagggcctgatgctggagaaggagcccgccatcgccagcccagacatcatgttcatcaagatccacatcccctgggacaccctgtgcaagtatgcagagcggctgaacatccgcatgcccttcaggaagaagtgctactacacagatggccgcagcaagtccatgggccgcatgcagacctacttccgccgcatcaagaactggatggcccagaaccccatggtgctggacaagagcgccttcccagacctggaggagagtgactgctacacaggccccttcagccgggcccgcatccaccacttcatcatcaacaacaaggacaccttcttcagcaatgccaccaggagccgcatcgtgtaccacatgctggagaggaccaagtatgaaaatggcatcagcaaggtgggcatcaggaagctgatcaacaacggcagctacatcgccgccttcccccctcatgaaggagcctacaagagcagccagcccatcaagacccacggcccccagaacaacagacacctgctgtatgagcgctgggcccgctggggcatgtggtacaagcaccagcccctggacctgatccggctgtactttggagagaagattggcctgtactttgcctggctgggctggtacacaggcatgctgatcccagctgccatcgtgggcctgtgtgtgttcttctacggcctcttcaccatgaacaacagccaggtgtcccaggagatctgcaaggccacagaggtgttcatgtgccccctgtgtgacaagaactgcagcctgcagaggctgaatgacagctgcatctatgccaaggtgacctacctgtttgacaatggaggcaccgtcttctttgccatcttcatggccatctgggccaccgtcttcctggagttctggaagagaagaagaagcatcctgacctacacctgggacctgattgagtgggaggaggaggaggagaccctgcggccccagtttgaggccaagtactacaagatggagatcgtgaaccccatcaccgggaagccagagccccaccagcccagcagtgacaaggtgacccggctgctggtgtctgtgtctggcatcttcttcatgatcagcctggtgatcacagctgtgtttggagtggtggtgtaccgcctggtggtgatggagcagtttgccagcttcaagtggaacttcatcaagcagtactggcagtttgccaccagcgctgctgctgtgtgcatcaacttcatcatcatcatgctgctgaacctggcctatgagaagatcgcctacctgctgaccaacctggagtaccccaggacagaaagtgagtgggagaacagctttgccctgaagatgttcctgttccagtttgtgaacctgaacagcagcatcttctacatcgccttcttcctgggccgctttgtgggccaccctgggaagtacaacaagctgtttgaccgctggaggctggaggagtgccaccccagcggctgcctgattgacctgtgcctgcagatgggcgtcatcatgttcctgaagcagatctggaacaacttcatggagctgggctaccccctcatccagaactggtggagccgccacaagatcaagaggggcatccatgatgccagcatcccccagtgggagaatgactggaacctgcagcccatgaacctgcacggcctgatggatgagtacctggagatggtgctgcagtttggcttcaccaccatctttgtggccgccttccccctggcccccctgctggccctgctgaacaacatcatcgagatccggctggatgcctacaagtttgtgacccagtggaggcggcccctgcctgcccgggccacagacatcggcatctggctgggcatcctggagggcatcggcatcctggccgtcatcaccaatgcctttgtgattgccatcaccagtgactacatccccaggtttgtgtatgagtacaagtatggcccctgtgccaaccacgtggagcccagcgagaactgcctgaagggctacgtgaacaacagcctgtccttctttgacctgtctgagctgggcatgggcaagagcggctactgccgctacagagactaccggggccccccctggagcagcaagccctatgagttcaccctgcagtactggcacatcctggccgcccggctggccttcatcatcgtgtttgagcacctggtgtttggcatcaagagcttcatcgcctacctgatcccagatgtgcccaagggcctgcatgaccgcatcagaagagagaagtacctggtgcaggagatgatgtatgaggccgagctggagcacctgcagcagcagaggaggaagagcggccagcctgtgcaccacgagtggccctag

SEQ ID NO: 32374 - DNA, 2508 bp, Artificial Sequence
  Description of Artificial Sequence: Synthetic coding sequence
atgaactacatcgccagcagcggccccctcttcaaggatggcaagaagagaattgactacatcctggtgtacaggaagaccaacatccagtatgacaagaggaacacctttgagaagaacctgcgggcagagggcctgatgctggagaaggagcccgccatcgccagcccagacatcatgttcatcaagatccacatcccctgggacaccctgtgcaagtatgcagagcggctgaacatccgcatgcccttcaggaagaagtgctactacacagatggccgcagcaagtccatgggccgcatgcagacctacttccgccgcatcaagaactggatggcccagaaccccatggtgctggacaagagcgccttcccagacctggaggagagtgactgctacacaggccccttcagccgggcccgcatccaccacttcatcatcaacaacaaggacaccttcttcagcaatgccaccaggagccgcatcgtgtaccacatgctggagaggaccaagtatgaaaatggcatcagcaaggtgggcatcaggaagctgatcaacaacggcagctacatcgccgccttcccccctcatgaaggagcctacaagagcagccagcccatcaagacccacggcccccagaacaacagacacctgctgtatgagcgctgggcccgctggggcatgtggtacaagcaccagcccctggacctgatccggctgtactttggagagaagattggcctgtactttgcctggctgggctggtacacaggcatgctgatcccagctgccatcgtgggcctgtgtgtgttcttctacggcctcttcaccatgaacaacagccaggtgtcccaggagatctgcaaggccacagaggtgttcatgtgccccctgtgtgacaagaactgcagcctgcagaggctgaatgacagctgcatctatgccaaggtgacctacctgtttgacaatggaggcaccgtcttctttgccatcttcatggccatctgggccaccgtcttcctggagttctggaagagaagaagaagcatcctgacctacacctgggacctgattgagtgggaggaggaggaggagaccctgcggccccagtttgaggccaagtactacaagatggagatcgtgaaccccatcaccgggaagccagagccccaccagcccagcagtgacaaggtgacccggctgctggtgtctgtgtctggcatcttcttcatgatcagcctggtgatcacagctgtgtttggagtggtggtgtaccgcctggtggtgatggagcagtttgccagcttcaagtggaacttcatcaagcagtactggcagtttgccaccagcgctgctgctgtgtgcatcaacttcatcatcatcatgctgctgaacctggcctatgagaagatcgcctacctgctgaccaacctggagtaccccaggacagaaagtgagtgggagaacagctttgccctgaagatgttcctgttccagtttgtgaacctgaacagcagcatcttctacatcgccttcttcctgggccgctttgtgggccaccctgggaagtacaacaagctgtttgaccgctggaggctggaggagtgccaccccagcggctgcctgattgacctgtgcctgcagatgggcgtcatcatgttcctgaagcagatctggaacaacttcatggagctgggctaccccctcatccagaactggtggagccgccacaagatcaagaggggcatccatgatgccagcatcccccagtgggagaatgactggaacctgcagcccatgaacctgcacggcctgatggatgagtacctggagatggtgctgcagtttggcttcaccaccatctttgtggccgccttccccctggcccccctgctggccctgctgaacaacatcatcgagatccggctggatgcctacaagtttgtgacccagtggaggcggcccctgcctgcccgggccacagacatcggcatctggctgggcatcctggagggcatcggcatcctggccgtcatcaccaatgcctttgtgattgccatcaccagtgactacatccccaggtttgtgtatgagtacaagtatggcccctgtgccaaccacgtggagcccagcgagaactgcctgaagggctacgtgaacaacagcctgtccttctttgacctgtctgagctgggcatgggcaagagcggctactgccgctacagagactaccggggccccccctggagcagcaagccctatgagttcaccctgcagtactggcacatcctggccgcccggctggccttcatcatcgtgtttgagcacctggtgtttggcatcaagagcttcatcgcctacctgatcccagatgtgcccaagggcctgcatgaccgcatcagaagagagaagtacctggtgcaggagatgatgtatgaggccgagctggagcacctgcagcagcagaggaggaagagcggccagcctgtgcaccacgagtggccctag

SEQ ID NO: 32375 - DNA, 2898 bp, Artificial Sequence; identical to SEQ ID NO: 32373
  Description of Artificial Sequence: Synthetic coding sequence

SEQ ID NO: 32376 - DNA, 2652 bp, Artificial Sequence
  Description of Artificial Sequence: Synthetic coding sequence
atgaggcctggccccaacaagccctaccccagccacagcaacatctttgcctaccacagcagcgccctgggcaaggacaaggactacacagatgaaagtgaacatgccacctatgacaggagccgcctcatcaatgactttgtgatcaaggacaagtctgagttcaagaccaagctgagcaagaatgacatgaactacatcgccagcagcggccccctcttcaaggatggcaagaagagaattgactacatcctggtgtacaggaagaccaacatccagtatgacaagaggaacacctttgagaagaacctgcgggcagagggcctgatgctggagaaggagcccgccatcgccagcccagacatcatgttcatcaagatccacatcccctgggacaccctgtgcaagtatgcagagcggctgaacatccgcatgcccttcaggatgcagacctacttccgccgcatcaagaactggatggcccagaaccccatggtgctggacaagagcgccttcccagacctggaggagagtgactgctacacaggccccttcagccgggcccgcatccaccacttcatcatcaacaacaaggacaccttcttcagcaatgccaccaggagccgcatcgtgtaccacatgctggagaggaccaagtatgaaaatggcatcagcaaggtgggcatcaggaagctgatcaacaacggcagctacatcgccgccttcccccctcatgaaggagcctacaagagcagccagcccatcaagacccacggcccccagaacaacagacacctgctgtatgagcgctgggcccgctggggcatgtggtacaagcaccagcccctggacctgatccggctgtactttggagagaagattggcctgtactttgcctggctgggctggtacacaggcatgctgatcccagctgccatcgtgggcctgtgtgtgttcttctacggcctcttcaccatgaacaacagccaggtgtcccaggagatctgcaaggccacagaggtgttcatgtgccccctgtgtgacaagaactgcagcctgcagaggctgaatgacagctgcatctatgccaaggtgacctacctgtttgacaatggaggcaccgtcttctttgccatcttcatggccatctgggccaccgtcttcctggagttctggaagagaagaagaagcatcctgacctacacctgggacctgattgagtgggaggaggaggaggagaccctgcggccccagtttgaggccaagtactacaagatggagatcgtgaaccccatcaccgggaagccagagccccaccagcccagcagtgacaaggtgacccggctgctggtgtctgtgtctggcatcttcttcatgatcagcctggtgatcacagctgtgtttggagtggtggtgtaccgcctggtggtgatggagcagtttgccagcttcaagtggaacttcatcaagcagtactggcagtttgccaccagcgctgctgctgtgtgcatcaacttcatcatcatcatgctgctgaacctggcctatgagaagatcgcctacctgctgaccaacctggagtaccccaggacagaaagtgagtgggagaacagctttgccctgaagatgttcctgttccagtttgtgaacctgaacagcagcatcttctacatcgccttcttcctgggccgctttgtgggccaccctgggaagtacaacaagctgtttgaccgctggaggctggaggagtgccaccccagcggctgcctgattgacctgtgcctgcagatgggcgtcatcatgttcctgaagcagatctggaacaacttcatggagctgggctaccccctcatccagaactggtggagccgccacaagatcaagaggggcatccatgatgccagcatcccccagtgggagaatgactggaacctgcagcccatgaacctgcacggcctgatggatgagtacctggagatggtgctgcagtttggcttcaccaccatctttgtggccgccttccccctggcccccctgctggccctgctgaacaacatcatcgagatccggctggatgcctacaagtttgtgacccagtggaggcggcccctgcctgcccgggccacagacatcggcatctggctgggcatcctggagggcatcggcatcctggccgtcatcaccaatgcctttgtgattgccatcaccagtgactacatccccaggtttgtgtatgagtacaagtatggcccctgtgccaaccacgtggagcccagcgagaactgcctgaagggctacgtgaacaacagcctgtccttctttgacctgtctgagctgggcatgggcaagagcggctactgccgctacagagactaccggggccccccctggagcagcaagccctatgagttcaccctgcagtactggcacatcctggccgcccggctggccttcatcatcgtgtttgagcacctggtgtttggcatcaagagcttcatcgcctacctgatcccagatgtgcccaagggcctgcatgaccgcatcagaagagagaagtacctggtgcaggagatgatgtatgaggccgagctggagcacctgcagcagcagaggaggaagagcggccagcctgtgcaccacgagtggccctag

SEQ ID NO: 32377 - DNA, 1428 bp, Artificial Sequence
  Description of Artificial Sequence: Synthetic coding sequence
atggctgtgtgggccaccgtcttcctggagttctggaagagaagaagagctgtgattgcctatgactgggacctgattgactgggaggaggaggagatctgtgtggtgattgctgctgtgtttggaattgtcatctacagagtggtgacagtgtccacctttgctgccttcaagtgggccctgatccggaacaacagccaggtggccaccactggaacagctgtgtgcatcaacttctgcatcatcatgctgctgaatgtgctgtatgagaaggtggccctgctgctgaccaacctggagcagcccaggacagagagcgagtgggagaacagcttcaccctgaagatgttcctgttccagtttgtgaacctgaacagcagcaccttctacatcgccttcttcctgggccgcttcaccggccaccctggggcctacctgcggctcatcaaccgctggaggctggaggagtgccaccccagcggctgcctgattgacctgtgcatgcagatgggcatcatcatggtgctgaagcagacctggaacaacttcatggagctgggctaccccctcatccagaactggtggaccaggaggaaggtgcggcaggagcacggccctgagaggaagatctccttcccccagtgggagaaggactacaacctgcagcccatgaatgcctacggcctgtttgatgagtacctggagatgatcctgcagtttggcttcaccaccatctttgtggccgccttccccctggcccccctgctggccctgctgaacaacatcatcgagatccggctggatgcctacaagtttgtgacccagtggaggcggcccctggccagccgggccaaggacatcggcatctggtacggcatcctggagggcatcggcatcctgagcgtcatcaccaatgcctttgtgattgccatcaccagtgacttcatcccccggctggtgtatgcctacaagtatggcccctgtgccggccagggcgaggccggccagaagtgcatggtgggctacgtgaatgccagcctgagcgtcttccgcatcagtgactttgagaacagaagtgagcctgagagtgatggcagcgagttcagcggcacccccctgaagtactgccgctacagagactacagagaccccccccacagcctggtgccctacggctacaccctgcagttctggcacgtgctggccgcccggctggccttcatcatcgtgtttgagcacctggtgttctgcatcaagcacctgatctcctacctgatcccagacctgcccaaggacctgcgggacaggatgaggcgggagaagtacctgatccaggagatgatgtatgaagctgagctggagcggctgcagaaggagaggaaggagaggaagaagaatggcaaggcccaccacaatgagtggccctag

SEQ ID NO: 32378 - DNA, 2868 bp, Artificial Sequence
  Description of Artificial Sequence: Synthetic coding sequence
atggaggccagcagcagcggcatcaccaacgggaagaccaaggtgttccaccctgagggcggcgtggacctgcagggctaccagctggacatgcagatcctgcctgatggccccaagagtgatgtggacttcagcgagatcctgaatgccatccaggagatggccaaggatgtgaacatcctgtttgatgagctggaggccgtgagcagcccctgcaaggatgatgacagcctgctgcaccctggcaacctgaccagcaccagtgatgatgccagccggctggaggccggcggggagaccgtgcctgagaggaacaagagcaatggcctgtacttcagagatggcaagtgcagaattgactacatcctggtgtacaggaagagcaacccccagacagagaagcgggaggtgtttgagaggaacatccgggcagagggcctgcagatggagaaggagagcagcctcatcaacagcgacatcatctttgtgaagctgcacgccccctgggaggtgctgggccgctatgcagagcagatgaatgtgaggatgcccttccggaggaagatctactacctgccccggcgctacaagttcatgagcagaattgacaagcagatcagccgcttccgccgctggctgcccaagaagcccatgaggctggacaaggagaccctgcctgacctggaggagaatgactgctacacagcccccttcagccagcagaggatccaccacttcatcatccacaacaaggagaccttcttcaacaatgccaccaggagcagaattgtgcaccacatcctgcagaggatcaagtatgaggagggcaagaacaagattggcctgaaccggctgctgaccaacggcagctatgaagctgccttccccctgcacgagggcagctaccgcagcaagaacagcatccgcacccatggagctgagaaccaccgccacctgctgtatgagtgctgggcctcctggggcgtgtggtacaagtaccagcccctggacctggtgcggcgctactttggagagaagattggcctgtactttgcctggctgggctggtacacaggcatgctgtttcctgctgccttcatcggcctgtttgtgttcctgtatggagtgaccaccctggaccacagccaggtgtccaaggaggtgtgccaggccacagacatcatcatgtgccctgtgtgtgacaagtactgccccttcatgaggctgagtgacagctgtgtgtatgccaaggtgacccacctgtttgacaacggggccaccgtcttctttgctgtgttcatggctgtgtgggccaccgtcttcctggagttctggaagagaagaagagctgtgattgcctatgactgggacctgattgactgggaggaggaggaggaggagatccggccccagtttgaggccaagtacagcaagaaggagaggatgaaccccatcagcggcaagccagagccctaccaggccttcacagacaagtgcagccggctgattgtgtctgccagcggcatcttcttcatgatctgtgtggtgattgctgctgtgtttggaattgtcatctacagagtggtgacagtgtccacctttgctgccttcaagtgggccctgatccggaacaacagccaggtggccaccactggaacagctgtgtgcatcaacttctgcatcatcatgctgctgaatgtgctgtatgagaaggtggccctgctgctgaccaacctggagcagcccaggacagagagcgagtgggagaacagcttcaccctgaagatgttcctgttccagtttgtgaacctgaacagcagcaccttctacatcgccttcttcctgggccgcttcaccggccaccctggggcctacctgcggctcatcaaccgctggaggctggaggagtgccaccccagcggctgcctgattgacctgtgcatgcagatgggcatcatcatggtgctgaagcagacctggaacaacttcatggagctgggctaccccctcatccagaactggtggaccaggaggaaggtgcggcaggagcacggccctgagaggaagatctccttcccccagtgggagaaggactacaacctgcagcccatgaatgcctacggcctgtttgatgagtacctggagatgatcctgcagtttggcttcaccaccatctttgtggccgccttccccctggcccccctgctggccctgctgaacaacatcatcgagatccggctggatgcctacaagtttgtgacccagtggaggcggcccctggccagccgggccaaggacatcggcatctggtacggcatcctggagggcatcggcatcctgagcgtcatcaccaatgcctttgtgattgccatcaccagtgacttcatcccccggctggtgtatgcctacaagtatggcccctgtgccggccagggcgaggccggccagaagtgcatggtgggctacgtgaatgccagcctgagcgtcttccgcatcagtgactttgagaacagaagtgagcctgagagtgatggcagcgagttcagcggcacccccctgaagtactgccgctacagagactacagagaccccccccacagcctggtgccctacggctacaccctgcagttctggcacgtgctggccgcccggctggccttcatcatcgtgtttgagcacctggtgttctgcatcaagcacctgatctcctacctgatcccagacctgcccaaggacctgcgggacaggatgaggcgggagaagtacctgatccaggagatgatgtatgaagctgagctggagcggctgcagaaggagaggaaggagaggaagaagaatggcaaggcccaccacaatgagtggccctag

SEQ ID NO: 32379 - DNA, 2763 bp, Artificial Sequence
  Description of Artificial Sequence: Synthetic coding sequence
atggaggccagcagcagcggcatcaccaacgggaagaccaaggtgttccaccctgtggccaaggatgtgaacatcctgtttgatgagctggaggccgtgagcagcccctgcaaggatgatgacagcctgctgcaccctggcaacctgaccagcaccagtgatgatgccagccggctggaggccggcggggagaccgtgcctgagaggaacaagagcaatggcctgtacttcagagatggaaaatgtagaattgactacatcctggtgtacaggaagagcaacccccagacagagaagcgggaggtgtttgaaagaaacatccgggcagagggcctgcagatggagaaggagagcagcctcatcaacagcgacatcatctttgtgaagctgcacgccccctgggaggtgctgggccgctatgcagagcagatgaatgtgaggatgcccttccggaggaagatctactacctgccccggcgctacaagttcatgagcagaattgacaagcagatcagccgcttccgccgctggctgcccaagaagcccatgaggctggacaaggagaccctgcctgacctggaggagaatgactgctacacagcccccttcagccagcagaggatccaccacttcatcatccacaacaaggagaccttcttcaacaatgccaccaggagccgcatcgtgcaccacatcctgcagaggatcaagtatgaggagggcaagaacaagattggcctgaaccggctgctgaccaacggcagctatgaggccgccttccccctgcacgagggcagctaccgcagcaagaacagcatccgcacccacggggctgagaaccaccgccacctgctgtatgagtgctgggcctcctggggcgtgtggtacaagtaccagcccctggacctggtgcggcgctactttggagagaagattggcctgtactttgcctggctgggctggtacacaggcatgctgtttcctgctgccttcatcggcctgtttgtgttcctgtatggagtgaccaccctggaccacagccaggtgtccaaggaggtgtgccaggccacagacatcatcatgtgccctgtgtgtgacaagtactgccccttcatgaggctgagtgacagctgtgtgtatgccaaggtgacccacctgtttgacaatggagccaccgtcttctttgctgtgttcatggctgtgtgggccaccgtcttcctggagttctggaagagaagaagagctgtgattgcctatgactgggacctgattgactgggaggaggaggaggaggagatccggccccagtttgaggccaagtacagcaagaaggagaggatgaaccccatcagcggcaagccagagccctaccaggccttcacagacaagtgcagccgcctcatcgtgtctgccagcggcatcttcttcatgatctgtgtggtgattgctgctgtgtttggcatcgtcatctacagagtggtgacagtgtccacctttgctgccttcaagtgggccctgatccggaacaacagccaggtggccaccaccggcacagctgtgtgcatcaacttctgcatcatcatgctgctgaatgtgctgtatgagaaggtggccctgctgctgaccaacctggagcagcccaggacagaaagtgagtgggagaacagcttcaccctgaagatgttcctgttccagtttgtgaacctgaacagcagcaccttctacatcgccttcttcctgggccgcttcaccggccaccctggggcctacctgcggctcatcaaccgctggaggctggaggagtgccaccccagcggctgcctgattgacctgtgcatgcagatgggcatcatcatggtgctgaagcagacctggaacaacttcatggagctgggctaccccctcatccagaactggtggaccaggaggaaggtgcggcaggagcacggccctgagaggaagatctccttcccccagtgggagaaggactacaacctgcagcccatgaatgcctacggcctgtttgatgagtacctggagatgatcctgcagtttggcttcaccaccatctttgtggccgccttccccctggcccccctgctggccctgctgaacaacatcatcgagatccggctggatgcctacaagtttgtgacccagtggaggcggcccctggccagccgggccaaggacatcggcatctggtacggcatcctggagggcatcggcatcctgagcgtcatcaccaatgccttcgtcatcgccatcaccagtgacttcatcccccggctggtgtatgcctacaagtatggcccctgtgccggccagggcgaggccggccagaagtgcatggtgggctacgtgaatgccagcctgtctgtgttccgcatcagtgactttgaaaatagaagtgagcctgagagtgatggcagcgagttcagcggcacccccctgaagtactgccgctacagagactacagagatcctccccacagcctggtgccctacggctacaccctgcagttctggcacgtgctggccgcccggctggccttcatcatcgtgtttgagcacctggtgttctgcatcaagcacctgatctcctacctgatcccagacctgcccaaggacctgcgggacaggatgagaagagagaagtacctgatccaggagatgatgtatgaggccgagctggagcggctgcagaaggagaggaaggagaggaagaagaatggcaaggcccaccacaatgagtggccctag

SEQ ID NO: 32380 - DNA, 1071 bp, Artificial Sequence
  Description of Artificial Sequence: Synthetic coding sequence
atggccagcctgacagcctatgacaaggatgtgagcagcggcagctacaacctgagcagcgccaccaccggcagctactacagctgtgtgtcccagatcaccatcggctatgatgtggccggccctgtggccatcggcctgacccactggaagaacccctacgtgcagggccggcccaccctgcccagcgacctgcccctgtttgtgtccaaggatgctggcatccctgtgtaccaccgctccttcaccaggaagacagaccaggccacccccctgagctgcccagccagcctgagcatcacccctgtgcccagctacagcagcagcagccaggagaccctgagccaggacaccaccggcctgagcctgagcatccacggggctgagaagaggctgcagatccaccagaggagatctgtggccagcaggcctgccagcagaagaaggctgcctgtggtgcgccacagcagcctgcccccaggccgccgcagcatcaagatggaggccagcagcagcggcatcaccaacgggaagaccaaggtgttccaccctgagggcggcgtggacctgcagggctaccagctggacatgcagatcctgcctgatggccccaagagtgatgtggacttcagcgagatcctgaatgccatccaggagatggccaaggatgtgaacatcctgtttgatgagctggaggccgtgagcagcccctgcaaggatgatgacagcctgctgcaccctggcaacctgaccagcaccagtgatgatgccagccggctggaggccggcggggagaccgtgcctgagaggaacaagagcaatggcctgtacttcagagatggcaagtgcagaattgactacatcctggtgtacaggaagagcaacccccagacagagaagcgggaggtgtttgagaggaacatccgggcagagggcctgcagatggagaaggagagcagcctcatcaacagcgacatcatctttgtgaagctgcacgccccctgggaggtgctgggccgctatgcagagcagatgaatgtgaggatgcccttcagcagcaactgcaactag

SEQ ID NO: 32381 - DNA, 36 bp, Artificial Sequence; identical to SEQ ID NO: 16405
  Description of Artificial Sequence: Synthetic coding sequence

SEQ ID NO: 32382 - DNA, 1428 bp, Artificial Sequence; identical to SEQ ID NO: 32377
  Description of Artificial Sequence: Synthetic coding sequence

SEQ ID NO: 32383 - DNA, 2802 bp, Artificial Sequence
  Description of Artificial Sequence: Synthetic coding sequence
atgaggatggccgccacagcctgggccggcctgcagggcccccccctgcccaccctgtgcccagctgtgaggacaggcctgtactgccgggaccaggcccatgctgagcgctgggccatgaccagcgagaccagcagcggcagccactgtgcccggagcaggatgctgcggcggcgggcccaggaggaggacagcacagtgctgattgatgtgtccccacctgaggccgagaagaggggcagctatggcagcacagcccacgccagcgagcccggcggccagcaggccgccgcctgcagagctggcagccctgccaagcccagaattgctgactttgtgctggtgtgggaggaggacctgaagctggaccggcagcaggacagcgctgcccgggacagaacagacatgcacaggacctggagggagaccttcctggacaacctgcgggctgctggcctgtgtgtggaccagcaggatgtgcaggacggcaacaccaccgtgcactacgccctgctgagcgcctcctgggccgtgctgtgctactatgcagaggacctgcggctgaagctgcccctgcaggagctgcccaaccaggccagcaactggagcgctggcctgctggcctggctgggcatccccaacgtgctgctggaggtggtgcctgatgtgcccccagagtactacagctgccgcttccgggtgaacaagctgccccgcttcctgggcagtgacaaccaggacaccttcttcaccagcaccaagaggcaccagatcctgtttgagatcctggccaagaccccctacggccacgagaagaagaacctgctgggcatccaccagctgctggccgagggcgtgctgtctgctgccttccccctgcatgatggccccttcaagaccccacctgagggcccccaggccccccggctgaaccagaggcaggtgctcttccagcactgggcccgctggggcaagtggaacaagtaccagcccctggaccacgtgcggcgctactttggagagaaggtggccctgtactttgcctggctgggcttctacacaggctggctgctgcctgctgctgtggtgggcaccctggtgttcctggtgggctgcttcctggtgttcagtgacatccccacccaggagctgtgtggcagcaaggacagctttgagatgtgccccctgtgcctggactgccccttctggctgctgagcagcgcctgtgccctggcccaggccggccgcctgtttgaccacggcggcaccgtcttcttcagcctcttcatggccctgtgggccgtgctgctgctggagtactggaagaggaagagcgccaccctggcctaccgctgggactgcagcgactatgaggacacagaggagcggccccggccccagtttgctgccagcgcccccatgacagcccccaaccccatcactggagaagatgagccctacttccctgagaggagccgggcccggaggatgctggccggctctgtggtgattgtggtgatggtggccgtggtggtgatgtgcctggtgtccatcatcctgtaccgggccatcatggccatcgtggtgagccgcagcggcaacaccctgctggccgcctgggccagccgcatcgccagcctgaccggctctgtggtgaacctggtgttcatcctgatcctgagcaagatctacgtgtccctggcccacgtgctgacccgctgggagatgcacaggacccagaccaagtttgaagatgccttcaccctgaaggtgttcatcttccagtttgtgaacttctacagcagccctgtgtacatcgccttcttcaagggccgctttgtgggctacccaggcaactaccacaccctgtttggagtgagaaatgaggagtgtgccgccggcggctgcctgattgagctggcccaggagctgctggtgatcatggtgggcaagcaggtgatcaacaacatgcaggaggtgctgatccccaagctgaagggctggtggcagaagttccggctgcggagcaagaagaggaaggccggggccagcgctggggccagccagggcccctgggaggatgattatgagctggtgccctgtgagggcctgtttgatgagtacctggagatggtgctgcagtttggatttgtgaccatctttgtggccgcctgccccctggcccccctgtttgccctgctgaacaactgggtggagatccggctggatgccaggaagtttgtgtgtgagtacagaagacctgtggccgagcgggcccaggacatcggcatctggttccacatcctggccggcctgacccacctggccgtcatcagcaatgccttcctgctggccttcagcagtgacttcctgccccgggcctactaccgctggacccgggcccatgacctgcggggcttcctgaacttcaccctggcccgggcccccagcagctttgctgctgcccacaacagaacctgccgctaccgggccttcagagatgatgatggccactacagccagacctactggaacctgctggccatccggctggcctttgtgattgtgtttgaacatgtggtgttttctgtgggccgcctgctggacctgctggtgcctgacatccctgagagcgtggagatcaaggtgaagcgggagtactacctggccaagcaggccctggccgagaatgaggtgctgtttggcaccaacggcaccaaggatgagcagcctgagggcagcgagctgagcagccactggacccccttcaccgtgcccaaggccagccagctgcagcagtag

SEQ ID NO: 32384 - DNA, 2652 bp, Artificial Sequence
  Description of Artificial Sequence: Synthetic coding sequence
atgaggatggccgccacagcctgggccggcctgcagggcccccccctgcccaccctgtgcccagctgtgaggacaggcctgtactgccgggaccaggcccatgctgagcgctgggccatgaccagcgagaccagcagcggcagccactgtgcccggagcaggatgctgcggcggcgggcccaggaggaggacagcacagtgctgattgatgtgtccccacctgaggccgagaagaggggcagctatggcagcacagcccacgccagcgagcccggcggccagcaggccgccgcctgcagagctggcagccctgccaagcccagaattgactttgtgctggtgtgggaggaggacctgaagctggaccggcagcaggacagcgctgcccgggacagaacagacatgcacaggacctggagggagaccttcctggacaacctgcgggccgccggcctgtgtgtggaccagcaggatgtgcaggacggcaacaccaccgtgcactacgccctgctgagcgcctcctgggccgtgctgtgctactatgcagaggacctgcggctgaagctgcccctgcaggagctgcccaaccaggccagcaactggagcgctggcctgctggcctggctgggcatccccaacgtgctgctggaggtggtgcctgatgtgcccccagagtactacagctgccgcttccgggtgaacaagctgccccgcttcctgggcagtgacaaccaggacaccttcttcaccagcaccaagaggcaccagatcctgtttgagatcctggccaagaccccctacggccacgagaagaagaacctgctgggcatccaccagctgctggccgagggcgtgctgtctgctgccttccccctgcatgatggccccttcaagaccccacctgagggcccccaggccccccggctgaaccagaggcaggtgctcttccagcactgggcccgctggggcaagtggaacaagtaccagcccctggaccacgtgcggcgctactttggagagaaggtggccctgtactttgcctggctgggcttctacacaggctggctgctgcctgctgctgtggtgggcaccctggtgttcctggtgggctgcttcctggtgttcagtgacatccccacccaggagctgtgtggcagcaaggacagctttgagatgtgccccctgtgcctggactgccccttctggctgctgagcagcgcctgtgccctggcccaggccggccgcctgtttgaccatggaggcaccgtcttcttcagcctcttcatggccctgtgggccgtgctgctgctggagtactggaagaggaagagcgccaccctggcctaccgctgggactgcagcgactatgaggacacagaggagcggccccggccccagtttgctgccagcgcccccatgacagcccccaaccccatcaccggggaggatgagccctacttccctgagaggagccgggcccggaggatgctggccggctctgtggtgattgtggtgatggtggccgtggtggtgatgtgcctggtgtccatcatcctgtaccgggccatcatggccatcgtggtgagccgcagcggcaacaccctgctggccgcctgggccagcagaattgccagcctgactggatctgtggtgaacctggtgttcatcctgatcctgagcaagatctacgtgtccctggcccacgtgctgacccgctgggagatgcacaggacccagaccaagtttgaagatgccttcaccctgaaggtgttcatcttccagtttgtgaacttctacagcagccctgtgtacatcgccttcttcaagggccgctttgtgggctacccaggcaactaccacaccctgtttggagtgagaaatgaagaatgtgccgccggcggctgcctgattgagctggcccaggagctgctggtgatcatggtgggcaagcaggtgatcaacaacatgcaggaggtgctgatccccaagctgaagggctggtggcagaagttccggctgcggagcaagaagaggaaggccggggccagcgctggggccagccagggcccctgggaggatgattatgagctggtgccctgtgagggcctgtttgatgagtacctggagatggtgctgcagtttggatttgtgaccatctttgtggccgcctgccccctggcccccctgtttgccctgctgaacaactgggtggagatccggctggatgccaggaagtttgtgtgtgagtacagaagacctgtggccgagcgggcccaggacatcggcatctggttccacatcctggccggcctgacccacctggccgtcatcagcaatgccttcctgctggccttcagcagtgacttcctgccccgggcctactaccgctggacccgggcccatgacctgcggggcttcctgaacttcaccctggcccgggcccccagcagctttgctgctgcccacaacagaacctgccgctaccgggccttcagagatgatgatggccactacagccagacctactggaacctgctggccatccggctggccttcgtcatcgtgtttgaggtggccgaggccccagctggcagccccatccacggcatgaggccccggccctgtgccctgcccaacagcagcacctggtag

SEQ ID NO: 32385 - DNA, 540 bp, Artificial Sequence
  Description of Artificial Sequence: Synthetic coding sequence
atgaggatggccgccacagcctgggccggcctgcagggcccccccctgcccaccctgtgcccagctgtgaggacaggcctgtactgccgggaccaggcccatgctgagcgctgggccatgaccagcgagaccagcagcggcagccactgtgcccggagcaggatgctgcggcggcgggcccaggaggaggacagcacagtgctgattgatgtgtccccacctgaggccgagaagaggggcagctatggcagcacagcccacgccagcgagcccggcggccagcaggccgccgcctgcagagctggcagccctgccaagcccagaattgactttgtgctggtgtgggaggaggacctgaagctggaccggcagcaggacagcgctgcccgggacagaacagacatgcacaggacctggagggagaccttcctggacaacctgcgggccgccggcctgtgtgtggaccaggtgcggggcggctgccacggccagggcccccggccctgcatccacagcgtgacccatgacctggccgcctag

SEQ ID NO: 32386 - DNA, 3699 bp, Artificial Sequence
  Description of Artificial Sequence: Synthetic coding sequence
atggccgaggccgccagcggggccggcggcaccagcctggagggggagcggggcaagaggcctcctcctgagggggagcctgctgccccagccagcggcgtgctggacaagctgtttgggaagaggctgctgcaggccggccgctacctggtgagccacaaggcctggatgaagacagtgcccacagagaactgtgatgtgctgatgaccttcccagacaccacagatgaccacaccctgctgtggctgctgaaccacatccgggtgggcatccctgagctgattgtgcaggtgcgccaccaccgccacacccgggcctatgccttctttgtgacagccacctatgagagcctgctgcggggagcagatgagctgggcctgaggaaggctgtgaaggccgagtttggaggcggcacccggggcttcagctgtgaggaggacttcatctatgaaaatgtggagagcgagctgcgcttcttcaccagccaggagcggcagagcatcatccgcttctggctgcagaacctgcgggccaagcagggcgaggccctgcacaacgtgcgcttcctggaggaccagcccatcatccctgagctggccgcccggggcatcatccagcaggtgtttcctgtgcatgagcagaggatcctgaaccggctgatgaagtcctgggtgcaggccgtgtgtgagaaccagcccctggatgacatctgtgactactttggagtgaagatcgccatgtactttgcctggctgggcttctacaccagcgccatggtgtacccagctgtgtttggatctgtgctgtacaccttcacagaagctgaccagaccagcagagatgtgtcctgtgtggtgtttgccctcttcaacgtcatctggagcaccctcttcctggaggagtggaagagaagaggagctgagctggcctacaagtggggcaccctggacagccctggagaggccgtggaggagccccggccccagttccggggcgtgcggcgcatcagccccatcaccagggctgaggagttctactacccaccctggaagaggctgctcttccagctgctggtgtccctgcccctgtgcctggcctgcctggtgtgtgtgttcctgctgatgctgggctgcttccagctgcaggagctggtgctgtctgtgaagggcctgccccggctggcccgcttcctgcccaaggtgatgctggccctgctggtgtctgtgtctgctgagggctacaagaagctggccatctggctgaatgacatggagaactaccgcctggagagcgcctatgagaagcacctgatcatcaaggtggtgctcttccagtttgtgaacagctacctgagcctcttctacatcggcttctacctgaaggacatggagcggctgaaggagatgctggccaccctgctgatcacccggcagttcctgcagaatgtgcgggaggtgctgcagccccacctgtacagaaggctgggccgcggggagctgggcctgcgggctgtgtgggagctggcccgggccctgctgggcctgctgagcctgcggcggcctgccccccggcggctggagccccaggctgatgaaggaggcggcggcggcagcggcggcggcggccgccgctgcctgagcggcggctgtggggcccctgaggaggaggaggaggccgccctggtggagaggagaagagctggggagggcggggaggagggagatggccccccaggcggcaaggaggaggatgaagatgatgaggaggaggaggatgaggaggaggaggaggatgaggaggagggggaggagggcggcctgctggactgtggcctgcggctgaagaaggtgtcctttgctgagcggggggccggcagaagaagacctggccccagccctgaggccctgctggaggagggcagccccaccatggtggagaagggcctggagcccggggtcttcaccctggccgaggaggatgatgaagctgagggcgcccctggcagccctgagcgggagcccccagccatcctcttccggcgggccggcggggagggccgggaccagggcccagatggcggccctgaccctgagcccggcagcaacagcgacagcacccggcggcagaggcggcagaacagaagctcctggattgaccccccagaggaggagcacagcccccagctgacccaggccgagctggagagctgcatgaagaagtatgaggacaccttccaggactaccaggagatgtttgtgcagtttggctacgtggtgctcttcagcagcgccttccccctggccgccctgtgtgccctggtgaacaacctgattgagatccgcagtgatgccttcaagctgtgcaccggcctgcagaggcccttcggccagagggtggagagcatcggccagtggcagaaggtgatggaggccatgggcgtgctggccatcgtggtgaactgctacctgattggccagtgtggccagctgcagaggctcttcccctggctgagccctgaggccgccatcgtgtctgtggtggtgctggagcactttgccctgctgctgaagtacctgattcatgtggccatcccagacatccctggctgggtggccgaggagatggccaagctggagtaccagaggcgggaggccttcaagagacatgagcggcaggcccagcaccgctaccagcagcagcagaggagaagaagagaggaggaggagcggcagagacatgctgagcaccacgcccggcgggagcatgacagcggcggccgggaggaggcccgggcagagggcagcggcctggaccctgccaccagcagcgagaaggccagcgccaaggccaagggcagcacagctgggggccacggccctgagcggcccaagaggcctggcagcctgctggcccccaacaacgtgatgaagctgaagcagatcatccccctgcagggcaagttcctgagcagcggggccaccagcagcctggccgccgccggggccggggccaccacccggcccccaccagcccagagccccactggaagtgacacccggctgcctgccttcctgtccttcaagttcctgaagagccctgagacccggcgggacagcgagaggagccacagcccccccaaggccttccacgccggcaagctgttcccctttggaggcaccagggctgagcccggcagcaatggagctgggggccaggcccggccagatggcacccccagcagcggcagcagccgggtgcagaggagcggccctgtggatgaggccctggccgaggagctggaggcccccaggcctgaggaggagggcagcggcacagccctggcccctgtgggcgccccagccctgcggaccaggaggagccgcagccctgcccctcctccacccatgcccctgcccaggcctcccaccccacctgctggctgctggcagtgggatggcccctggggctgcggcggggagggcgccgccccccggcaggccctggccgctgctgagtgccccccctgtgccatggccggccccccaccagccccccagcccctgcctggagatgccagcttctacagcctgcccccaccacccctgccccccaccagtgaccccctggagaccccagcccccagccccagccccagccccagcccccaggccgtgtgctggcccagcggctggcactag

SEQ ID NO: 32387 - DNA, 2349 bp, Artificial Sequence
  Description of Artificial Sequence: Synthetic coding sequence
atgcagggcgaggagagcctgcgcatcctggtggagcctgagggggacagcttccccctgatggagatcagcacctgtgaaacagaggccagcgagcagtgggactatgtgctggtggcccagaggcacacccagagggacccccggcaggcccggcagcagcagttcctggaggagctgcggaggaagggcttccacatcaaggtgatccgggaccagaagcaggtgttcttcggcatccgggctgacaacagcgtgtttggcctgtaccgcaccttcctgctggagcctgagggccctgcccctcatgctgagctggccgcccccaccaccatccctgtgaccaccagcctgcgcatccgcatcgtgaactttgtggtgatgaacaacaagaccagcgctggggagacctttgaggacctgatgaaggatggagtgtttgaggcccgcttccccctgcacaagggggagggccgcctgaagaagacctgggcccgctggaggcacatgttccgggagcagcctgtggatgagatccggaactactttggagagaaggtggccctgtactttgtgtggctgggctggtacacctacatgctggtgcctgctgccctgaccggcctgctggtgttcctgagcggcttcagcctgtttgaggccagccagatcagcaaggagatctgtgaggcccatgacatcctgatgtgccccctgggggaccacagccgccgctaccagaggctgtctgagacctgcacctttgccaagctgacccacctgtttgacaatgatggcaccgtggtgtttgccatcttcatggccctgtgggccaccgtcttcctggagatctggaagaggcagagggcccgggtggtgctgcactgggacctgtatgtgtgggatgaggagcaggaggagatggccctgcagctgatcaactgcccagactacaagctgcggccctaccagcacagctacctgcggagcaccgtcatcctggtgctgaccctgctgatgatctgcctgatgattggcatggcccacgtgctggtggtgtacagagtgctggccagcgccctcttcagcagcagcgctgtgcccttcctggaggagcaggtgaccacagctgtggtggtgactggagccctggtgcactacgtgaccatcatcatcatgaccaagatcaacagatgtgtggccctgaagctgtgtgactttgagatgcccaggaccttcagcgagcgggagagccgcttcaccatccgcttcttcaccctgcagttcttcacccacttcagcagcctcatctacatcgccttcatcctgggccgcatcaatggccaccctgggaagagcacccggctggccggcctgtggaagctggaggagtgccacgccagcggctgcatgatggacctgtttgtgcagatggccatcatcatgggcctgaagcagaccctgagcaactgtgtggagtacctggtgccctgggtgacccacaagtgccgcagcctgcgggccagcgagagcggccacctgccccgggaccctgagctgcgggactggaggaggaactacctgctgaaccctgtgaacaccttcagcctgtttgatgagttcatggagatgatgatccagtatggcttcaccaccatctttgtggccgccttccccctggcccccctgctggccctcttcagcaacctggtggagatccggctggatgccatcaagatggtgtggctgcagaggcggctggtgcccaggaaggccaaggacatcggcacctggctgcaggtgctggagaccatcggcgtgctggccgtgattgccaacggcatggtgattgccttcaccagcgagttcatcccccgggtggtgtacaagtaccgctacagcccctgcctgaaggagggcaacagcacagtggactgcctgaagggctacgtgaaccacagcctgagcgtcttccacaccaaggacttccaggaccctgatggcatcgagggctctgaaaatgtgaccctgtgccgctacagagactacagaaaccccccagactacaacttcagcgagcagttctggttcctgctggccatccggctggcctttgtgatcctgtttgaacatgtggccctgtgcatcaagctgattgctgcctggtttgtgcctgacatcccccagagcgtgaagaacaaggtgctggaggtgaagtaccagaggctgcgggagaagatgtggcacggccggcagaggctgggcggcgtgggcgccggcagcaggcctcccatgcctgcccaccccaccccagccagcatcttcagcgcccggagcacagatgtgtag

SEQ ID NO: 32388 - DNA, 2592 bp, Artificial Sequence
  Description of Artificial Sequence: Synthetic coding sequence
atgaagaagttctttgacagccggcgggagcagggcggcagcggcctgggcagcggcagcagcggcggcggcggcagcaccagcggcctgggcagcggctacatcggccgggtgtttggaattggccggcagcaggtgacagtggatgaggtgctggccgagggcggctttgccatcgtgttcctggtgaggaccagcaatggcatgaagtgtgccctgaagaggatgtttgtgaacaatgaacatgacctgcaggtgtgcaagcgggagatccagatcatgagggacctgagcggccacaagaacatcgtgggctacatcgacagcagcatcaacaacgtgtcctctggagatgtgtgggaggtgctgatcctgatggacttctgccggggcggccaggtggtgaacctgatgaaccagaggctgcagacaggcttcacagaaaatgaggtgctgcagatcttctgtgacacctgtgaggccgtggcccggctgcaccagtgcaagacccccatcatccaccgggacctgaaggtggagaacatcctgctgcatgaccggggccactacgtgctgtgtgactttggaagtgccaccaacaagttccagaacccccagacagaaggagtgaatgctgtggaggatgagatcaagaagtacaccaccctgagctaccgggcccctgagatggtgaacctgtacagcggcaagatcatcaccaccaaggctgacatctgggccctgggctgcctgctgtacaagctgtgctacttcaccctgccctttggagagagccaggtggccatctgtgatggcaacttcaccatcccagacaacagccgctacagccaggacatgcactgcctgatccgctacatgctggagccagaccctgacaagaggccagacatctaccaggtgtcctacttctccttcaagctgctgaagaaggagtgccccatccccaacgtgcagaacagccccatcccagccaagctgcctgagcctgtgaaggccagcgaggccgccgccaagaagacccagcccaaggcccggctgacagaccccatccccaccacagagaccagcatcgccccccggcagaggcccaaggccggccagacccagcccaaccctggcatcctgcccatccagcctgccctgacccccaggaagagggccaccgtgcagcccccaccccaggccgccggcagcagcaaccagcccggcctgctggcctctgtgccccagcccaagccccaggccccacccagccagcccctgccccagacccaggccaagcagccccaggccccacccaccccccagcagacccccagcacccaggcccagggcctgcctgcccaggcccaggccaccccccagcaccagcagcagctgttcctgaagcagcagcagcagcagcagcagcccccaccagcccagcagcagcctgctggcaccttctaccagcagcagcaggcccagacccagcagttccaggccgtgcacccagccacccagaagccagccatcgcccagtttcctgtggtgtcccagggcggcagccagcagcagctgatgcagaacttctaccagcagcagcagcagcagcagcagcagcagcagcagcagcagctggccacagccctgcaccagcagcagctgatgacccagcaggccgccctgcagcagaagcccaccatggctgctggccagcagccccagccccagcctgctgctgccccccagcctgccccagcccaggagcccgccatccaggcccctgtgcggcagcagcccaaggtgcagaccaccccacctcctgctgtgcagggccagaaggtgggcagcctgaccccacccagcagccccaagacccagagagctggccaccggcgcatcctgagtgatgtgacccacagcgctgtgtttggagtgcctgccagcaagagcacccagctgctgcaggccgctgctgctgaggccagcctgaacaagagcaagagcgccaccaccacccccagcggcagccccaggaccagccagcagaatgtgtacaaccccagcgagggcagcacctggaacccctttgatgatgacaacttcagcaagctgacagctgaggagctgctgaacaaggactttgccaagctgggggagggcaagcaccctgagaagctgggcggcagcgctgagagcctcatccctggcttccagagcacccagggagatgcctttgccaccaccagcttctctgctggaacagctgagaagaggaaaggaggccagacagtggacagcggcctgcccctgctgtctgtgtctgaccccttcatccccctgcaggtgcctgatgcccctgagaagctgattgagggcctgaagagcccagacaccagcctgctgctgcctgacctgctgcccatgacagaccccttcggcagcaccagtgatgctgtgattggcaaggtgatcatctctgtgtcctctgtgatgcatgacatgtgtgcctgcttcaagaatgacaagtacctggtgaaccagagcctgggcaacagccctgccaccccagaggccaaggccatctag

SEQ ID NO: 32389 - DNA, 2886 bp, Artificial Sequence
  Description of Artificial Sequence: Synthetic coding sequence
atgaagaagttctttgacagccggcgggagcagggcggcagcggcctgggcagcggcagcagcggcggcggcggcagcaccagcggcctgggcagcggctacatcggccgggtgtttggaattggccggcagcaggtgacagtggatgaggtgctggccgagggcggctttgccatcgtgttcctggtgaggaccagcaatggcatgaagtgtgccctgaagaggatgtttgtgaacaatgaacatgacctgcaggtgtgcaagcgggagatccagatcatgagggacctgagcggccacaagaacatcgtgggctacatcgacagcagcatcaacaacgtgtcctctggagatgtgtgggaggtgctgatcctgatggacttctgccggggcggccaggtggtgaacctgatgaaccagaggctgcagacaggcttcacagaaaatgaggtgctgcagatcttctgtgacacctgtgaggccgtggcccggctgcaccagtgcaagacccccatcatccaccgggacctgaaggtggagaacatcctgctgcatgaccggggccactacgtgctgtgtgactttggaagtgccaccaacaagttccagaacccccagacagaaggagtgaatgctgtggaggatgagatcaagaagtacaccaccctgagctaccgggcccctgagatggtgaacctgtacagcggcaagatcatcaccaccaaggctgacatctgggccctgggctgcctgctgtacaagctgtgctacttcaccctgccctttggagagagccaggtggccatctgtgatggcaacttcaccatcccagacaacagccgctacagccaggacatgcactgcctgatccgctacatgctggagccagaccctgacaagaggccagacatctaccaggtgtcctacttctccttcaagctgctgaagaaggagtgccccatccccaacgtgcagaacagccccatcccagccaagctgcctgagcctgtgaaggccagcgaggccgccgccaagaagacccagcccaaggcccggctgacagaccccatccccaccacagagaccagcatcgccccccggcagaggcccaaggccggccagacccagcccaaccctggcatcctgcccatccagcctgccctgacccccaggaagagggccaccgtgcagcccccaccccaggccgccggcagcagcaaccagcccggcctgctggcctctgtgccccagcccaagccccaggccccacccagccagcccctgccccagacccaggccaagcagccccaggccccacccaccccccagcagacccccagcacccaggcccagggcctgcctgcccaggcccaggccaccccccagcaccagcagcagctgttcctgaagcagcagcagcagcagcagcagcccccaccagcccagcagcagcctgctggcaccttctaccagcagcagcaggcccagacccagcagttccaggccgtgcacccagccacccagaagccagccatcgcccagtttcctgtggtgtcccagggcggcagccagcagcagctgatgcagaacttctaccagcagcagcagcagcagcagcagcagcagcagcagcagcagctggccacagccctgcaccagcagcagctgatgacccagcaggccgccctgcagcagaagcccaccatggctgctggccagcagccccagccccagcctgctgctgccccccagcctgccccagcccaggagcccgccatccaggcccctgtgcggcagcagcccaaggtgcagaccaccccacctcctgctgtgcagggccagaaggtgggcagcctgaccccacccagcagccccaagacccagagagctggccaccggcgcatcctgagtgatgtgacccacagcgctgtgtttggagtgcctgccagcaagagcacccagctgctgcaggccgctgctgctgaggccagcctgaacaagagcaagagcgccaccaccacccccagcggcagccccaggaccagccagcagaatgtgtacaaccccagcgagggcagcacctggaacccctttgatgatgacaacttcagcaagctgacagctgaggagctgctgaacaaggactttgccaagctgggggagggcaagcaccctgagaagctgggcggcagcgctgagagcctcatccctggcttccagagcacccagggagatgcctttgccaccaccagcttctctgctggaacagctgagaagaggaaaggaggccagacagtggacagcggcctgcccctgctgtctgtgtctgaccccttcatccccctgcaggtgcctgatgcccctgagaagctgattgagggcctgaagagcccagacaccagcctgctgctgcctgacctgctgcccatgacagaccccttcggcagcaccagtgatgctgtgattgagaaggcagatgtggccgtggagagcctcatccctggcctggagccccctgtgccccagaggctgcccagccagacagagagcgtgaccagcaacagaacagacagcctgaccggggaggacagcctgctggactgcagcctgctgagcaaccccaccacagacctgctggaggagtttgcccccacagccatcagcgcccctgtgcacaaggctgctgaggacagcaacctgatcagcggctttgatgtgcctgagggcagtgacaaggtggctgaagatgaatttgaccccatccctgtgctgatcaccaagaacccccagggcggccacagcaggaacagcagcggcagcagcgagagcagcctgcccaacctggcccggagcctgctgctggtggaccagctgattgacctgtag

SEQ ID NO: 32390 - DNA, 1143 bp, Artificial Sequence
  Description of Artificial Sequence: Synthetic coding sequence
atggaggagggcggggactttgacaactactatggagctgacaaccagagtgaatgtgagtacacagactggaagagcagcggggccctgatcccagccatctacatgctggtgttcctgctgggcaccactggaaatggcctggtgctgtggacagtgttccgcagcagccgggagaagagaagatctgctgacatcttcatcgccagcctggccgtggccgacctgacctttgtggtgaccctgcccctgtgggccacctacacctacagagattatgactggcccttcggcaccttcttctgcaagctgagcagctacctgatctttgtgaacatgtatgccagcgtcttctgcctgaccggcctgagctttgaccgctacctggccatcgtgcggcctgtggccaatgcccggctgcggctgcgggtgtctggagctgtggccacagctgtgctgtgggtgctggccgccctgctggccatgcctgtgatggtgctgcggaccaccggggacctggagaacaccaccaaggtgcagtgctacatggactacagcatggtggccaccgtgtcctctgagtgggcctgggaggtgggcctgggcgtgagcagcaccaccgtgggctttgtggtgcccttcaccatcatgctgacctgctacttcttcatcgcccagaccatcgccggccacttcaggaaggagagaattgagggcctgaggaagagaagaaggctgctgagcatcatcgtggtgctggtggtgacctttgccctgtgctggatgccctaccacctggtgaagaccctgtacatgctgggcagcctgctgcactggccctgtgactttgacctcttcctgatgaacatcttcccctactgcacctgcatctcctatgtgaacagctgcctgaaccccttcctgtatgccttctttgacccccgcttccggcaggcctgcacctccatgctgtgctgcggccagagccgctgtgccggcaccagccacagcagcagtggagagaagagcgccagctacagcagcggccacagccagggccctggccccaacatgggcaagggcggggagcagatgcatgagaagagcatcccctacagccaggagaccctggtggtggactag

SEQ ID NO: 32391 - DNA, 786 bp, Artificial Sequence
  Description of Artificial Sequence: Synthetic coding sequence
atggaggagggcggggactttgacaactactatggagctgacaaccagagtgaatgtgagtacacagactggaagagcagcggggccctgatcccagccatctacatgctggtgttcctgctggccatgcctgtgatggtgctgcggaccactggagacctggagaacaccaccaaggtgcagtgctacatggactacagcatggtggccaccgtgagcagcgagtgggcctgggaggtgggcctgggcgtgagcagcaccaccgtgggctttgtggtgcccttcaccatcatgctgacctgctacttcttcatcgcccagaccatcgccggccacttcaggaaggagcgcatcgagggcctgaggaagagaagaaggctgctgagcatcatcgtggtgctggtggtgacctttgccctgtgctggatgccctaccacctggtgaagaccctgtacatgctgggcagcctgctgcactggccctgtgactttgacctcttcctgatgaacatcttcccctactgcacctgcatctcctatgtgaacagctgcctgaaccccttcctgtatgccttctttgacccccgcttccggcaggcctgcacctccatgctgtgctgcggccagagccgctgtgccggcaccagccacagcagcagcggggagaagagcgccagctacagcagcggccacagccagggccctggccccaacatgggcaaaggaggagagcagatgcatgagaagagcatcccctacagccaggagaccctggtggtggactag

SEQ ID NO: 32392 - DNA, 900 bp, Artificial Sequence
  Description of Artificial Sequence: Synthetic coding sequence
atgctggtgttcctgctgggcaccactggaaatggcctggtgctgtggacagtgttccgcagcagccgggagaagagaagatctgctgacatcttcatcgccagcctggccgtggccgacctgacctttgtggtgaccctgcccctgtgggccacctacacctacagagattatgactggcccttcggcaccttcttctgcaagctgagcagctacctgatctttgtgaacatgtatgccatgcctgtgatggtgctgcggaccactggagacctggagaacaccaccaaggtgcagtgctacatggactacagcatggtggccaccgtgagcagcgagtgggcctgggaggtgggcctgggcgtgagcagcaccaccgtgggctttgtggtgcccttcaccatcatgctgacctgctacttcttcatcgcccagaccatcgccggccacttcaggaaggagcgcatcgagggcctgaggaagagaagaaggctgctgagcatcatcgtggtgctggtggtgacctttgccctgtgctggatgccctaccacctggtgaagaccctgtacatgctgggcagcctgctgcactggccctgtgactttgacctcttcctgatgaacatcttcccctactgcacctgcatctcctatgtgaacagctgcctgaaccccttcctgtatgccttctttgacccccgcttccggcaggcctgcacctccatgctgtgctgcggccagagccgctgtgccggcaccagccacagcagcagcggggagaagagcgccagctacagcagcggccacagccagggccctggccccaacatgggcaaaggaggagagcagatgcatgagaagagcatcccctacagccaggagaccctggtggtggactag

SEQ ID NO: 32393 - DNA, 621 bp, Artificial Sequence
  Description of Artificial Sequence: Synthetic coding sequence
atgctgccctgtgccgccggggcccggggccgcggggccatggtggtgctgcgggccggcaagaagaccttcctgccccccctgtgccgggcctttgcctgccggggctgccagctggcccctgagagaggagctgagcggcgggacacagcccccagcggcgtgagccgcttctgcccccccaggaagagctgccacgactggattggccccccagacaagtacagcaacctgcggcctgtgcacttctacatcccagaaaatgaaagccccctggagcagaagctgaggaagctgcggcaggagacccaggagtggaaccagcagttctgggccaaccagaacctgaccttcagcaaggagaaggaggagttcatccacagccggctgaagaccaagggcctgggcctgaggacagaaagtggccagaaggccaccctgaatgctgaggagatggctgacttctacaaggagttcctgagcaagaacttccagaagcacatgtactacaacagagactggtacaagaggaactttgccatcaccttcttcatgggcaaggtggccctggagcgcatctggaacaagctgaagcagaagcagaagaagaggagcaactag

SEQ ID NO: 32394 - DNA, 1122 bp, Artificial Sequence
  Description of Artificial Sequence: Synthetic coding sequence
atgggcagccaggtgtctgtggagagcggggccctgcacgtggtgattgtgggcggcggctttggaggcattgctgctgccagccagctgcaggccctgaatgtgcccttcatgctggtggacatgaaggacagcttccaccacaacgtggccgccctgcgggcctctgtggagactggatttgccaagaagaccttcatctcctacagcgtgaccttcaaggacaacttccggcagggcctggtggtgggcatcgacctgaagaaccagatggtgctgctgcagggcggggaggccctgcccttcagccacctgatcctggccaccggcagcacaggccccttccctgggaagttcaatgaggtgagcagccagcaggccgccatccaggcctatgaggacatggtgcggcaggtgcagaggagccgcttcatcgtggtggtgggcggcggcagcgctggggtggagatggctgctgagatcaagacagagtacccagagaaggaggtgaccctcatccacagccaggtggccctggccgacaaggagctgctgcccagcgtgcggcaggaggtgaaggagatcctgctgaggaaaggagtgcagctgctgctgtctgagcgggtgagcaacctggaggagctgcccctgaatgagtaccgggagtacatcaaggtgcagacagacaagggcacagaggtggccaccaacctggtgatcctgtgcaccggcatcaagatcaacagcagcgcctacaggaaggcctttgagagccggctggccagcagcggggccctgcgggtgaatgagcacctgcaggtggagggccacagcaatgtgtatgccatcggggactgtgctgatgtgaggacccccaagatggcctacctggccggcctgcacgccaacattgctgtggccaacatcgtgaacagcgtgaagcagaggcccctgcaggcctacaagccaggggccctgaccttcctgctgtccatgggcagaaatgatggagtgggccagatcagcggcttctacgtgggccgcctgatggtgcggctgaccaagagccgggacctgtttgtgtccacctcctggaagaccatgaggcagagccccccatag

SEQ ID NO: 32395 - DNA, 1122 bp, Artificial Sequence; identical to SEQ ID NO: 32394
  Description of Artificial Sequence: Synthetic coding sequence

SEQ ID NO: 32396 - DNA, 1011 bp, Artificial Sequence
  Description of Artificial Sequence: Synthetic coding sequence
atgggcagccaggtgtctgtggagagcggggccctgcacgtggtgattgtgggcggcggctttggaggcattgctgctgccagccagctgcaggccctgaatgtgcccttcatgctggtggacatgaaggacagcttccaccacaacgtggccgccctgcgggcctctgtggagactggatttgccaagaagaccttcatctcctacagcgtgaccttcaaggacaacttccggcagggcctggtggtgggcatcgacctgaagaaccagatggtgctgctgcagggcggggaggtgcagaggagccgcttcatcgtggtggtgggcggcggcagcgctggggtggagatggctgctgagatcaagacagagtacccagagaaggaggtgaccctcatccacagccaggtggccctggccgacaaggagctgctgcccagcgtgcggcaggaggtgaaggagatcctgctgaggaaaggagtgcagctgctgctgaccctgctgggggagcgggtgagcaacctggaggagctgcccctgaatgagtaccgggagtacatcaaggtgcagacagacaagggcacagaggtggccaccaacctggtgatcctgtgcaccggcatcaagatcaacagcagcgcctacaggaaggcctttgagagccggctggccagcagcggggccctgcgggtgaatgagcacctgcaggtggagggccacagcaatgtgtatgccatcggggactgtgctgatgtgaggacccccaagatggcctacctggccggcctgcacgccaacattgctgtggccaacatcgtgaacagcgtgaagcagaggcccctgcaggcctacaagccaggggccctgaccttcctgctgtccatgggcagaaatgatggagtgggccagatcagcggcttctacgtgggccgcctgatggtgcggctgaccaagagccgggacctgtttgtgtccacctcctggaagaccatgaggcagagccccccatag

SEQ ID NO: 32397 - DNA, 906 bp, Artificial Sequence
  Description of Artificial Sequence: Synthetic coding sequence
atggtgttcacccaggccccagctgagatcatgggccacctgcgcatccgcagcctgctggcccggcagtgcctggccgagttcctgggcgtgtttgtgctgatgctgctgacccagggcgctgtggcccaggccgtgaccagcggggagaccaagggcaacttcttcaccatgttcctggccggcagcctggccgtgaccatcgccatctacgtgggcggcaatgtgtctggggcccacctgaacccagccttcagcctggccatgtgcatcgtgggccgcctgccctgggtgaagctgcccatctacatcctggtgcagctgctgagcgccttctgtgccagcggggccacctacgtgctgtaccatgatgccctgcagaactacacaggaggcaacctgactgtgacaggccccaaggagacagccagcatctttgccacctacccagccccctacctgagcctgaacaacggcttcctggaccaggtgctgggcaccggcatgctgattgtgggcctgctggccatcctggacagaagaaataaaggagtgcctgctggcctggagcctgtggtggtgggcatgctgatcctggccctgggcctgtccatgggcgccaactgtggcatccccctgaacccagcccgggacctgggccccaggctcttcacctacgtggccggctggggccctgaggtgttttctgctggaaatggctggtggtgggtgcctgtggtggcccccctggtgggcgccaccgtgggcacagccacctaccagctgctggtggccctgcaccaccctgagggccctgagcccgcccaggacctggtgtctgcccagcacaaggccagcgagctggagaccccagccagcgcccagatgctggagtgcaagctgtag

SEQ ID NO: 32398 - DNA, 795 bp, Artificial Sequence
  Description of Artificial Sequence: Synthetic coding sequence
atggtgttcacccaggccccagctgagatcatgggccacctgcgcatccgcagcctgctggcccggcagtgcctggccgagttcctgggcgtgtttgtgctgatgctgctgacccagggcgctgtggcccaggccgtgaccagcggggagaccaagggcaacttcttcaccatgttcctggccggcagcctggccgtgaccatcgccatctacgtgggcggcaatgtgtctggggcccacctgaacccagccttcagcctggccatgtgcatcgtgggccgcctgccctgggtgaagctgcccatctacatcctggtgcagctgctgagcgccttctgtgccagcggggccacctacgtgctgtaccatgatgccctgcagaactacacaggaggcaacctgactgtgacaggccccaaggagacagccagcatctttgccacctacccagccccctacctgagcctgaacaacggcttcctggaccaggtgctgggcaccggcatgctgattgtgggcctgctggccatcctggacagaagaaataaaggagtgcctgctggcctggagcctgtggtggtgggcatgctgatcctggccctgggcctgtccatgggcgccaactgtggcatccccctgaacccagcccgggacctgggccccaggctcttcacctacgtggccggctggggccctgaggtgttccgctgggagacagacagccctggggccggcctgcacagccccagcagcgccaagggctctgtgcccggcagcacagccctgtgcctgtag

SEQ ID NO: 32399 - DNA, 1125 bp, Artificial Sequence
  Description of Artificial Sequence: Synthetic coding sequence
atggccaaggagcggcggcgggctgtgctggagctgctgcagaggcctggaaatgcccgctgtgccgactgtggggccccagaccctgactgggccagctacaccctgggcgtcttcatctgcctgagctgcagcggcatccacaggaacatcccccaggtgtccaaggtgaagtctgtgcggctggatgcctgggaggaggcccaggtggagttcatggccagccacggcaatgatgctgcccgggccaggtttgagagcaaggtgcccagcttctactaccggcccacccccagcgactgccagctgctgcgggagcagtggatccgggccaagtatgagcggcaggagttcatctacccagagaagcaggagccctacagcgctggctaccgggagggcttcctgtggaagaggggccgggacaatggccagttcctgagcaggaagtttgtgctgacagagcgggagggcgccctgaagtacttcaacagaaatgatgccaaggagcccaaggctgtgatgaagattgagcacctgaatgccaccttccagcctgccaagattggccacccccacggcctgcaggtgacctacctgaaggacaacagcaccaggaacatcttcatctaccatgaagatggcaaggagatcgtggactggttcaatgccctgcgggccgcccgcttccactacctgcaggtggccttccctggagctggagatgctgacctggtgcccaagctgagcaggaactacctgaaggagggctacatggagaagacaggccccaagcagacagagggcttcaggaagcgctggttcaccatggatgaccggcggctgatgtacttcaaggaccccctggatgcctttgcccggggggaggtgttcatcggcagcaaggagagcggctacacagtgctgcacggcttcccccccagcacccagggccaccactggccccacggcatcaccatcgtgaccccagacaggaagttcctgtttgcctgtgaaacagaaagtgaccagcgggagtgggtggccgccttccagaaggctgtggaccggcccatgctgccccaggagtatgctgtggaggcccacttcaagcacaagccctag

SEQ ID NO: 32400 - DNA, 909 bp, Artificial Sequence
  Description of Artificial Sequence: Synthetic coding sequence
atggccagccacggcaatgatgctgcccgggccaggtttgagagcaaggtgcccagcttctactaccggcccacccccagcgactgccagctgctgcgggagcagtggatccgggccaagtatgagcggcaggagttcatctacccagagaagcaggagccctacagcgctggctaccgggagggcttcctgtggaagaggggccgggacaatggccagttcctgagcaggaagtttgtgctgacagagcgggagggcgccctgaagtacttcaacagaaatgatgccaaggagcccaaggctgtgatgaagattgagcacctgaatgccaccttccagcctgccaagattggccacccccacggcctgcaggtgacctacctgaaggacaacagcaccaggaacatcttcatctaccatgaagatggcaaggagatcgtggactggttcaatgccctgcgggccgcccgcttccactacctgcaggtggccttccctggagctggagatgctgacctggtgcccaagctgagcaggaactacctgaaggagggctacatggagaagacaggccccaagcagacagagggcttcaggaagcgctggttcaccatggatgaccggcggctgatgtacttcaaggaccccctggatgcctttgcccggggggaggtgttcatcggcagcaaggagagcggctacacagtgctgcacggcttcccccccagcacccagggccaccactggccccacggcatcaccatcgtgaccccagacaggaagttcctgtttgcctgtgaaacagaaagtgaccagcgggagtgggtggccgccttccagaaggctgtggaccggcccatgctgccccaggagtatgctgtggaggcccacttcaagcacaagccctag

SEQ ID NO: 32401 - DNA, 603 bp, Artificial Sequence
  Description of Artificial Sequence: Synthetic coding sequence
atgaagattgagcacctgaatgccaccttccagcctgccaagattggccacccccacggcctgcaggtgacctacctgaaggacaacagcaccaggaacatcttcatctaccatgaagatggcaaggagatcgtggactggttcaatgccctgcgggccgcccgcttccactacctgcaggtggccttccctggagctggagatgctgacctggtgcccaagctgagcaggaactacctgaaggagggctacatggagaagacaggccccaagcagacagagggcttcaggaagcgctggttcaccatggatgaccggcggctgatgtacttcaaggaccccctggatgcctttgcccggggggaggtgttcatcggcagcaaggagagcggctacacagtgctgcacggcttcccccccagcacccagggccaccactggccccacggcatcaccatcgtgaccccagacaggaagttcctgtttgcctgtgaaacagaaagtgaccagcgggagtgggtggccgccttccagaaggctgtggaccggcccatgctgccccaggagtatgctgtggaggcccacttcaagcacaagccctag

SEQ ID NO: 32402 - DNA, 783 bp, Artificial Sequence
  Description of Artificial Sequence: Synthetic coding sequence
atggtgctggccagcctggagctgctgcgggagcagtggatccgggccaagtatgaaaggcaggagttcatctacccagagaagcaggagccctacagcgctggctaccgggagggcttcctgtggaagaggggccgggacaatggccagttcctgagcaggaagtttgtgctgacagagcgggagggcgccctgaagtacttcaacagaaatgatgccaagattggccacccccacggcctgcaggtgacctacctgaaggacaacagcaccaggaacatcttcatctaccatgaagatggcaaggagatcgtggactggttcaatgccctgcgggccgcccgcttccactacctgcaggtggccttccctggagctggagatgctgacctggtgcccaagctgagcaggaactacctgaaggagggctacatggagaagacaggccccaagcagacagagggcttcaggaagcgctggttcaccatggatgaccggcggctgatgtacttcaaggaccccctggatgcctttgcccggggggaggtgttcatcggcagcaaggagagcggctacacagtgctgcacggcttcccccccagcacccagggccaccactggccccacggcatcaccatcgtgaccccagacaggaagttcctgtttgcctgtgaaacagaaagtgaccagcgggagtgggtggccgccttccagaaggctgtggaccggcccatgctgccccaggagtatgctgtggaggcccacttcaagcacaagccctag

SEQ ID NO: 32403 - DNA, 1158 bp, Artificial Sequence
  Description of Artificial Sequence: Synthetic coding sequence
atgttccagtttgtgttcagccgggtgtactgcatcaacccagcccggaggaagtggaaggagtttgagaagatgctgggctgtgccgaggagggccacgccagcctgggccgggaccctgactgggccagctacaccctgggcgtcttcatctgcctgagctgcagcggcatccacaggaacatcccccaggtgtccaaggtgaagtctgtgcggctggatgcctgggaggaggcccaggtggagttcatggccagccatggaaatgatgctgcccgggccaggtttgagagcaaggtgcccagcttctactaccggcccacccccagcgactgccagctgctgcgggagcagtggatccgggccaagtatgaaaggcaggagttcatctacccagagaagcaggagccctacagcgctggctaccgggagggcttcctgtggaagaggggccgggacaatggccagttcctgagcaggaagtttgtgctgacagagcgggagggcgccctgaagtacttcaacagaaatgatgccaaggagcccaaggctgtgatgaagattgagcacctgaatgccaccttccagcctgccaagattggccacccccacggcctgcaggtgacctacctgaaggacaacagcaccaggaacatcttcatctaccatgaagatggcaaggagatcgtggactggttcaatgccctgcgggccgcccgcttccactacctgcaggtggccttccctggagctggagatgctgacctggtgcccaagctgagcaggaactacctgaaggagggctacatggagaagacaggccccaagcagacagagggcttcaggaagcgctggttcaccatggatgaccggcggctgatgtacttcaaggaccccctggatgcctttgcccggggggaggtgttcatcggcagcaaggagagcggctacacagtgctgcacggcttcccccccagcacccagggccaccactggccccacggcatcaccatcgtgaccccagacaggaagttcctgtttgcctgtgaaacagaaagtgaccagcgggagtgggtggccgccttccagaaggctgtggaccggcccatgctgccccaggagtatgctgtggaggcccacttcaagcacaagccctag

SEQ ID NO: 32404 - DNA, 1146 bp, Artificial Sequence
  Description of Artificial Sequence: Synthetic coding sequence
atgggagaccgggagaggaacaagaagaggctgctggagctgctgcgggccccagacacaggaaatgcccactgtgccgactgtggggctgctgaccctgactgggccagctacaagctgggcatcttcatctgcctgaactgctgcggcgtgcacaggaacttcccagacatcagccgggtgaagtctgtgcggctggacttctgggatgacagcatcgtggagttcatgatccacaacggcaacctgcgggtgaaggccaagtttgaggcccgggtgcctgccttctactacatcccccaggccaatgactgcctggtgctgaaggagcagtggatccgggccaagtatgaaagaagagagttcatggctgatggagagaccatcagcctgcccggcaaccgggagggcttcctgtggaagaggggccgggacaacagccagttcctgcggaggaagtttgtgctgctggcccgggagggcctgctgaagtacttcaccaaggagcagggcaagagccccaaggccgtcatcagcatcaaggacctgaatgccaccttccagacagagaagattggccacccccacggcctgcagatcacctacagaagagatggccacaccaggaacctgtttgtgtaccatgaaagtggcaaggagatcgtggactggttcaatgccctgcgggccgcccggctgcagtacctgaagatggccttccctgagctgcctgagagcgagctggtgcccttcctgaccaggaactacctgaagcagggcttcatggagaagacaggccccaagcagaaggagcccttcaagaagcgctggtttgccctggactgccatgaaagaaggctgctgtactacaagaaccccctggatgcctttgagcagggccaggtgttcctgggcaacaaggagcagggctatgaggcctatgaggacctgcccaagggcatccggggcaaccgctggaaggccggcctgaccatcgtgaccccagagaggagatttgtgctgacctgccccagcgagaaggagcagcaggagtggctggagagcctgcggggcgtgctgagcagccccctgacccccctgaaccggctgacagccagcacagagagcggccgcagcagcaggtag

SEQ ID NO: 32405 - DNA, 3021 bp, Artificial Sequence
  Description of Artificial Sequence: Synthetic coding sequence
atgccagaccagatctctgtgtctgaatttgtggccgagacccatgaggactacaaggcccccacagccagcagcttcaccaccaggacagcccagtgcaggaacacagtggccgccatcgaggaggccctggatgtggacaggatggtgctgtacaagatgaagaagtctgtgaaggccatcaacagcagcggcctggcccacgtggagaatgaggagcagtacacccaggccctggagaagtttggaggcaactgtgtgtgcagagatgatcctgacctgggcagcgccttcctgaagttcagcgtcttcaccaaggagctgacagccctcttcaagaacctgatccagaacatgaacaacatcatctccttccccctggacagcctgctgaagggggacctgaagggcgtgaagggggacctgaagaagccctttgacaaggcctggaaggactatgagaccaagatcaccaagattgagaaggagaagaaggagcacgccaagctgcacggcatgatcagaacagagatctctggagctgagattgctgaggagatggagaaggagcggcgcttcttccagctgcagatgtgtgagtacctgctgaaggtgaatgagatcaagatcaagaagggcgtggacctgctgcagaacctgatcaagtacttccacgcccagtgcaacttcttccaggacggcctgaaggctgtggagagcctgaagcccagcattgagaccctgagcacagacctgcacaccatcaagcaggcccaggatgaggagcggcggcagctgatccagctgcgggacatcctgaagagcgccctgcaggtggagcagaaggaggacagccagatccggcagagcacagcctacagcctgcaccagccccagggcaacaaggagcacggcacagaaagaaatggcagcctgtacaagaagagtgatggcatcaggaaggtgtggcagaagaggaaatgttctgtgaagaatggcttcctgaccatcagccatggaacagccaacagacctccagccaagctgaacctgctgacctgccaggtgaagaccaaccctgaggagaagaagtgctttgacctgatcagccatgacaggacctaccacttccaggccgaggatgagcaggagtgccagatctggatgtctgtgctgcagaacagcaaggaggaggccctgaacaatgccttcaagggagatgacaacacaggagagaacaacatcgtgcaggagctgaccaaggagatcatcagcgaggtgcagaggatgactggaaatgatgtgtgctgtgactgtggggccccagaccccacctggctgagcaccaacctgggcatcctgacctgcatcgagtgcagcggcatccaccgggagctgggcgtgcactacagcaggatgcagagcctgaccctggatgtgctgggcaccagcgagctgctgctggccaagaacattggaaatgccggcttcaatgagatcatggagtgctgcctgcctgctgaggacagcgtgaagcccaaccctggcagtgacatgaatgccaggaaggactacatcacagccaagtacattgaaagaagatatgccaggaagaagcatgctgacaatgctgccaagctgcacagcctgtgtgaggccgtgaagacccgggacatcttcggcctgctgcaggcctatgcagatggagtggacctgacagagaagatccccctggccaacggccacgagccagatgaaacagccctgcacctggccgtgcgctctgtggacaggaccagcctgcacatcgtggacttcctggtgcagaacagcggcaacctggacaagcagacaggcaagggcagcacagccctgcactactgctgcctgacagacaatgcagaatgtctgaagctgctgctgcggggcaaggccagcattgaaattgccaatgaaagtggagagacccccctggacatcgccaagaggctgaagcatgagcactgtgaggagctgctgacccaggccctgagcggccgcttcaacagccacgtgcacgtggagtatgagtggaggctgctgcacgaggacctggatgaaagtgatgatgacatggatgagaagctgcagcccagccccaacagaagagaagatcggcccatctccttctaccagctgggcagcaaccagctgcagagcaatgctgtgtccctggccagagatgctgccaacctggccaaggagaagcagagggccttcatgcccagcatcctgcagaatgagacctatggagccctgctgagcggcagccccccaccagcccagcctgctgcccccagcaccaccagcgccccacccctgcccccaagaaatgtgggcaaggtgcagacagccagcagcgccaacaccctgtggaagaccaacagcgtgtctgtggatggcggcagccggcagaggagcagcagtgaccccccagctgtgcacccccccctgccccccctgcgggtgaccagcaccaaccccctgacccccaccccacctcctcctgtggccaagaccccatctgtgatggaggccctgagccagcccagcaagccagcccctcctggcatcagccagatccggcccccacccctgcccccccagccccccagccggctgccccagaagaagccagcccctggagctgacaagagcacccccctgaccaacaagggccagccccggggccctgtggacctgagcgccacagaggccctgggccccctgagcaatgccatggtgctgcagcccccagcccccatgcccaggaagagccaggccaccaagctgaagcccaagagggtgaaggccctgtacaactgtgtggccgacaacccagatgagctgaccttctctgaaggagatgtgatcatcgtggatggagaggaggaccaggagtggtggattggccacattgatggagaccccggcaggaaaggagccttccctgtgtcctttgtgcacttcatcgctgactag

SEQ ID NO: 32406 - DNA, 2886 bp, Artificial Sequence
  Description of Artificial Sequence: Synthetic coding sequence
atgccagaccagatctctgtgtctgaatttgtggccgagacccatgaggactacaaggcccccacagccagcagcttcaccaccaggacagcccagtgcaggaacacagtggccgccatcgaggaggccctggatgtggacaggatggtgctgtacaagatgaagaagtctgtgaaggccatcaacagcagcggcctggcccacgtggagaatgaggagcagtacacccaggccctggagaagtttggaggcaactgtgtgtgcagagatgatcctgacctgggcagcgccttcctgaagttcagcgtcttcaccaaggagctgacagccctcttcaagaacctgatccagaacatgaacaacatcatctccttccccctggacagcctgctgaagggggacctgaagggcgtgaagggggacctgaagaagccctttgacaaggcctggaaggactatgagaccaagatcaccaagattgagaaggagaagaaggagcacgccaagctgcacggcatgatcagaacagagatctctggagctgagattgctgaggagatggagaaggagcggcgcttcttccagctgcagatgtgtgagtacctgctgaaggtgaatgagatcaagatcaagaagggcgtggacctgctgcagaacctgatcaagtacttccacgcccagtgcaacttcttccaggacggcctgaaggctgtggagagcctgaagcccagcattgagaccctgagcacagacctgcacaccatcaagcaggcccaggatgaggagcggcggcagctgatccagctgcgggacatcctgaagagcgccctgcaggtggagcagaaggaggacagccagatccggcagagcacagcctacagcctgcaccagccccagggcaacaaggagcacggcacagaaagaaatggcagcctgtacaagaagagtgatggcatcaggaaggtgtggcagaagaggaaatgttctgtgaagaatggcttcctgaccatcagccatggaacagccaacagacctccagccaagctgaacctgctgacctgccaggtgaagaccaaccctgaggagaagaagtgctttgacctgatcagccatgacaggacctaccacttccaggccgaggatgagcaggagtgccagatctggatgtctgtgctgcagaacagcaaggaggaggccctgaacaatgccttcaagggagatgacaacacaggagagaacaacatcgtgcaggagctgaccaaggagatcatcagcgaggtgcagaggatgactggaaatgatgtgtgctgtgactgtggggccccagaccccacctggctgagcaccaacctgggcatcctgacctgcatcgagtgcagcggcatccaccgggagctgggcgtgcactacagcaggatgcagagcctgaccctggatgtgctgggcaccagcgagctgctgctggccaagaacattggaaatgccggcttcaatgagatcatggagtgctgcctgcctgctgaggacagcgtgaagcccaaccctggcagtgacatgaatgccaggaaggactacatcacagccaagtacattgaaagaagatatgccaggaagaagcatgctgacaatgctgccaagctgcacagcctgtgtgaggccgtgaagacccgggacatcttcggcctgctgcaggcctatgcagatggagtggacctgacagagaagatccccctggccaacggccacgagccagatgaaacagccctgcacctggccgtgcgctctgtggacaggaccagcctgcacatcgtggacttcctggtgcagaacagcggcaacctggacaagcagacaggcaagggcagcacagccctgcactactgctgcctgacagacaatgcagaatgtctgaagctgctgctgcggggcaaggccagcattgaaattgccaatgaaagtggagagacccccctggacatcgccaagaggctgaagcatgagcactgtgaggagctgctgacccaggccctgagcggccgcttcaacagccacgtgcacgtggagtatgagtggaggctgctgcacgaggacctggatgaaagtgatgatgacatggatgagaagctgcagcccagccccaacagaagagaagatcggcccatctccttctaccagctgggcagcaaccagctgcagagcaatgctgtgtccctggccagagatgctgccaacctggccaaggagaagcagagggccttcatgcccagcatcctgcagaatgagacctatggagccctgctgagcggcagccccccaccagcccagcctgctgcccccagcaccaccagcgccccacccctgcccccaagaaatgtgggcaaggaccccctgacccccaccccacctcctcctgtggccaagacccccagcgtgatggaggccctgagccagcccagcaagccagcccctcctggcatcagccagatccggcccccacccctgcccccccagccccccagccggctgccccagaagaagccagcccctggagctgacaagagcacccccctgaccaacaagggccagccccggggccctgtggacctgagcgccacagaggccctgggccccctgagcaatgccatggtgctgcagcccccagcccccatgcccaggaagagccaggccaccaagctgaagcccaagagggtgaaggccctgtacaactgtgtggccgacaacccagatgagctgaccttctctgaaggagatgtgatcatcgtggatggagaggaggaccaggagtggtggattggccacattgatggagaccccggcaggaagggggccttccctgtgtcctttgtgcacttcatcgctgactag

SEQ ID NO: 32407 - DNA, 849 bp, Artificial Sequence
  Description of Artificial Sequence: Synthetic coding sequence
atgaacagcagcaccagcaccatgtctgaggagccagatgccctgtctgtggtgaaccagctgcgggacctggccgctgaccccctgaacagaagagccatcgtgcaggaccagggctgcctgcccggcctcatcctcttcatggaccaccccaacccccctgtggtgcacagcgccctgctggccctgcgctacctggccgagtgccgggccaaccgggagaagatgaagggggagctgggcatgatgctgagcctgcagaatgtcatccagaagaccaccaccccaggagagaccaagctgctggccagcgagatctatgacatcctgcagagcagcaacatggctgatggagacagcttcaatgagatgaacagcagaagaaggaaggcccagttcttcctgggcaccaccaacaagagggccaagacagtggtgctgcacattgatggcctggatgacaccagcagaagaaacctgtgtgaggaggccctgctgaagatcaagggcgtcatctccttcaccttccagatggctgtgcagagatgtgtggtgcgcatccgcagtgacctgaaggccgaggccctggccagcgccatcgccagcaccaaggtgatgaaggcccagcaggtggtgaagtctgagagcggggaggagatgctggtgcccttccaggacacccctgtggaggtggagcagaacacagagctgcctgactacctgcctgaagatgagagccccaccaaggagcaggacaaggctgtgtcccgggtgggcagccaccctgagggcggggcctcctggctgagcacagctgccaacttcctgagccgctccttctactggtag

SEQ ID NO: 32408 - DNA, 543 bp, Artificial Sequence
  Description of Artificial Sequence: Synthetic coding sequence
atgtctgcctggccctacttcatctacggccccagccagcccagcagccggcccctgcgctttgcctgcagcagcatcctgggccgcatgccctgcaagcagaggaaggatgaaagaagaacaggctatgatgtggagctgaccaagtgctacacagagagcagaagaaacctgtgtgaggaggccctgctgaagatcaagggcgtcatctccttcaccttccagatggctgtgcagagatgtgtggtgcgcatccgcagtgacctgaaggccgaggccctggccagcgccatcgccagcaccaaggtgatgaaggcccagcaggtggtgaagtctgagagcggggaggagatgctggtgcccttccaggacacccctgtggaggtggagcagaacacagagctgcctgactacctgcctgaagatgagagccccaccaaggagcaggacaaggctgtgtcccgggtgggcagccaccctgagggcggggcctcctggctgagcacagctgccaacttcctgagccgctccttctactggtag

SEQ ID NO: 32409 - DNA, 6873 bp, Artificial Sequence
  Description of Artificial Sequence: Synthetic coding sequence
atgggccgcatccaggaggtgggctgggtgacagctggcctggtgatctgggccggcacctgctactacatctacaagttcaccaagggccgggcccagagcgtgaggaccctggccagaaatggcagcacagtgaagatggagaccgtggtgggcgtgcagagccagaccctggccatcaatgaagctgagatcaagaccaagccccaggtggagattggagctgagactggagcccggagcggccccagggctgaggtggagaccaaggccacagccatcgccatccaccgggccaacagccaggccaaggccatggtgggcgctgagcctgagacccagagcgagagcaaggtggtggccggcaccctggtgatgacagaagctgtgaccctgacagaggtgaaggccaaggcccgggaggtggccatgaaggaggccgtgacccagacagatgctgaggccggcaagatcgtgaagaaggaggccgtgacccagaccaaggccaaggcctgggccctggtggccaagacagaggccaagcgggaggccatgacccagaccaaggccgagacccacatcctggccgagaaggagacagagatcaacagagtgatggtgacccagagcgagaccctggccgtgccccgggaggtggccaagatgggcgccaccaacaagacaggcatcgtggatgagaccaagacccgggccctggaggagaccgtgtctgtggccaagacccagagcgaggcccggcctggggccaccgtggatgcccggggcaaccccaacggcatgagccgggaggtggccggcgtggacatgaagagctgtgcccagagccaggccgtgaccaagatccagggagatgacatgcctggcaccggggtggaggacatgggcaactgcaagaccatgagcagagctgagagcggggctgacacccgggccagcgcccagccccagatctttgccaagacccagacagaggccatccctggggccaagattgatgctgggggcaacaccaatgccatgtgcaaggtgggcgctggagcagatgtgcgggcctgcatccagccccagacagtggccaagaagcaggccgaggtgaccagcggggcccgggtggatggccggggcaacaccaacgtcatcagcaaggccatcaccggggctgacatgagagctgctgcccagccccaggccgtggccagcacccacgccgaggccatgtctgatgccaaggtgaagaacagaggcaaccccaatgccatgaccaaggccggggccaaggccaacctgcgggccaacagccaggtggaggccctgcctgatgcccgggacaagagccggggcaaccccaacgtgatggccaaggtgggagatggaacagacatgctgagctgcacccagccccagctggtggcctctgtgcaggccgacaccctgagtgatggcaagatcaaggtgagaggaaatgtgaacaccatgcccaaggagggcgctggggtggacatgaaggcccagggcatggcccagagccagggcgaggccctgcccaacacccggggcaaggcccggggcaaggccaaggccaagtgcaagacaggccctggcatggacatgaagacctgcacccagccccaggccggcgtgaagaccccagctgaggccctgctggacagccgggtggatggccggggcaaccccaatgccaccagcaaggccggcaccaaggctgaccagagggtgtgtggccagcccctggtggtggccaacccccagggcgaggccctgcccggggccaagaacaaggtgaagggcaacccccacacagtgctgaaggtgggcgctggggagggcaccacagattctgcccagcctgaggccgtggtgtccttccagggcgaggccctgctgggcaccaagaacaaggtgaagggcaaccccaacgtggtgctgaaggccgaggtgggggagggcgccatgggcacagcccagctgcagatcatggccagcagcaaaggagaggccctgctggacagcaagaacaaggtgaagggcaacagcaatgctgtgtccaaggccggggccggcacagacaccactggatctgtgcagccccagatcgtggccaacagccagggcgaggtgctgcccggggccaagaacaagatccggggcaaccccaccaccgtgcccaacagcggcgtgggcccctacaccacagattctgcccggctgcaggccgtggccaacagccagggcgaggtgctgcccggggccaagaacaaggtgaaggccaacctgaatgctgtgtccaaggccgaggccggcatgggcgccactggatctgtgcagccccaggccgtggccaacagccactgtgagaccctgcccggggccaagaacaaggtgcggggcaactggaatgctgtgtccaaggccggggccggcatggacacccggggcagcgcccagccccaggccgtggccaacagccagggcgaggtgctgcccggggccaagaacaaggtgaagggcaaccccaacgtggtgtccaaggccggggcccgggaggacacagtgggcagcacccagccccaggtgctggccagcagccagcgggagaccctgcccggggccaggaacaaggtgaagggcaacagcaatgtggtgtccaaggccggggcccgggaggacaccatgggcagcgcccagccccaggtggtggccaacagccagcgggagaccctgcccggggccaggaacaaggtgaagggcaacagcaatgccatcagcaaggccgaggccggggccggcatcatgggctctgtgcaggtgcaggtggtggccagcttccagggcgaggtgctgcccggggccaagaacaaggtgcggggcaacagcaatgctgtgcccaaggccgaggccggggctgacacagtgggcagcgcccagccccaggccgtggccaacagccagagcgagaccctgctgggcgccaggaacaaggtgaagggcaacaccatcgctgtgcccaaggccggcaccggggccggcaccaggcacagcgcccagccccagatcgtggccggcagccagggcgagaccctgcccggggcccgggacaagtccatgagcaccagcgaggccgaggccacagcagaagatgaggcctatgccaagccagaggccgaggccatgcccaccagcgagagcgagggcggcagcggcacccaggcctgcaggaagacccagcccaacatccatgactactactggaatggcatcggcgtggaggactggattgctgctgagcgctggatcaagttccgcttccagaccatggatggagactgggagaacagcgtgtcctgggcagatgatgaaaatgaggccagcatcggctcctggagcggggccagtgacaaggccggcatcatccgctcctgggccgtggcctgtgatgagacctctgtgaagtcctgggccggggcccgggcagaaaatgtggtgggcatcggcacctgggcccgggccggggagcaggccagcggcggcctgtgggccggcggccagaccagcgagggcacctgggccggggacaaggccagcggcggggcctggacaggagctgagaaccaggccagcggcggctcctgggccctggccggcaaccaggccatcggggagctgtgggccgccggccaggccagtgatggctcctggccaggcggccaggccagcggcgtgtcctgggtgggggaggaggccatcggcggctcctggacaggagctgagaaccaggccagcgagggctcctgggccggggccggggccggcaacatgagctctgtgtcctactgggccggcgtggtggaccaggccggcggcggctcctgggccggcaccagtgaccagagcggcggcggcagcaagcccaggtttgaggaccaggccagcggggagggctcctgggccggggccggcggccaggccagcggcggctccatgctgggccctgaggaccagagcagcggccgctcctgggccgacacagctgaccaggccagcggcggcagccggctgggccacgtggaccagagcagtggaggagcctgggccggcaccctggaccagagcggcggcggcagcaagcccaggtttgagaaccagaccacagaggagggctcctgggccggggccggcggccaggccggcggcggcagcaaggtgggccctgaggaccagagcagcggccgctcctgggccaacagcggggaccagatcagcggcggcttcctggtgggcatcgtggaccaggccaacggcggctcctggacaggagctggccacccagcctctgtgggccccaagcccatctttgaggaccaggtgtctggccggggctcctgggcagatgcccgggagcaggtggtgggggacagccggctgggcctgcgggaccagagcagcggggacagctgggccgacaccggggaccaggccagcggctggttctgtgtgtgccccggcagccagaccaatggaggctcctggggcggggccagcggccaggatgtgggcggcagccggcccggccccaccaaccagagcagcgctggctcctgggacagccctggcagccaggtgtctggcagctgctggacaggagctggagctgtggaccaggccggcggctgcagcaagccaggctttgaggaccaggccatcggcggcggcttctggccaggagctggggaccagacaggaggcggcagcaggcctggcagcgaggaccagagcagcggcatcggctcctggggcgtggccggcggccaggtgctgggcggggcccggcccggccctgctgaccagagcagcggcggctcctgggccggcaccggcaaccagagcagcggccgctcctggattggccctggggaccaggccgtggactgcagcaagccagagtttgaggaccaggcctgtggcggcggctcctgggccggggccggcagccaggccagcggggagagctgggccggcagcaggcctggaaatgaggccatcggcggcagcaggatgggcagcgaggaccaggccaccggcggctcctgggcccggtctgaggaccaggccagcggccgcttccaggtgtcctttgaggtggaggccaatgaaggcttctggtttggacctggagctgaggccgtgattggctcctggtgctggacagaggagaaggctgacatcgtgtccaggccagatgacaaggatgaggccaccacagccagccgctctggagctggggaggaggccatgatctgcagcagaattgaagctgagaacaaggccagcagcggctcctggatccgctctgaggaggtggcctacatgggcagctgtgtgggcgctgaggccggggccggggctgaggccggggccggggctgaggccggggccggggccggggctgaggccggggctgaggccggggccggggccggggccggccctggaacagaaagtggagctggcatctggagctgggatggagatgccaccaccgtggagagccggctgggcgctggggaggaggccggcgtggagagctggaccctggccagaaatgtgggggaggatgagctgagccgggagagcagcccagacatcgaggagatcagcctgcggagcctcttctgggccgagagcgagaacagcaacaccttccgcagcaagagcggcaaggatgccagctttgagagcggggccggggacaacaccagcatcaaggacaagtttgaggccgccggcggcgtggacatcggctcctggttctgtgctggaaatgaaaacaccagcgaggacaagagcgcccccaaggccaaggccaagaagagcagcgagagccggggcatctacccctacatggtgcctggagctggcatgggctcctgggatggagccatgatctggagcgagaccaagtttgcccaccagagcgaggccagcttccctgtggaggatgagagcaggaagcagaccaggactggagagaagacccggccctggagctgccgctgcaagcatgaggccaacatggacccccgggacctggagaagctgatctgcatgattgagatgacagaggaccccagcgtgcatgaaattgccaacaatgccctgtacaacagcgctgactacagctacagccatgaggtggtgagaaatgtgggcggcatcagcgtcatcgagagcctgctgaacaacccctaccccagcgtgcggcagaaggccctgaatgccctgaacaacatctctgtggccgctgagaaccacaggaaggtgaagacctacctgaaccaggtgtgtgaagatactgtgacctaccccctgaacagcaatgtgcagctggccggcctgcggctcatccgccacctgaccatcaccagcgagtaccagcacatggtgaccaactacatcagcgagttcctgcggctgctgactgtgggcagcggggagaccaaggaccacgtgctgggcatgctgctgaacttcagcaagaaccccagcatgaccaaggacctgctgattgccaatgcccccaccagcctcatcaacatcttcagcaagaaggagaccaaggagaacatcctgaatgccctgagcctgtttgagaacatcaactaccacttcaagaggcgggccaaggccttcacccaggacaagttcagcaagaacagcctgtacttcctgttccagaggcccaaggcctgtgccaagaagctgcgggccctggccgcagaatgtaatgaccctgaggtgaaggagcgggtggagctgctgatcagcaagctgtag

SEQ ID NO: 32410 - DNA, 1083 bp, Artificial Sequence
  Description of Artificial Sequence: Synthetic coding sequence
atgtctgctgctggcctgaagatcaccggcagcaaggagaccaagaggcggctgctgctgatcagcattgactggagccgggacctgatgaacctgtgcatctacttccgggtgtactgccaggagaagcaggaggagcggcgggagctgccccgcatcatcactggacctcctcctgaggccgctgtggtggcctttgagtggctgaagaccagcaccctgaccggcctgcacccccagctgcccctgagcctgccccagccagaatgtgccctgccctacctggtgcgggccttcagcagaggagactacatgggccgcatccaggaggtgggctgggtgacagctggcctggtgatctgggccggcacctgctactacatctacaagttcaccaagggccgggcccagagcgtgaggaccctggccagaaatggcagcacagtgaagatggagaccgtggtgggcgtgcagagccagaccctggccatcaatgaagctgagatcaagaccaagccccaggtggagattggagctgagactggagcccggagcggccccagggctgaggtggagaccaaggccacagccatcgccatccaccgggccaacagccaggccaaggccatggtgggcgctgagcctgagacccagagcgagagcaaggtggtggccggcaccctggtgatgacagaagctgtgaccctgacagaggtgaaggccaaggcccgggaggtggccatgaaggaggccgtgacccagacagatgctgaggccggcaagatcgtgaagaaggaggccgtgacccagaccaaggccaaggcctgggccctggtggccaagacagaggccaagcgggaggccatgacccagaccaaggccgagacccacatcctggccgagaaggagacagagatcaacagagtgatggtgacccagagcgagaccctggccgtgccccgggaggtggccaagatgggcgccaccaacaagacaggcatcgtggatgagaccaagacccgggccctggaggagaccgtgctgatcccccgggccttccccagcaagaatgccagctgctag

SEQ ID NO: 32411 - DNA, 1083 bp, Artificial Sequence; identical to SEQ ID NO: 32410
  Description of Artificial Sequence: Synthetic coding sequence

SEQ ID NO: 32412 - DNA, 903 bp, Artificial Sequence
  Description of Artificial Sequence: Synthetic coding sequence
atgggccgggcccgggaggtgggctggatggccgccggcctgatgattggagctggggcctgctactgtgtgtacaagctgaccatcggcagagatgacagcgagaagctggaggaggagggggaggaggagtgggatgatgaccaggagctggatgaggaggagccagacatctggtttgattttgagaccatggcccggccctggacagaagatggagactggacagagcccggggcccctgggggcacagaagatcggcccagcggcggcggcaaggccaacagagcccaccccatcaagcagaggcccttcccctatgagcacaagaacacctggagcgcccagaactgcaagaatggcagctgtgtgctggacctgagcaaatgtctcttcatccagggcaagctgctgtttgctgagcccaaggatgctggcttccccttcagccaggacatcaacagccacctggccagcctgtccatggccaggaacaccagccccaccccagaccccaccgtgcgggaggccctgtgtgccccagacaacctgaatgccagcattgagagccagggccagatcaagatgtacatcaatgaggtgtgccgggagaccgtgagccgctgctgcaacagcttcctgcagcaggccggcctgaacctgctgatctccatgaccgtcatcaacaacatgctggccaagagcgccagtgacctgaagttccccctcatcagcgagggcagcggctgtgccaaggtgcaggtgctgaagcccctgatgggcctgtctgagaagcctgtgctggccggggagctggtgggcgcccagatgctgttctccttcatgagcctcttcatcagaaatggaaaccgggagatcctgctggagaccccagccccctag

SEQ ID NO: 32413 - DNA, 903 bp, Artificial Sequence; identical to SEQ ID NO: 32412
  Description of Artificial Sequence: Synthetic coding sequence

SEQ ID NO: 32414 - DNA, 903 bp, Artificial Sequence; identical to SEQ ID NO: 32412
  Description of Artificial Sequence: Synthetic coding sequence

SEQ ID NO: 32415 - DNA, 1302 bp, Artificial Sequence
  Description of Artificial Sequence: Synthetic coding sequence
atgggccgggtgcagctgtttgagatcagcctgagccacggccgggtggtgtacagccctggagagcccctggccggcaccgtgcgggtgcggctgggcgcccccctgcccttccgggccatccgggtgacctgcatcggcagctgtggggtgagcaacaaggccaatgacacagcctgggtggtggaggagggctacttcaacagcagcctgagcctggccgacaagggcagcctgcctgctggggagcacagcttccccttccagttcctgctgcctgccacagcccccaccagctttgagggcccctttgggaagatcgtgcaccaggtgcgggccgccatccacaccccccgcttcagcaaggaccacaagtgcagcctggtgttctacatcctgagccccctgaacctgaacagcatcccagacatcgagcagcccaacgtggccagcgccaccaagaagttctcctacaagctggtgaagacaggctctgtggtgctgacagccagcacagacctgcggggctacgtggtgggccaggccctgcagctgcatgctgatgtggagaaccagagcggcaaggacaccagccctgtggtggccagcctgctgcagaaggtgtcctacaaggccaagcgctggattcatgatgtgaggaccatcgccgaggtggagggcgctggggtgaaggcctggaggcgggcccagtggcatgagcagatcctggtgcctgccctgccccagagcgccctgcccggctgcagcctcatccacatcgactactacctgcaggtgtccctgaaggcccctgaggccaccgtgaccctgcccgtcttcatcggcaacattgctgtgaaccacgcccctgtgagccccaggcctggcctgggcctgcccccaggggccccacccctggtggtgcccagcgccccaccccaggaggaggccgaggccgaggccgctgctgggggcccccacttcctggaccctgtgttcctgagcaccaagagccacagccagaggcagcccctgctggccaccctgagctctgtgcctggggcccctgagccctgcccccaggacggcagccctgccagccaccccctgcacccccccctgtgcatcagcactggagccaccgtgccctactttgctgagggcagcggcggccctgtgcccaccaccagcaccctcatcctgcccccagagtacagctcctggggctacccctatgaggcccctccttcctatgagcagagctgtggcggcgtggagcccagcctgaccccagagagctag

SEQ ID NO: 32416 - DNA, 816 bp, Artificial Sequence
  Description of Artificial Sequence: Synthetic coding sequence
atgggccgggtgcagctgtttgagatcagcctgagccacggccgggtggtgtacagccctggagagcccctggccggcaccgtgcgggtgcggctgggcgcccccctgcccttccgggccatccgggtgacctgcatcggcagctgtggggtgagcaacaaggccaatgacacagcctgggtggtggaggagggctacttcaacagcagcctgagcctggccgacaagggcagcctgcctgctggggagcacagcttccccttccagttcctgctgcctgccacagcccccaccagctttgagggcccctttgggaagatcgtgcaccaggtgcgggccgccatccacaccccccgcttcagcaaggaccacaagtgcagcctggtgttctacatcctgagccccctgaacctgaacagcatcccagacatcgaggccctgcagctgcatgctgatgtggagaaccagagcggcaaggacaccagccctgtggtggccagcctgctgcagaaggtgtcctacaaggccaagcgctggattcatgatgtgaggaccatcgccgaggtggagggcgctggggtgaaggcctggaggcgggcccagtggcatgagcagatcctggtgcctgccctgccccagagcgccctgcccggctgcagcctcatccacatcgactactacctgcaggtgtccctgaaggcccctgaggccaccgtgaccctgcccgtcttcatcggcaacattgctgtgaaccacgcccctgtgagccccaggcctggcctgggcctgcccccaggggccccacccctggtgtag

SEQ ID NO: 32417 - DNA, 534 bp, Artificial Sequence
  Description of Artificial Sequence: Synthetic coding sequence
atgggccgggtgcagctgtttgagatcagcctgagccacggccgggtggtgtacagccctggagagcccctggccggcaccgtgcgggtgcggctgggcgcccccctgcccttccgggccatccgggtgacctgcatcggcagctgtggggtgagcaacaaggccaatgacacagcctgggtggtggaggagggctacttcaacagcagcctgagcctggccgacaagggcagcctgcctgctggggagcacagcttccccttccagttcctgctgcctgccacagcccccaccagctttgagggcccctttgggaagatcgtgcaccaggtgcgggccgccatccacaccccccgcttcagcaaggaccacaagtgcagcctggtgttctacatcctgagccccctgaacctgaacagcatcccagacatcgagggcagcagcctgcggaccccagccaagcccctgcccggccccccacccaagcagcccaacgtggccagcgccaccaagaagttctcctacaagctgtag

SEQ ID NO: 32418 - DNA, 1224 bp, Artificial Sequence
  Description of Artificial Sequence: Synthetic coding sequence
atggctgtgccctggctggtgctgctgctggccctgcccatcttcttcctgggcgtgtttgtgtgggccgtgtttgagcacttcctgaccacagacatcccagccaccctgcagcacccagccaagctgcgcttcctgcactgcatcttcctgtacctggtgaccctgggcaacatctttgagaagctgggcatctgcagcatgcccaagttcatccgcttcctgcatgacagcgtgcgcatcaagaaggaccctgagctggtggtgacagacctgcgcttcggcaccatccctgtgcggctcttccagcccaaggccgccagcagccggccccggcggggcatcatcttctaccatggaggagccaccgtgtttggcagcctggactgctaccacggcctgtgcaactacctggcccgggagacagagagcgtgctgctgatgattggctacaggaagctgcctgaccaccacagccctgccctcttccaggactgcatgaatgccagcatccacttcctgaaggccctggagacctacggcgtggaccccagccgggtggtggtgtgtggggagagcgtgggcggcgctgctgtggccgccatcacccaggccctggtgggccgcagtgacctgccccgcatccgggcccaggtgctgatctaccctgtggtgcaggccttctgcctgcagctgcccagcttccagcagaaccagaatgtgcccctgctgagcaggaagttcatggtgaccagcctgtgcaactacctggccatcgacctgtcctggagagatgccatcctgaatggcacctgtgtgcccccagatgtgtggaggaaatatgagaagtggctgagcccagacaacatccccaagaagttcaagaacagaggctaccagccctggagccctggccccttcaatgaggccgcctacctggaggccaagcacatgctggatgtggagaacagccccctgattgctgatgatgaggtgattgcccagctgcctgaggccttcctggtgtcctgtgaaaatgacatcctgagagatgacagcctgctgtacaagaagaggctggaggaccagggcgtgcgggtgacctggtaccacctgtatgatggcttccacggcagcatcatcttctttgacaagaaggccctgtccttcccctgcagcctgaagatcgtgaatgctgtggtgtcctacatcaagggcatctag

SEQ ID NO: 32419 - DNA, 8910 bp, Artificial Sequence
  Description of Artificial Sequence: Synthetic coding sequence
atggaccccaggaacacagccatgctgggcctgggcagtgacagcgagggcttcagcaggaagagccccagcgccatcagcacaggcaccctggtgtccaagcgggaggtggagctggagaagaacaccaaggaggaggaggacctgaggaagaggaaccgggagaggaacatcgaggccggcaaggatgatggcctgacagatgcccagcagcagttctctgtgaaggagaccaacttcagcgagggcaacctgaagctgaagattggcctgcaggccaagaggaccaagaagccacccaagaacctggagaactacgtgtgcaggcctgccatcaagaccaccatcaagcaccccaggaaggccctgaagagcggcaagatgacagatgagaagaatgagcactgccccagcaagagggaccccagcaagctgtacaagaaggcagatgatgtggccgccatcgagtgccagagcgaggaggtgatccggctgcacagccagggcgagaacaaccccctgagcaagaagctgagccctgtgcacagcgagatggctgactacatcaatgccacccccagcaccctgctgggcagccgggaccctgacctgaaggaccgggccctgctgaatggaggcacctctgtgacagagaagctggcccagctgattgccacctgcccccccagcaagagcagcaagaccaagcccaagaagctgggcaccggcaccacagctggcctggtgtccaaggacctgatcaggaaggccggcgtgggctctgtggccggcatcatccacaaggacctgatcaagaagcccaccatcagcacagctgtgggcctggtgaccaaggaccccgggaagaagcctgtgttcaatgctgctgtgggcctggtgaacaaggacagcgtgaagaagctgggcaccggcaccacagctgtgttcatcaacaagaacctgggcaagaagccaggcaccatcaccaccgtgggcctgctgagcaaggacagcggcaagaagctgggcatcggcatcgtgcccggcctggtgcacaaggagagcggcaagaagctgggcctgggcaccgtggtgggcctggtgaacaaggacctgggcaagaagctgggcagcacagtgggcctggtggccaaggactgtgccaagaagatcgtggccagcagcgccatgggcctggtgaacaaggacatcggcaagaagctgatgagctgccccctggccggcctcatcagcaaggatgccatcaacctgaaggccgaggccctgctgcccacccaggagcccctgaaggccagctgcagcaccaacatcaacaaccaggagagccaggagctgtctgagagcctgaaggacagcgccaccagcaagacctttgagaagaatgtggtgcggcagaacaaggagagcatcctggagaagttctctgtgaggaaggagatcatcaacctggagaaggagatgtttaatgaaggcacctgcatccagcaggacagcttcagcagcagcgagaagggcagctatgagaccagcaagcatgagaagcagccccctgtgtactgcaccagcccagacttcaagatgggcggggccagtgatgtgtccacagccaagagccccttctctgctgtgggggagagcaacctgcccagccccagccccaccgtgtctgtgaaccccctgaccaggagccccccagagaccagcagccagctggcccccaaccccctgctgctgagcagcaccacagagctgattgaggagatcagcgagagcgtgggcaagaaccagttcaccagcgagagcacccacctgaatgtgggccacaggtctgtgggccacagcatcagcattgaatgtaaaggaattgacaaggaggtgaatgacagcaagaccacccacatcgacatcccccgcatcagcagcagcctgggcaagaagcccagcctgaccagcgagagcagcatccacaccatcacccccagcgtggtgaacttcaccagcctcttcagcaacaagcccttcctgaagctgggcgctgtgtctgccagtgacaagcactgccaggtggccgagagcctgagcaccagcctgcagagcaagcccctgaagaagaggaaaggaaggaagccccgctggaccaaggtggtggcccggagcacctgccgcagccccaagggcctggagctggagaggtctgagctgttcaagaatgtgtcctgcagcagcctgagcaacagcaacagcgagcccgccaagttcatgaagaacatcggcccccccagctttgtggaccatgacttcctgaagaggcggctgcccaagctgagcaagagcacagcccccagcctggccctgctggccgacagcgagaagcccagccacaagagctttgccacccacaagctgagcagctccatgtgtgtgtccagtgacctgctgagtgacatctacaagcccaagaggggccggcccaagagcaaggagatgccccagctggagggcccccccaagaggaccctgaagatcccagccagcaaggtgttcagcctgcagagcaaggaggagcaggagccccccatcctgcagcctgagattgagatccccagcttcaagcagggcctgtctgtgagccccttccccaagaagaggggccggcccaagaggcagatgaggagccctgtgaagatgaagccccctgtgctgtctgtggccccctttgtggccacagagagccccagcaagctggagagcgagagtgacaaccacaggagcagcagtgacttctttgaaagtgaggaccagctgcaggaccctgatgacctggatgacagccaccggcccagcgtgtgcagcatgtctgacctggagatggagccagacaagaagatcaccaagagaaataatggccagctgatgaagaccatcatcaggaagatcaacaagatgaagaccctgaagaggaagaagctgctgaaccagatcctgagcagctctgtggagagcagcaacaagggcaaggtgcagagcaagctgcacaacacagtgagcagcctggccgccaccttcggcagcaagctgggccagcagatcaacgtgtccaagaagggcaccatctacatcggcaagaggcggggcaggaagcccaagacagtgctgaatggcatcctgagcggcagccccaccagcctggccgtgctggagcagacagcccagcaggccgccggcagcgccctgggccagatcctgccccccctgctgcccagcagcgccagcagcagcgagatcctgcccagccccatctgcagccagagcagcggcaccagcggcggccagagccctgtgtccagtgatgctggctttgtggagcccagctctgtgccctacctgcacctgcacagccggcagggctccatgatccagaccctggccatgaagaaggccagcaagggcagaagaaggctgagcccccccaccctgctgcccaacagccccagccacctgtctgagctgaccagcctgaaggaggccacccccagccccatcagcgagagccacagtgatgagaccatccccagcgacagcggcattggaacagacaacaacagcaccagtgacagagctgagaagttctgtggccagaagaagagaagacacagctttgaacatgtgtccctcatccccccagagaccagcacagtgctgagcagcctgaaggagaagcacaagcacaagtgcaagagaagaaatcatgactacctgtcctatgacaagatgaagaggcagaagaggaagaggaagaagaagtacccccagctgaggaaccggcaggaccctgacttcatcgccgagctggaggagctgatcagccggctgtctgagatccgcatcacccacaggagccaccacttcatcccccgggacctgctgcccaccatcttccgcatcaacttcaacagcttctacacccaccccagcttccccctggaccccctgcactacatcaggaagccagacctgaagaagaagaggggccggccccccaagatgagggaggccatggccgagatgcccttcatgcacagcctgtccttccccctgagcagcacaggcttctaccccagctatggcatgccctacagccccagccccctgacagctgcccccatcggcctgggctactacggccgctacccacccaccctgtacccacctccacccagccccagcttcaccacccccctgcccccacccagctacatgcatgctggccacctgctgctgaacccagccaagtaccacaagaagaagcacaagctgctgcggcaggaggccttcctgaccaccagcaggacccccctgctgtccatgagcacctaccccagcgtgcccccagagatggcctacggctggatggtggagcacaagcaccgccaccgccacaagcaccgggagcacaggagcagcgagcagccccaggtgtccatggacaccggcagcagccgctctgtgctggagagcctgaagcgctacagatttgggaaggatgctgtgggggagcgctacaagcacaaggagaagcaccgctgccacatgagctgcccccacctgagccccagcaagagcctcatcaaccgggaggagcagtgggtgcaccgggagcccagcgagagcagccccctggccctgggcctgcagacccccctgcagattgactgcagcgagagcagccccagcctgagcctgggcggcttcacccccaacagcgagcccgccagcagtgatgagcacaccaacctcttcaccagcgccatcggcagctgccgggtgagcaaccccaacagcagcggcaggaagaagctgacagacagccctggcctcttcagcgcccaggacaccagcctgaaccggctgcacaggaaggagagcctgcccagcaatgaaagagctgtgcagaccctggccggcagccagcccaccagtgacaagcccagccagaggccttctgagagcaccaactgcagccccaccaggaagaggagcagcagcgagagcaccagcagcacagtgaatggagtgcccagccgcagcccccggctggtggccagcggagatgattctgtggacagcctgctgcagaggatggtgcagaatgaagaccaggagcccatggagaagagcattgatgctgtgattgccacagccagcgccccacccagcagcagccctggccgcagccacagcaaggacaggaccctgggcaagccagacagcctgctggtgcctgctgtgaccagtgacagctgcaacaacagcatcagcctgctgtctgagaagctgaccagcagctgcagcccccaccacatcaagaggtctgtggtggaggccatgcagaggcaggccaggaagatgtgcaactatgacaagatcctggccaccaagaagaacctggaccacgtgaacaagatcctgaaggccaagaagctgcagaggcaggccaggactggaaacaactttgtgaagaggcggcccggccggcccaggaaatgtcccctgcaggccgtggtgtccatgcaggccttccaggccgcccagtttgtgaaccctgagctgaacagagatgaggagggcgccgccctgcacctgagcccagacacagtgacagatgtgattgaagctgtggtgcagagcgtgaacctgaaccctgagcacaagaagggcctgaagaggaagggctggctgctggaggagcagaccaggaagaagcagaagcccctgcctgaggaggaggagcaggagaacaacaagagcttcaatgaggcccctgtggagatccccagccccagcgagaccccagccaagcccagcgagcctgagagcaccctgcagcctgtgctgagcctcatcccccgggagaagaagccaccccggccccccaagaagaagtaccagaaggccggcctgtacagtgatgtgtacaagaccacagaccccaagagccgcctcatccagctgaagaaggagaagctggagtacaccccaggagaacatgaatatggcctcttccctgcccccatccacgtggtgttctttgtgtctgggaagtacctgcggcagaagagaattgacttccagctgccctatgacatcctgtggcagtggaagcacaaccagctgtacaagaagccagatgtgcccctgtacaagaagatccgcagcaatgtgtatgtggatgtgaagcccctgagcggctatgaggccaccacctgcaactgcaagaagccagatgatgacaccaggaagggctgtgtggatgactgcctgaacaggatgatctttgctgaatgtagccccaacacctgcccctgtggggagcagtgctgcaaccagaggatccagagacatgagtgggtgcagtgcctggagcgcttccgggcagaggagaagggctggggcatccgcaccaaggagcccctgaaggccggccagttcatcatcgagtacctgggggaggtggtgtctgagcaggagttcaggaacaggatgattgagcagtaccacaaccacagcgaccactactgcctgaacctggacagcggcatggtgattgacagctacaggatgggaaatgaggcccgcttcatcaaccacagctgtgaccccaactgtgagatgcagaagtggagcgtgaatggagtgtaccgcatcggcctgtatgccctgaaggacatgcctgctggaacagagctgacctatgactacaacttccacagcttcaacgtggagaagcagcagctgtgcaagtgtggctttgagaagtgccggggcatcatcggcggcaagagccagagggtgaatggcctgaccagcagcaagaacagccagcccatggccacccacaagaagagcggccgcagcaaggagaagaggaagagcaagcacaagctgaagaagagaagaggccacctgtctgaggagcccagcgagaacatcaacacccccacccggctgaccccccagctgcagatgaagcccatgagcaaccgggagaggaactttgtgctgaagcaccacgtgttcctggtgaggaactgggagaagatccggcagaagcaggaggaggtgaagcacaccagtgacaacatccacagcgccagcctgtacacccgctggaatggcatctgcagagatgatggcaacatcaagagtgatgtgttcatgacccagttcagcgccctgcagacagcccggtctgtgaggacccggcggctggccgctgctgaagaaaatattgaggtggcccgggccgcccggctggcccagatcttcaaggagatctgtgatggcatcatctcctacaaggacagcagccggcaggccctggccgcccccctgctgaacctgccccccaagaagaagaatgctgactactatgagaagatcagtgaccccctggacctgatcaccatcgagaagcagatcctgaccggctactacaagacagtggaggcctttgatgctgacatgctgaaggtgttcagaaatgctgagaagtactacggcaggaagagccctgtgggcagagatgtgtgccgcctgaggaaggcctactacaatgcccggcatgaggccagcgcccagattgatgaaattgtgggggagacagccagcgaggccgacagcagcgagacctctgtgtctgagaaggaaaatggacatgagaaggatgatgatgtgatccgctgcatctgtggcctgtacaaggatgagggcctgatgatccagtgtgacaagtgcatggtgtggcagcactgtgactgcatgggcgtgaacagtgatgtggagcactacctgtgtgagcagtgtgaccccaggcctgtggaccgggaggtgcccatgatcccccggccccactacgcccagcccggctgtgtgtacttcatctgcctgctgagagatgacctgctgctgcggcagggcgactgtgtgtacctgatgagggacagcaggaggaccccagatggccaccctgtgcggcagagctaccgcctgctgagccacatcaacagagacaagctggacatcttccgcatcgagaagctgtggaagaatgagaaggaggagagatttgccttcggccaccactacttccggccccatgagacccaccacagccccagccgccgcttctaccacaatgaactcttccgggtgcccctgtatgagatcatccccctggaggccgtggtgggcacctgctgcgtgctggacctgtacacctactgcaagggccggcccaagggcgtgaaggagcaggatgtgtacatctgtgactaccgcctggacaagagcgcccacctgttctacaagatccacaggaaccgctaccctgtgtgcaccaagccctatgcctttgaccacttccccaagaagctgacccccaagaaggacttcagcccccactacgtgcctgacaactacaagagaaatggaggccgcagctcctggaagtctgagaggagcaagccacccctgaaggacctgggccaggaggatgatgccctgcccctcatcgaggaggtgctggccagccaggagcaggccgccaatgagatccccagcctggaggagcctgagcgggagggcgccacagccaacgtgtctgagggggagaagaagacagaggagagcagccaggagccccagagcacctgcaccccagaggagcggcggcacaaccagcgggagcggctgaaccagatcctgctgaacctgctggagaagatccctgggaagaatgccattgatgtgacctacctgctggaggagggcagcggcaggaagctgcggcggaggaccctcttcatccctgagaacagcttcaggaagtag

SEQ ID NO: 32420 - DNA, 8895 bp, Artificial Sequence
  Description of Artificial Sequence: Synthetic coding sequence
atggaccccaggaacacagccatgctgggcctgggcagtgacagcgagggcttcagcaggaagagccccagcgccatcagcacaggcaccctggtgtccaagcgggaggtggagctggagaagaacaccaaggaggaggaggacctgaggaagaggaaccgggagaggaacatcgaggccggcaaggatgatggcctgacagatgcccagcagcagttctctgtgaaggagaccaacttcagcgagggcaacctgaagctgaagattggcctgcaggccaagaggaccaagaagccacccaagaacctggagaactacgtgtgcaggcctgccatcaagaccaccatcaagcaccccaggaaggccctgaagagcggcaagatgacagatgagaagaatgagcactgccccagcaagagggaccccagcaagctgtacaagaaggcagatgatgtggccgccatcgagtgccagagcgaggaggtgatccggctgcacagccagggcgagaacaaccccctgagcaagaagctgagccctgtgcacagcgagatggctgactacatcaatgccacccccagcaccctgctgggcagccgggaccctgacctgaaggaccgggccctgctgaatggaggcacctctgtgacagagaagctggcccagctgattgccacctgcccccccagcaagagcagcaagaccaagcccaagaagctgggcaccggcaccacagctggcctggtgtccaaggacctgatcaggaaggccggcgtgggctctgtggccggcatcatccacaaggacctgatcaagaagcccaccatcagcacagctgtgggcctggtgaccaaggaccccgggaagaagcctgtgttcaatgctgctgtgggcctggtgaacaaggacagcgtgaagaagctgggcaccggcaccacagctgtgttcatcaacaagaacctgggcaagaagccaggcaccatcaccaccgtgggcctgctgagcaaggacagcggcaagaagctgggcatcggcatcgtgcccggcctggtgcacaaggagagcggcaagaagctgggcctgggcaccgtggtgggcctggtgaacaaggacctgggcaagaagctgggcagcacagtgggcctggtggccaaggactgtgccaagaagatcgtggccagcagcgccatgggcctggtgaacaaggacatcggcaagaagctgatgagctgccccctggccggcctcatcagcaaggatgccatcaacctgaaggccgaggccctgctgcccacccaggagcccctgaaggccagctgcagcaccaacatcaacaaccaggagagccaggagctgtctgagagcctgaaggacagcgccaccagcaagacctttgagaagaatgtggtgcggcagaacaaggagagcatcctggagaagttctctgtgaggaaggagatcatcaacctggagaaggagatgtttaatgaaggcacctgcatccagcaggacagcttcagcagcagcgagaagggcagctatgagaccagcaagcatgagaagcagccccctgtgtactgcaccagcccagacttcaagatgggcggggccagtgatgtgtccacagccaagagccccttctctgctgtgggggagagcaacctgcccagccccagccccaccgtgtctgtgaaccccctgaccaggagccccccagagaccagcagccagctggcccccaaccccctgctgctgagcagcaccacagagctgattgaggagatcagcgagagcgtgggcaagaaccagttcaccagcgagagcacccacctgaatgtgggccacaggtctgtgggccacagcatcagcattgaatgtaaaggaattgacaaggaggtgaatgacagcaagaccacccacatcgacatcccccgcatcagcagcagcctgggcaagaagcccagcctgaccagcgagagcagcatccacaccatcacccccagcgtggtgaacttcaccagcctcttcagcaacaagcccttcctgaagctgggcgctgtgtctgccagtgacaagcactgccaggtggccgagagcctgagcaccagcctgcagagcaagcccctgaagaagaggaaaggaaggaagccccgctggaccaaggtggtggcccggagcacctgccgcagccccaagggcctggagctggagaggtctgagctgttcaagaatgtgtcctgcagcagcctgagcaacagcaacagcgagcccgccaagttcatgaagaacatcggcccccccagctttgtggaccatgacttcctgaagaggcggctgcccaagctgagcaagagcacagcccccagcctggccctgctggccgacagcgagaagcccagccacaagagctttgccacccacaagctgagcagctccatgtgtgtgtccagtgacctgctgagtgacatctacaagcccaagaggggccggcccaagagcaaggagatgccccagctggagggcccccccaagaggaccctgaagatcccagccagcaaggtgttcagcctgcagagcaaggaggagcaggagccccccatcctgcagcctgagattgagatccccagcttcaagcagggcctgtctgtgagccccttccccaagaagaggggccggcccaagaggcagatgaggagccctgtgaagatgaagccccctgtgctgtctgtggccccctttgtggccacagagagccccagcaagctggagagcgagagtgacaaccacaggagcagcagtgacttctttgaaagtgaggaccagctgcaggaccctgatgacctggatgacagccaccggcccagcgtgtgcagcatgtctgacctggagatggagccagacaagaagatcaccaagagaaataatggccagctgatgaagaccatcatcaggaagatcaacaagatgaagaccctgaagaggaagaagctgctgaaccagatcctgagcagctctgtggagagcagcaacaagggcaaggtgcagagcaagctgcacaacacagtgagcagcctggccgccaccttcggcagcaagctgggccagcagatcaacgtgtccaagaagggcaccatctacatcggcaagaggcggggcaggaagcccaagacagtgctgaatggcatcctgagcggcagccccaccagcctggccgtgctggagcagacagcccagcaggccgccggcagcgccctgggccagatcctgccccccctgctgcccagcagcgccagcagcagcgagatcctgcccagccccatctgcagccagagcagcggcaccagcggcggccagagccctgtgtccagtgatgctggctttgtggagcccagctctgtgccctacctgcacctgcacagccggcagggctccatgatccagaccctggccatgaagaaggccagcaagggcagaagaaggctgagcccccccaccctgctgcccaacagccccagccacctgtctgagctgaccagcctgaaggaggccacccccagccccatcagcgagagccacagtgatgagaccatccccagcgacagcggcattggaacagacaacaacagcaccagtgacagagctgagaagttctgtggccagaagaagagaagacacagctttgaacatgtgtccctcatccccccagagaccagcacagtgctgagcagcctgaaggagaagcacaagcacaagtgcaagagaagaaatcatgactacctgtcctatgacaagatgaagaggcagaagaggaagaggaagaagaagtacccccagctgaggaaccggcaggaccctgacttcatcgccgagctggaggagctgatcagccggctgtctgagatccgcatcacccacaggagccaccacttcatcccccgggacctgctgcccaccatcttccgcatcaacttcaacagcttctacacccaccccagcttccccctggaccccctgcactacatcaggaagccagacctgaagaagaagaggggccggccccccaagatgagggaggccatggccgagatgcccttcatgcacagcctgtccttccccctgagcagcacaggcttctaccccagctatggcatgccctacagccccagccccctgacagctgcccccatcggcctgggctactacggccgctacccacccaccctgtacccacctccacccagccccagcttcaccacccccctgcccccacccagctacatgcatgctggccacctgctgctgaacccagccaagtaccacaagaagaagcacaagctgctgcggcaggaggccttcctgaccaccagcaggacccccctgctgtccatgagcacctaccccagcgtgcccccagagatggcctacggctggatggtggagcacaagcaccgccaccgccacaagcaccgggagcacaggagcagcgagcagccccaggtgtccatggacaccggcagcagccgctctgtgctggagagcctgaagcgctacagatttgggaaggatgctgtgggggagcgctacaagcacaaggagaagcaccgctgccacatgagctgcccccacctgagccccagcaagagcctcatcaaccgggaggagcagtgggtgcaccgggagcccagcgagagcagccccctggccctgggcctgcagacccccctgcagattgactgcagcgagagcagccccagcctgagcctgggcggcttcacccccaacagcgagcccgccagcagtgatgagcacaccaacctcttcaccagcgccatcggcagctgccgggtgagcaaccccaacagcagcggcaggaagaagctgacagacagccctggcctcttcagcgcccaggacaccagcctgaaccggctgcacaggaaggagagcctgcccagcaatgaaagagctgtgcagaccctggccggcagccagcccaccagtgacaagcccagccagaggccttctgagagcaccaactgcagccccaccaggaagaggagcagcagcgagagcaccagcagcacagtgaatggagtgcccagccgcagcccccggctggtggccagcggagatgattctgtggacagcctgctgcagaggatggtgcagaatgaagaccaggagcccatggagaagagcattgatgctgtgattgccacagccagcgccccacccagcagcagccctggccgcagccacagcaaggacaggaccctgggcaagccagacagcctgctggtgcctgctgtgaccagtgacagctgcaacaacagcatcagcctgctgtctgagaagctgaccagcagctgcagcccccaccacatcaagaggtctgtggtggaggccatgcagaggcaggccaggaagatgtgcaactatgacaagatcctggccaccaagaagaacctggaccacgtgaacaagatcctgaaggccaagaagctgcagaggcaggccaggactggaaacaactttgtgaagaggcggcccggccggcccaggaaatgtcccctgcaggccgtggtgtccatgcaggccttccaggccgcccagtttgtgaaccctgagctgaacagagatgaggagggcgccgccctgcacctgagcccagacacagtgacagatgtgattgaagctgtggtgcagagcgtgaacctgaaccctgagcacaagaagggcctgaagaggaagggctggctgctggaggagcagaccaggaagaagcagaagcccctgcctgaggaggaggagcaggagaacaacaagagcttcaatgaggcccctgtggagatccccagccccagcgagaccccagccaagcccagcgagcctgagagcaccctgcagcctgtgctgagcctcatcccccgggagaagaagccaccccggccccccaagaagaagtaccagaaggccggcctgtacagtgatgtgtacaagaccacagaccccaagagccgcctcatccagctgaagaaggagaagctggagtacaccccaggagaacatgaatatggcctcttccctgcccccatccacgtgggcaagtacctgcggcagaagagaattgacttccagctgccctatgacatcctgtggcagtggaagcacaaccagctgtacaagaagccagatgtgcccctgtacaagaagatccgcagcaatgtgtatgtggatgtgaagcccctgagcggctatgaggccaccacctgcaactgcaagaagccagatgatgacaccaggaagggctgtgtggatgactgcctgaacaggatgatctttgctgagtgcagccccaacacctgcccctgtggggagcagtgctgcaaccagaggatccagagacatgagtgggtgcagtgcctggagcgcttccgggcagaggagaagggctggggcatccgcaccaaggagcccctgaaggccggccagttcatcatcgagtacctgggggaggtggtgtctgagcaggagttcaggaacaggatgattgagcagtaccacaaccacagcgaccactactgcctgaacctggacagcggcatggtgattgacagctacaggatgggaaatgaggcccgcttcatcaaccacagctgtgaccccaactgtgagatgcagaagtggagcgtgaatggagtgtacagaattggcctgtatgccctgaaggacatgcctgctggaacagagctgacctatgactacaacttccacagcttcaacgtggagaagcagcagctgtgcaagtgtggctttgagaagtgccggggcatcattggaggcaagagccagagggtgaatggcctgaccagcagcaagaacagccagcccatggccacccacaagaagagcggccgcagcaaggagaagaggaagagcaagcacaagctgaagaagaggcggggccacctgtctgaggagcccagcgagaacatcaacacccccacccggctgaccccccagctgcagatgaagcccatgagcaaccgggagaggaactttgtgctgaagcaccacgtgttcctggtgaggaactgggagaagatccggcagaagcaggaggaggtgaagcacaccagtgacaacatccacagcgccagcctgtacacccgctggaatggcatctgcagagatgatggcaacatcaagagtgatgtgttcatgacccagttcagcgccctgcagacagcccggtctgtgaggacccggcggctggccgctgctgaggagaacatcgaggtggcccgggccgcccggctggcccagatcttcaaggagatctgtgatggcatcatctcctacaaggacagcagccggcaggccctggccgcccccctgctgaacctgccccccaagaagaagaatgctgactactatgagaagatcagtgaccccctggacctgatcaccatcgagaagcagatcctgaccggctactacaagacagtggaggcctttgatgctgacatgctgaaggtgttcagaaatgctgagaagtactacggcaggaagagccctgtgggcagagatgtgtgccgcctgaggaaggcctactacaatgcccggcatgaggccagcgcccagattgatgagatcgtgggggagacagccagcgaggccgacagcagcgagacctctgtgtctgagaaggaaaatggccacgagaaggatgatgatgtgatccgctgcatctgtggcctgtacaaggatgagggcctgatgatccagtgtgacaagtgcatggtgtggcagcactgtgactgcatgggcgtgaacagtgatgtggagcactacctgtgtgagcagtgtgaccccaggcctgtggaccgggaggtgcccatgatcccccggccccactacgcccagcccggctgtgtgtacttcatctgcctgctgagagatgacctgctgctgcggcagggcgactgtgtgtacctgatgagggacagcaggaggaccccagatggccaccctgtgcggcagagctaccgcctgctgagccacatcaacagagacaagctggacatcttcagaattgagaagctgtggaagaatgagaaggaggagagatttgccttcggccaccactacttccggccccatgagacccaccacagccccagccgccgcttctaccacaatgagctgttccgggtgcccctgtatgagatcatccccctggaggccgtggtgggcacctgctgcgtgctggacctgtacacctactgcaagggccggcccaagggcgtgaaggagcaggatgtgtacatctgtgactaccgcctggacaagagcgcccacctgttctacaagatccacaggaaccgctaccctgtgtgcaccaagccctatgcctttgaccacttccccaagaagctgacccccaagaaggacttcagcccccactacgtgcctgacaactacaagagaaatggaggccgcagctcctggaagtctgagaggagcaagccacccctgaaggacctgggccaggaggatgatgccctgcccctgattgaggaggtgctggccagccaggagcaggccgccaatgagatccccagcctggaggagcctgagcgggagggcgccacagccaacgtgtctgagggggagaagaagacagaggagagcagccaggagccccagagcacctgcaccccagaggagaggaggcacaaccagcgggagcggctgaaccagatcctgctgaacctgctggagaagatccctgggaagaatgccattgatgtgacctacctgctggaggagggcagcggcaggaagctgcggcggaggaccctcttcatcccagaaaattccttcaggaagtag

SEQ ID NO: 32421 - DNA, 864 bp, Artificial Sequence
  Description of Artificial Sequence: Synthetic coding sequence
atggccaaggacttccaggacatccagcagctgagcagtgaagaaaatgaccaccccttccaccagggccccccaccagcccagcccctggcccagaggctgtgcagcatggtgtgcttcagcctgctggccctgtccttcaacatcctgctgctggtggtgatctgtgtgacaggcagccagagcgcccagctgcaggccgagctgcggagcctgaaggaggccttcagcaacttcagcagcagcaccctgacagaggtgcaggccatcagcacccatggaggctctgtgggggacaagatcaccagcctgggcgccaagctggagaagcagcagcaggacctgaaggctgaccatgatgccctgctcttccacctgaagcacttccctgtggacctgcgctttgtggcctgccagatggagctgctgcacagcaatggcagccagaggacctgctgccctgtgaactgggtggagcaccagggcagctgctactggttcagccacagcggcaaggcctgggccgaggccgagaagtactgccagctggagaatgcccacctggtggtgatcaacagctgggaggagcagaagttcatcgtgcagcacaccaaccccttcaacacctggattggcctgacagacagtgatggctcctggaagtgggtggatggaacagactaccgccacaactacaagaactgggccgtgacccagcctgacaactggcacggccacgagctgggcggcagcgaggactgtgtggaggtgcagccagatggccgctggaatgatgacttctgcctgcaggtgtaccgctgggtgtgtgagaagagaagaaatgccactggagaggtggcctag

SEQ ID NO: 32422 - DNA, 936 bp, Artificial Sequence
  Description of Artificial Sequence: Synthetic coding sequence
atggccaaggacttccaggacatccagcagctgagcagtgaagaaaatgaccaccccttccaccagggcgagggccctggcacccggcggctgaacccccggcggggcaaccccttcctgaagggccccccaccagcccagcccctggcccagaggctgtgcagcatggtgtgcttcagcctgctggccctgtccttcaacatcctgctgctggtggtgatctgtgtgacaggcagccagagcgagggccacggcggggcccagctgcaggccgagctgcggagcctgaaggaggccttcagcaacttcagcagcagcaccctgacagaggtgcaggccatcagcacccatggaggctctgtgggggacaagatcaccagcctgggcgccaagctggagaagcagcagcaggacctgaaggctgaccatgatgccctgctcttccacctgaagcacttccctgtggacctgcgctttgtggcctgccagatggagctgctgcacagcaatggcagccagaggacctgctgccctgtgaactgggtggagcaccagggcagctgctactggttcagccacagcggcaaggcctgggccgaggccgagaagtactgccagctggagaatgcccacctggtggtgatcaacagctgggaggagcagaagttcatcgtgcagcacaccaaccccttcaacacctggattggcctgacagacagtgatggctcctggaagtgggtggatggaacagactaccgccacaactacaagaactgggccgtgacccagcctgacaactggcacggccacgagctgggcggcagcgaggactgtgtggaggtgcagccagatggccgctggaatgatgacttctgcctgcaggtgtaccgctgggtgtgtgagaagagaagaaatgccactggagaggtggcctag

SEQ ID NO: 32423 - DNA, 936 bp, Artificial Sequence; identical to SEQ ID NO: 32422
  Description of Artificial Sequence: Synthetic coding sequence

SEQ ID NO: 32424 - DNA, 879 bp, Artificial Sequence
  Description of Artificial Sequence: Synthetic coding sequence
atggccaaggacttccaggacatccagcagctgagcagtgaagaaaatgaccaccccttccaccagggccccccaccagcccagcccctggcccagaggctgtgcagcatggtgtgcttcagcctgctggccctgtccttcaacatcctgctgctggtggtgatctgtgtgacaggcagccagagcgagggccatggaggagcccagctgcaggccgagctgcggagcctgaaggaggccttcagcaacttcagcagcagcaccctgacagaggtgcaggccatcagcacccacggcggctctgtgggggacaagatcaccagcctgggcgccaagctggagaagcagcagcaggacctgaaggctgaccatgatgccctgctcttccacctgaagcacttccctgtggacctgcgctttgtggcctgccagatggagctgctgcacagcaatggcagccagaggacctgctgccctgtgaactgggtggagcaccagggcagctgctactggttcagccacagcggcaaggcctgggccgaggccgagaagtactgccagctggagaatgcccacctggtggtgatcaacagctgggaggagcagaagttcatcgtgcagcacaccaaccccttcaacacctggattggcctgacagacagtgatggctcctggaagtgggtggatggaacagactaccgccacaactacaagaactgggccgtgacccagcctgacaactggcacggccacgagctgggcggcagcgaggactgtgtggaggtgcagccagatggccgctggaatgatgacttctgcctgcaggtgtaccgctgggtgtgtgagaagagaagaaatgccaccggggaggtggcctag

SEQ ID NO: 32425 - DNA, 414 bp, Artificial Sequence
  Description of Artificial Sequence: Synthetic coding sequence
atggccaaggacttccaggacatccagcagctgagcagtgaagaaaatgaccaccccttccaccagggccccccaccagcccagcccctggcccagaggctgtgcagcatggtgtgcttcagcctgctggccctgtccttcaacatcctgctgctggtggtgatctgtgtgacaggcagccagagcgcccagctgcaggccgagctgcggagcctgaaggaggccttcagcaacttcagcagcagcaccctgacagaggtgcaggccatcagcacccatggaggctctgtgggggacaagatcaccagcctgggcgccaagctggagaagcagcagcaggacctgaaggccggccagagggccagcggcgtgtgtgcccacgtgcgggcctgtgtgcgggtgcgctgtgtgtag

SEQ ID NO: 32426 - DNA, 1422 bp, Artificial Sequence
  Description of Artificial Sequence: Synthetic coding sequence
atggcccagctggagggctactgcttctctgctgccctgagctgcaccttcctggtgtcctgcctgctcttcagcgccttcagccgggccctgcgggagccctacatggatgagatcttccacctgccccaggcccagcgctactgtgagggccacttcagcctgagccagtgggaccccatgatcaccaccctgcccggcctgtacctggtgtctgtgggcgtggtgaagccagccatctggatctttgcctggagcgagcacgtggtgtgcagcatcggcatgctgcgctttgtgaacctgctcttctctgtgggcaacttctacctgctgtacctgctcttccacaaggtgcagcccaggaacaaggccgccagcagcatccagagggtgctgagcaccctgaccctggccgtgttccccaccctgtacttcttcaacttcctgtactacacagaggccggctccatgttcttcaccctgtttgcctacctgatgtgcctgtatggcaaccacaagaccagcgccttcctgggcttctgtggcttcatgttccggcagaccaacatcatctgggccgtgttctgtgctggaaatgtgattgcccagaagctgacagaggcctggaagacagagctgcagaagaaggaggaccggctgccccccatcaagggcccctttgctgagttcaggaagatcctgcagttcctgctggcctacagcatgtccttcaagaacctgtccatgctgttctgcctgacctggccctacatcctgctgggcttcctgttctgtgcctttgtggtggtgaatggaggcatcgtcatcggggacaggagcagccatgaggcctgcctgcacttcccccagctgttctacttcttctccttcaccctcttcttctccttcccccacctgctgagccccagcaagatcaagaccttcctgagcctggtgtggaagcacggcatcctcttcctggtggtgaccctggtgtctgtgttcctggtgtggaagttcacctacgcccacaagtacctgctggccgacaacagacactacaccttctacgtgtggaagagggtcttccagagatatgccatcctgaagtacctgctggtgcctgcctacatctttgctggctggagcattgctgacagcctgaagagcaagcccatcttctggaacctgatgttcttcatctgcctcttcatcgtgattgtgccccagaagctgctggagttccgctacttcatcctgccctacgtgatctaccgcctgaacatcaccctgccccccaccagccggctggtgtgtgagctgagctgctacgccatcgtgaacttcatcaccttctacatcttcctgaacaagaccttccagtggcccaacagccaggacatccagcgcttcatgtggtag

SEQ ID NO: 32427 - DNA, 1173 bp, Artificial Sequence
  Description of Artificial Sequence: Synthetic coding sequence
atgtttcctgcccaggccaaggaaaatgccggcttcagcggctgcggcggggacacagaaattgactggaaggcctacatggccgaggtggagggcgtcatcaatggcacctatgactacacccagctgcagggcgacaccggccccctggtgtacccagctggctttgtgtacatcttcatgggcctgtactatgccaccagccggggcacagacatccgcatggcccagaacatctttgctgtgctgtacctggccaccctgctgctggtgttcctgatctaccaccagacctgcaaggtgcccccatttgtgttcttcttcatgtgctgtgccagctacagagtgcacagcatctttgtgctgcggctcttcaatgaccctgtggccatggtgctgctcttcctgagcatcaacctgctgctggcccagcgctggggctggggctgctgcttcttcagcctggccgtgtctgtgaagatgaatgtgctgctgtttgcccctggcctgctcttcctgctgctgacccagtttggcttccggggggccctgcccaagctgggcatctgtgccggcctgcaggtggtgctgggcctgcccttcctgctggagaaccccagcggctacctgagccgcagctttgacctgggccggcagttcctgttccactggacagtgaactggaggttcctgcctgaggccctcttcctgcaccgggccttccacctggccctgctgacagcccacctgaccctgctgctgctgtttgccctgtgccgctggcacaggactggagagagcatcctgagcctgctgcgggaccccagcaagaggaaggtgcccccccagcccctgacccccaaccagatcgtgtccaccctcttcaccagcaacttcatcggcatctgcttcagccgcagcctgcactaccagttctacgtgtggtacttccacaccctgccctacctgctgtgggccatgcctgcccgctggctgacccacctgctgcggctgctggtgctgggcctcatcgagctgtcctggaacacctaccccagcaccagctgcagcagcgctgccctgcacatctgccacgccgtcatcctgctgcagctgtggctgggcccccagcccttccccaagagcacccagcacagcaagaaggcccactag

SEQ ID NO: 32428 - DNA, 975 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccacagccaccaagatgcctgccctgcacagacatgaggaggagaagttcttcctgaatgccaagggccagaaggagaccctgcccagcatctgggacagccccaccaagcagctgtctgtggtggtgcccagctacaatgaggagaagaggctgcctgtgatgatggatgaggccctgagctacctggagaagaggcagaagagggaccctgccttcacctatgaagtcatcgtggtggatgatggcagcaaggaccagaccagcaaggtggccttcaagtactgccagaagtatggcagtgacaaggtgcgggtcatcaccctggtgaagaacagaggaaaaggaggagccatccgcatgggcatcttcagcagcagaggagagaagatcctgatggctgatgctgatggagccaccaagttcccagatgtggagaagctggagaagggcctgaatgacctgcagccctggcccaaccagatggccatcgcctgtggcagccgggcccacctggagaaggagagcatcgcccagaggagctacttccgcaccctgctgatgtatggcttccacttcctggtgtggttcctgtgtgtgaagggcatccgggacacccagtgtggcttcaagctgttcacccgggaggccgccagcaggaccttcagcagcctgcacgtggagcgctgggcctttgatgtggagctgctgtacatcgcccagttcttcaagatccccatcgccgagattgctgtgaactggacagaaattgagggcagcaagctggtgcccttctggagctggctgcagatgggcaaggacctgctcttcatccggctgcgctacctgaccggggcctggaggctggagcagaccaggaagatgaactag

SEQ ID NO: 32429 - DNA, 693 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccacagccaccaagatgcctgccctgcacagacatgaggaggagaagttcttcctgaatgccaagggccagaaggagaccctgcccagcatctgggacagccccaccaagcagctgtctgtggtggtgcccagctacaatgaggagaagaggctgcctgtgatgatggatgaggccctgagctacctggagaagaggcagaagagggaccctgccttcacctatgaagtcatcgtggtggatgatggcagcaaggaccagaccagcaaggtggccttcaagtactgccagaagtatggcagtgacaaggtgcgggtcatcaccctggtgaagaacagaggaaaaggaggagccatccgcatgggcatcttcagcagcagaggagagaagatcctgatggctgatgctgatggagccaccaagttcccagatgtggagaagctggagaagggcctgaatgacctgcagccctggcccaaccagatggccatcgcctgtggcagccgggcccacctggagaaggagagcatcgcccagcacaagtgcagctttggaggcctcatcagccagcctgtgttcatcggcagcatcctgtatggccgccactag

SEQ ID NO: 32430 - DNA, 885 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccacagccaccaagatgcctgccctgcacagacatgaggaggagaagttcttcctgaatgccaagggccagaaggagaccctgcccagcatctgggacagccccaccaagcagctgtctgtggtggtgcccagctacaatgaggagaagaggctgcctgtgatgatggatgaggccctgagctacctggagaagaggcagaagtatggcagtgacaaggtgcgggtcatcaccctggtgaagaacagaggaaaaggaggagccatccgcatgggcatcttcagcagcagaggagagaagatcctgatggctgatgctgatggagccaccaagttcccagatgtggagaagctggagaagggcctgaatgacctgcagccctggcccaaccagatggccatcgcctgtggcagccgggcccacctggagaaggagagcatcgcccagaggagctacttccgcaccctgctgatgtatggcttccacttcctggtgtggttcctgtgtgtgaagggcatccgggacacccagtgtggcttcaagctgttcacccgggaggccgccagcaggaccttcagcagcctgcacgtggagcgctgggcctttgatgtggagctgctgtacatcgcccagttcttcaagatccccatcgccgagattgctgtgaactggacagaaattgagggcagcaagctggtgcccttctggagctggctgcagatgggcaaggacctgctcttcatccggctgcgctacctgaccggggcctggaggctggagcagaccaggaagatgaactag

SEQ ID NO: 32431 - DNA, 1173 bp, Artificial Sequence
  Description of Artificial Sequence: Synthetic coding sequence
atgaaggagggccggggcagcttctctgtggagcggggccccaggaaggagcgggagacagcccagagcggcatgtggaagggcaacagccctgctggcagccagggcgccgccatggagggcaccggcggggagctgggcggccagggcaactggggcccagaagatgcccctggcctgctggcccgggccagcctcatcatgctgccctggcccctgcccctggccagcagcgccctgaccctgctgtttggagccctgaccagcctcttcctgtggtactgctaccgcctgggcagccaggacatgcaggccctgggcgccggcagccgggccggcggcgtgcggggcggccctgtgggctgcagcgaggccggcggccccagccctgggggccctggggaccccggggagggccccaggacagagggcctggtgtcccggcggctgcgggcctatgcccggcgctacagctgggccggcatgggccgggtgcggcgggccgcccagggcggccctggccctggccggggccctggggtgctgggcatccagaggcctggcctgctcttcctgcctgacctgcccagcgccccctttgtgcccagagatgcccagagacatgatgtggagctgctggagagcagcttccctgccatcctgcgggactttggagctgtgtcctgggacttcagcggcaccaccccaccaccccggggctggagcccccccctggcccctggctgctaccagctgctgctgtaccaggccggccgctgccagcccagcaactgccgccgctgccctggggcctaccgggccctgcggggcctgcggagcttcatgtctgccaacacctttggaaatgccggcttctctgtgctgctgcccggggcccggctggagggccgctgtggccccaccaatgcccgggtgcgctgccacctgggcctgaagatccccccaggctgtgagctggtggtgggcggggagccccagtgctgggccgagggccactgcctgctggtggatgacagcttcctgcacacagtggcccacaacggcagcccagaagatggcccccgggtggtgttcatcgtggacctgtggcaccccaacgtggccggggctgagcggcaggccctggactttgtgtttgccccagacccctag

SEQ ID NO: 32432 - DNA, 1173 bp, Artificial Sequence; identical to SEQ ID NO: 32431
  Description of Artificial Sequence: Synthetic coding sequence

SEQ ID NO: 32433 - DNA, 891 bp, Artificial Sequence
  Description of Artificial Sequence: Synthetic coding sequence
atggcccgctgtgagcggctgcggggggccgccctgagagatgtgctgggccgggcccagggcgtgctgtttgactgtgatggagtgctgtggaatggagagagagctgtgcctggggcccctgagctgctggagcggctggcccgggccggcaaggccgccctgtttgtgagcaacaacagccggcgggcccggcctgagctggccctgcgctttgcccggctgggctttggaggcctgcgggcagagcagctgttcagcagcgccctgtgtgccgcccggctgctgcggcagaggctgcccggccccccagatgcccctggagctgtgtttgtgctgggcggggagggcctgcgggcagagctgcgggctgctggcctgcggctggccggggaccccagcgctggagatggagctgccccccgggtgcgggctgtgctggtgggctatgatgagcacttctcctttgccaagctgcgggaggcctgtgcccacctgcgggaccctgagtgcctgctggtggccacagaccgggacccctggcaccccctgagtgatggcagcaggaccccaggcaccggcagcctggccgctgctgtggagacagccagcggccggcaggccctggtggtgggcaagcccagcccctacatgtttgagtgcatcacagagaacttcagcattgatcctgcccggaccctgatggtgggggaccggctggagacagacatcctgtttggccaccgctgtggcatgaccaccgtgctgaccctgactggagtgtcccggctggaggaggcccaggcctacctggccgccggccagcacgacctggtgccccactactacgtggagagcattgctgacctgacagagggcctggaggactag

SEQ ID NO: 32434 - DNA, 1506 bp, Artificial Sequence
  Description of Artificial Sequence: Synthetic coding sequence
atgcccagcgccagcgccagcaggaagagccaggagaagccccgggagatcatggatgctgctgaggactatgccaaggagagatatggcatcagctccatgatccagagccaggagaagccagacagagtgctggtgcgggtgcgggacctgaccatccagaaggcagatgaggtggtgtgggtgcgggcccgggtgcacaccagccgggccaagggcaagcagtgcttcctggtgctgcggcagcagcagttcaacgtgcaggccctggtggccgtgggggaccacgccagcaagcagatggtgaagtttgctgccaacatcaacaaggagagcatcgtggatgtggagggcgtggtgaggaaggtgaaccagaagattggcagctgcacccagcaggatgtggagctgcacgtgcagaagatctacgtgatcagcctggccgagccccggctgcccctgcagctggatgatgctgtgcggcctgaggccgagggggaggaggagggccgggccaccgtgaaccaggacacccggctggacaacagagtgattgacctgcggaccagcaccagccaggccgtgttccggctgcagagcggcatctgccacctgttccgggagaccctcatcaacaagggctttgtggagatccagacccccaagatcatctctgctgccagcgagggcggggccaacgtgttcaccgtgtcctacttcaagaacaatgcctacctggcccagagcccccagctgtacaagcagatgtgcatctgtgccgactttgagaaggtgttcagcatcggccctgtgttccgggcagaggacagcaacacccaccgccacctgacagaatttgtgggcctggacatcgagatggccttcaactaccactaccacgaggtgatggaggagattgctgacaccatggtgcagatcttcaagggcctgcaggagcgcttccagacagagatccagacagtgaacaagcagttcccctgtgagcccttcaagttcctggagcccaccctgcggctggagtactgtgaggccctggccatgctgcgggaggccggcgtggagatgggagatgaagatgacctgagcaccccaaatgagaagctgctgggccacctggtgaaggagaagtatgacacagacttctacatcctggacaagtaccccctggccgtgcggcccttctacaccatgccagaccccaggaaccccaagcagagcaacagctatgacatgttcatgagaggagaggagatcctgagcggggcccagagaattcatgacccccagctgctgacagagcgggccctgcaccacggcatcgacctggagaagatcaaggcctacatcgacagcttccgctttggagcccctcctcatgctgggggcggcatcggcctggagcgggtgaccatgctgttcctgggcctgcacaacgtgcggcagacctccatgttcccccgggaccccaagaggctgaccccctag

SEQ ID NO: 32435 - DNA, 1206 bp, Artificial Sequence
  Description of Artificial Sequence: Synthetic coding sequence
atggtgaagtttgctgccaacatcaacaaggagagcatcgtggatgtggagggcgtggtgaggaaggtgaaccagaagattggcagctgcacccagcaggatgtggagctgcacgtgcagaagatctacgtgatcagcctggccgagccccggctgcccctgcagctggatgatgctgtgcggcctgaggccgagggggaggaggagggccgggccaccgtgaaccaggacacccggctggacaacagagtgattgacctgcggaccagcaccagccaggccgtgttccggctgcagagcggcatctgccacctgttccgggagaccctcatcaacaagggctttgtggagatccagacccccaagatcatctctgctgccagcgagggcggggccaacgtgttcaccgtgtcctacttcaagaacaatgcctacctggcccagagcccccagctgtacaagcagatgtgcatctgtgccgactttgagaaggtgttcagcatcggccctgtgttccgggcagaggacagcaacacccaccgccacctgacagaatttgtgggcctggacatcgagatggccttcaactaccactaccacgaggtgatggaggagattgctgacaccatggtgcagatcttcaagggcctgcaggagcgcttccagacagagatccagacagtgaacaagcagttcccctgtgagcccttcaagttcctggagcccaccctgcggctggagtactgtgaggccctggccatgctgcgggaggccggcgtggagatgggagatgaagatgacctgagcaccccaaatgagaagctgctgggccacctggtgaaggagaagtatgacacagacttctacatcctggacaagtaccccctggccgtgcggcccttctacaccatgccagaccccaggaaccccaagcagagcaacagctatgacatgttcatgagaggagaggagatcctgagcggggcccagagaattcatgacccccagctgctgacagagcgggccctgcaccacggcatcgacctggagaagatcaaggcctacatcgacagcttccgctttggagcccctcctcatgctgggggcggcatcggcctggagcgggtgaccatgctgttcctgggcctgcacaacgtgcggcagacctccatgttcccccgggaccccaagaggctgaccccctag

SEQ ID NO: 32436 - DNA, 564 bp, Artificial Sequence
  Description of Artificial Sequence: Synthetic coding sequence
atgaccagccgggagcaccaggtgtccctgtgcaactgtgtgcccctgctgcggcggctgctgtgtgatgccccctggaggaaggcccggcccctgcacgccctgagccgctacttccgcagccgggtgagccccagcaagatggccgaggagccccagagcgtgctgcagctgcccaccagcattgctgctggaggagagggcctgacagatgtgtccccagagaccaccaccccagagccccccagcagcgctgctgtgtccccaggcacagaggagcctgctggggacaccaagaagaagattgacatcctgctgaaggctgtgggggacacccccatcatgaagaccaagaagtgggccgtggagaggaccaggaccatccagggcctgattgacttcatcaagaagttcctgaagctggtggccagcgagcagctgttcatctacgtgaaccagagctttgcccccagcccagaccaggaggtgggcaccctgtatgagtgcttcggcagtgatggcaagctggtgctgcactactgcaagagccaggcctggggctag

SEQ ID NO: 32437 - DNA, 225 bp, Artificial Sequence
  Description of Artificial Sequence: Synthetic coding sequence
atggccgaggagccccagagcgtgctgcagctgcccaccagcattgctgctggaggagagggcctgacagatgtgtccccagagaccaccaccccagagccccccagcagcgctgctgtgtccccaggcacagaggagcctgctggggacaccaagaagaagatctacctgtgtgagagcgtgctgtgcagcttcccccggcccaggtcctggaacagcctgtag

SEQ ID NO: 32438 - DNA, 423 bp, Artificial Sequence
  Description of Artificial Sequence: Synthetic coding sequence
atggccgaggagccccagagcgtgctgcagctgcccaccagcattgctgctggaggagagggcctgacagatgtgtccccagagaccaccaccccagagccccccagcagcgctgctgtgtccccaggcacagaggagcctgctggggacaccaagaagaagattgacatcctgctgaaggctgtgggggacacccccatcatgaagaccaagaagtgggccgtggagaggaccaggaccatccagggcctgattgacttcatcaagaagttcctgaagctggtggccagcgagcagctgttcatctacgtgaaccagagctttgcccccagcccagaccaggaggtgggcaccctgtatgaatgttttggaagtgatggcaagctggtgctgcactactgcaagagccaggcctggggctag

SEQ ID NO: 32439 - DNA, 1479 bp, Artificial Sequence
  Description of Artificial Sequence: Synthetic coding sequence
atggccagccccagcgggaaaggagcccgggccctggaggcccctggctgcggcccccggcccctggcccgggacctggtggacagcgtggatgatgctgagggcctgtatgtggccgtggagcgctgccccctgtgcaacaccacccggcggcggctgacctgtgccaagtgtgtgcagagcggggactttgtgtactttgatggccgggaccgggagcgcttcatcgacaagaaggagcggctgagccggctgaagagcaagcaggaggagttccagaaggaggtgctgaaggccatggagggcaagtggatcacagaccagctgcgctggaagatcatgagctgcaagatgagaattgagcagctgaagcagaccatctgcaagggaaatgaggagatggagaagaacagcgagggcctgctgaagaccaaggagaagaaccagaagctgtacagccgggcccagaggcaccaggagaagaaggagaagatccagaggcacaacaggaagctgggggacctggtggagaagaagaccatcgacctgcggagccactatgagcggctggccaacctgcggcgcagccacatcctggagctgaccagcgtcatcttccccatcgaggaggtgaagacaggagtgcgggaccctgcagatgtgtcctctgagagtgacagcgccatgaccagcagcacagtgtccaagctggccgaggcccggaggaccacctacctgagcggccgctgggtgtgtgatgaccacaacggggacaccagcatcagcatcaccggcccctggatcagcctgcccaacaatggagactacagcgcctactacagctgggtggaggagaagaagaccacccagggccctgacatggagcagagcaacccagcctacaccatctctgctgccctgtgctacgccacccagctggtgaacatcctgagccacatcctggatgtgaacctgcccaagaagctgtgcaacagcgagttctgtggggagaacctgagcaagcagaagttcaccagggctgtgaagaagctgaatgccaacatcctgtacctgtgcttcagccagcacgtgaacctggaccagctgcagcccctgcacaccctgaggaacctgatgtacctggtgagccccagcagcgagcacctgggccgcagcggcccctttgaggtgcgggctgacctggaggagagcatggagtttgtggaccccggggtggccggggagagtgatgaaagtggagatgagcgggtgtctgatgaggagacagacctgggcacagactgggagaacctgcccagcccccgcttctgtgacatccccagccagagcgtggaggtgtcccagagccagagcacccaggccagcccccccatcgccagcagcagcgctgggggcatgatcagcagcgctgctgcctctgtgacctcctggttcaaggcctacacaggccacaggtag

SEQ ID NO: 32440 - DNA, 828 bp, Artificial Sequence
  Description of Artificial Sequence: Synthetic coding sequence
atgacagatgacaaggatgtgctgagagatgtgtggtttggccgcatccccacctgcttcaccctgtaccaggatgagatcacagagcgggaggccgagccctactacctgctgctgccccgggtgtcctacctgaccctggtgacagacaaggtgaagaagcacttccagaaggtgatgaggcaggaggacatcagcgagatctggtttgaatatgagggcacccccctgaagtggcactaccccatcggcctgctgtttgacctgctggccagcagcagcgccctgccctggaacatcaccgtgcacttcaagagcttccctgagaaggacctgctgcactgccccagcaaggatgccatcgaggcccacttcatgagctgcatgaaggaggctgatgccctgaagcacaagagccaggtgatcaatgagatgcagaagaaggaccacaagcagctgtggatgggcctgcagaatgacagatttgaccagttctgggccatcaacaggaagctgatggagtacccagcagaagaaaatggcttccgctacatccccttccgcatctaccagaccaccacagagcggcccttcatccagaagctgttccggcctgtggccgcagatggccagctgcacaccctgggggacctgctgaaggaggtgtgccccagcgccattgatcctgaagatggagagaagaagaaccaggtgatgattcatggaattgagcccatgctggagacccccctgcagtggctgtctgagcacctgagctacccagacaacttcctgcacatcagcatcatcccccagcccacagactag

SEQ ID NO: 32441 - DNA, 276 bp, Artificial Sequence
  Description of Artificial Sequence: Synthetic coding sequence
atgacagatgacaaggatgtgctgagagatgtgtggtttggccgcatccccacctgcttcaccctgtaccaggatgagatcacagagcgggaggccgagccctactacacagacctgaccagctttggccccagcatcggcaacagctggaacatcctgcagaagaagatggactttgtgatcagccccctggagtacatccggcagaggctgaaggacctgtccttccgcagctgctttgtgctgtggctgcagatggacagctgcacccactag

SEQ ID NO: 32442 - DNA, 594 bp, Artificial Sequence
  Description of Artificial Sequence: Synthetic coding sequence
atgcactaccccatcggcctgctgtttgacctgctggccagcagcagcgccctgccctggaacatcaccgtgcacttcaagagcttccctgagaaggacctgctgcactgccccagcaaggatgccatcgaggcccacttcatgagctgcatgaaggaggctgatgccctgaagcacaagagccaggtgatcaatgagatgcagaagaaggaccacaagcagctgtggatgggcctgcagaatgacagatttgaccagttctgggccatcaacaggaagctgatggagtacccagcagaagaaaatggcttccgctacatccccttccgcatctaccagaccaccacagagcggcccttcatccagaagctgttccggcctgtggccgcagatggccagctgcacaccctgggggacctgctgaaggaggtgtgccccagcgccattgatcctgaagatggagagaagaagaaccaggtgatgattcatggaattgagcccatgctggagacccccctgcagtggctgtctgagcacctgagctacccagacaacttcctgcacatcagcatcatcccccagcccacagactag

SEQ ID NO: 32443 - DNA, 828 bp, Artificial Sequence; identical to SEQ ID NO: 32440
  Description of Artificial Sequence: Synthetic coding sequence

SEQ ID NO: 32444 - DNA, 384 bp, Artificial Sequence
  Description of Artificial Sequence: Synthetic coding sequence
atgtgctgtgctgtgtctgagcagaggctgacctgtgccgaccagatgatgccctttgggaagatcagccagcagctgtgtggggtgaagaagctgccctggagctgtgacagccgctacttctggggctggctgaatgctgtgttcaacaaggtggactatgaccgcatcagagatgtgggccctgacagagctgccagcgagtggctgctgcgctgtggggccatggtgcgctaccacggccaggagcgctggcagaaggactacaaccacctgcccaccggccccctggacaagtacaagatccaggccattgatgccacagacagctgcatcatgagcattggatttgaccacatggagaccagcaacatctgctgctag

SEQ ID NO: 32445 - DNA, 411 bp, Artificial Sequence
  Description of Artificial Sequence: Synthetic coding sequence
atgtgctgtgctgtgtctgagcagaggctgacctgtgccgaccagatgatgccctttgggaagatcagccagcagctgtgtggggtgaagaagctgccctggagctgtgacagccgctacttctggggctggctgaatgctgtgttcaacaaggtggactatgaccgcatcagagatgtgggccctgacagagctgccagcgagtggctgctgcgctgtggggccatggtgcgctaccacggccaggagcgctggcagaaggactacaaccacctgcccaccggccccctggacaagtacaagatccaggccattgatgccacagacagctgcatcatgagcattggatttgaccacatgggcaactaccccatcgtgctgctgattgaaaatgctgatgacctgcagtag

SEQ ID NO: 32446 - DNA, 783 bp, Artificial Sequence
  Description of Artificial Sequence: Synthetic coding sequence
atggctgctgtggtggtggccgctgctggaggagctggccctgctgtgctgcaggtggccggcctgtaccggggcctgtgtgctgtgcgcagccgggccctgggcctgggcctggtgtccccagcccagctgcgggtcttccctgtgcggcccggcagcggccggcctgagggcggcgctgacagcagtggagtgggcgctgaggccgagctgcaggccaaccccttctatgaccgctacagagacaagatccagctgctgcggcggagtgaccctgctgcctttgagagccggctggagaagaggtctgagttcaggaagcagcctgtgggccacagccggcagggcgacttcatcaagtgtgtggagcagaagacagatgccctgggcaagcagagcgtgaacagaggcttcaccaaggacaagaccctgagcagcatcttcaacatcgagatggtgaaggagaagacagctgaggagatcaagcagatctggcagcagtactttgctgccaaggacacagtgtatgctgtgatcccagctgagaagtttgacctgatctggaacagagcccagagctgccccaccaacgtggccgaggcccagtgcatcgccaaccaggtgcagctgttctacgccacagacaggaaggagacctacggcctggtggagaccttcaacctgcggcccaatgagttcaagtacatgtctgtgattgctgagctggagcagagcggcctgggcgctgagctgaagtgtgcccagaaccagaacaagacctag

SEQ ID NO: 32447 - DNA, 987 bp, Artificial Sequence
  Description of Artificial Sequence: Synthetic coding sequence
atggctgctgtggtggtggccgctgctggaggagctggccctgctgtgctgcaggtggccggcctgtaccggggcctgtgtgctgtgcgcagccgggccctgggcctgggcctggtgtccccagcccagctgcgggtcttccctgtgcggcccggcagcggccggcctgagggcggcgctgacagcagtggagtgggcgctgaggccgagctgcaggccaaccccttctatgaccgctacagagacaagatccagctgctgcggcggagtgaccctgctgcctttgagagccggctggagaagaggtctgagttcaggaagcagcctgtgggccacagccggcagggcgacttcatcaagtgtgtggagcagaagacagatgccctgggcaagcagagcgtgaacagaggcttcaccaaggacaagaccctgagcagcatcttcaacatcgagatggtgaaggagaagacagctgaggagatcaagcagatctggcagcagtactttgctgccaaggacacagtgtatgctgtgatcccagctgagaagtttgacctgatctggaacagagcccagagctgccccaccttcctgtgtgccctgccccggcgggagggctatgagttctttgtgggccagtggacaggaacagagctgcacttcaccgccctgatcaacatccagaccagaggagaggccgccgccagccagctgatcctgtaccactacccagagctgaaggaggagaagggcatcgtgctgatgacagctgagatggacagcaccttcctgaatgtggccgaggcccagtgcatcgccaaccaggtgcagctgttctacgccacagacaggaaggagacctacggcctggtggagaccttcaacctgcggcccaatgagttcaagtacatgtctgtgattgctgagctggagcagagcggcctgggcgctgagctgaagtgtgcccagaaccagaacaagacctag

SEQ ID NO: 32448 - DNA, 723 bp, Artificial Sequence
  Description of Artificial Sequence: Synthetic coding sequence
atgtctgaccctgctgcctttgagagccggctggagaagaggtctgagttcaggaagcagcctgtgggccacagccggcagggcgacttcatcaagtgtgtggagcagaagacagatgccctgggcaagcagagcgtgaacagaggcttcaccaaggacaagaccctgagcagcatcttcaacatcgagatggtgaaggagaagacagctgaggagatcaagcagatctggcagcagtactttgctgccaaggacacagtgtatgctgtgatcccagctgagaagtttgacctgatctggaacagagcccagagctgccccaccttcctgtgtgccctgccccggcgggagggctatgagttctttgtgggccagtggacaggaacagagctgcacttcaccgccctgatcaacatccagaccagaggagaggccgccgccagccagctgatcctgtaccactacccagagctgaaggaggagaagggcatcgtgctgatgacagctgagatggacagcaccttcctgaatgtggccgaggcccagtgcatcgccaaccaggtgcagctgttctacgccacagacaggaaggagacctacggcctggtggagaccttcaacctgcggcccaatgagttcaagtacatgtctgtgattgctgagctggagcagagcggcctgggcgctgagctgaagtgtgcccagaaccagaacaagacctag

SEQ ID NO: 32449 - DNA, 534 bp, Artificial Sequence
  Description of Artificial Sequence: Synthetic coding sequence
atggtgaaggagaagacagctgaggagatcaagcagatctggcagcagtactttgctgccaaggacacagtgtatgctgtgatcccagctgagaagtttgacctgatctggaacagagcccagagctgccccaccttcctgtgtgccctgccccggcgggagggctatgagttctttgtgggccagtggacaggaacagagctgcacttcaccgccctgatcaacatccagaccagaggagaggccgccgccagccagctgatcctgtaccactacccagagctgaaggaggagaagggcatcgtgctgatgacagctgagatggacagcaccttcctgaatgtggccgaggcccagtgcatcgccaaccaggtgcagctgttctacgccacagacaggaaggagacctacggcctggtggagaccttcaacctgcggcccaatgagttcaagtacatgtctgtgattgctgagctggagcagagcggcctgggcgctgagctgaagtgtgcccagaaccagaacaagacctag

SEQ ID NO: 32450 - DNA, 138 bp, Artificial Sequence
  Description of Artificial Sequence: Synthetic coding sequence
atgtctgaccctgctgcctttgagagccggctggagaagaggtctgagttcaggaagcagcctgtgggccacagccggcagggcgacttcatcaagtgtgtggagcagaaggatggagcccagaacaagctggtgtag

SEQ ID NO: 32451 - DNA, 783 bp, Artificial Sequence; identical to SEQ ID NO: 32446
  Description of Artificial Sequence: Synthetic coding sequence

SEQ ID NO: 32452 - DNA, 207 bp, Artificial Sequence
  Description of Artificial Sequence: Synthetic coding sequence
atgccccagctgaacaccaccgtgtggcccaccatgatcacccccatgctgctgaccctcttcctgatcacccagctgaagatgctgaacaccaactaccacctgccccccagccccaagcccatgaagatgaagaactacaacaagccctgggagcccaagtggaccaagatctgcagcctgcacagcctgcccccccagagctag

SEQ ID NO: 32453 - DNA, 642 bp, Artificial Sequence
  Description of Artificial Sequence: Synthetic coding sequence
atggccccagcccagaggcccctgctgcccctgctgctgctgctgctgcccctgcccccacctccatttgcccgggcagaagatgctgcccgggccaacagcgacagatatgctgtgtactggaacagaagcaacccccgcttccacgccggggctggagatgatggcggcggctacacagtggaggtgtccatcaatgactacctggacatctactgcccccactacggggcccccctgcccccagctgagaggatggagcactacgtgctgtacatggtgaatggagagggccacgccagctgtgaccaccggcagaggggcttcaagcgctgggagtgcaacagacctgctgcccctgggggccccctgaagttcagcgagaagttccagctgttcacccccttcagcctgggctttgagttccggcccggccacgagtactactacatcagcgccaccccaccaaatgctgtggaccggccctgcctgcggctgaaggtgtatgtgcggcccaccaatgagaccctgtatgaggcccctgagcccatcttcaccagcaacaacagctgcagcagccctgggggctgccgcctcttcctgagcaccatccctgtgctgtggaccctgctgggcagctag

SEQ ID NO: 32454 - DNA, 507 bp, Artificial Sequence
  Description of Artificial Sequence: Synthetic coding sequence
atgctgcctgctgccctgctgcggcggcccggcctgggccgcctggtgagacatgcccgggcctatgcagaggccgctgctgccccagctgctgccagcggccccaaccagatgtccttcacctttgccagccccacccaggtgttcttcaatggagccaacgtgcggcaggtggatgtgcccaccctgaccggggccttcggcatcctggccgcccacgtgcccaccctgcaggtgctgcggcccggcctggtggtggtgcatgctgaagatggcaccaccagcaagtactttgtgagcagcggcagcattgctgtgaatgctgacagctctgtgcagctgctggccgaggaggccgtgaccctggacatgctggacctgggcgccgccaaggccaacctggagaaggcccaggccgagctggtgggcacagcagatgaggccaccagggctgagatccagatcagaattgaggccaatgaggccctggtgaaggccctggagtag

SEQ ID NO: 32455 - DNA, 156 bp, Artificial Sequence
  Description of Artificial Sequence: Synthetic coding sequence
atggtggcctactggaggcaggccggcctgagctacatccgctacagccagatctgtgccaaggtggtgagagatgccctgaagacagagttcaaggccaatgccaagaagaccagcggcaacagcgtgaagatcgtgaaggtgaagaaggagtag

SEQ ID NO: 32456 - DNA, 771 bp, Artificial Sequence
  Description of Artificial Sequence: Synthetic coding sequence
atgctgagccgggtggtgctgtctgctgctgccacagctgcccccagcctgaagaatgctgccttcctgggccctggggtgctgcaggccaccaggaccttccacacaggccagccccacctggtgcctgtgccccccctgcctgaatatggaggcaaggtgcgctatggcctcatccctgaggagttcttccagttcctgtaccccaagacaggagtgacaggcccctacgtgctgggcaccggcctcatcctgtatgccctgagcaaggagatctacgtgatctctgctgagaccttcaccgccctgtctgtgctgggcgtgatggtgtatggcatcaagaagtatggcccctttgtggccgactttgctgacaagctgaatgagcagaagctggcccagctggaggaggccaagcaggccagcatccagcacatccagaatgccatcgacacagagaagagccagcaggccctggtgcagaagaggcactacctgtttgatgtgcagaggaacaacatcgccatggccctggaggtgacctaccgggagcggctgtacagagtgtacaaggaggtgaagaaccggctggactaccacatctctgtgcagaacatgatgaggaggaaggagcaggagcacatgatcaactgggtggagaagcacgtggtgcagagcatcagcacccagcaggagaaggagaccatcgccaagtgcatcgctgacctgaagctgctggccaagaaggcccaggcccagcctgtgatgtag

SEQ ID NO: 32457 - DNA, 588 bp, Artificial Sequence
  Description of Artificial Sequence: Synthetic coding sequence
atgctgagccgggtggtgctgtctgctgctgccacagctggcccctacgtgctgggcaccggcctcatcctgtatgccctgagcaaggagatctacgtgatctctgctgagaccttcaccgccctgtctgtgctgggcgtgatggtgtatggcatcaagaagtatggcccctttgtggccgactttgctgacaagctgaatgagcagaagctggcccagctggaggaggccaagcaggccagcatccagcacatccagaatgccatcgacacagagaagagccagcaggccctggtgcagaagaggcactacctgtttgatgtgcagaggaacaacatcgccatggccctggaggtgacctaccgggagcggctgtacagagtgtacaaggaggtgaagaaccggctggactaccacatctctgtgcagaacatgatgaggaggaaggagcaggagcacatgatcaactgggtggagaagcacgtggtgcagagcatcagcacccagcaggagaaggagaccatcgccaagtgcatcgctgacctgaagctgctggccaagaaggcccaggcccagcctgtgatgtag

SEQ ID NO: 32458 - DNA, 486 bp, Artificial Sequence
  Description of Artificial Sequence: Synthetic coding sequence
atggccggcaggaagctggccctgaagaccatcgactgggtggcctttgctgagatcatcccccagaaccagaaggccatcgccagcagcctgaagtcctggaatgagaccctgaccagccggctggccgccctgcctgaaaatcctccagccatcgactgggcctactacaaggccaacgtggccaaggccggcctggtggatgactttgagaagaagttcaatgccctgaaggtgcctgtgcctgaggacaagtacacagcccaggtggatgctgaggagaaggaggatgtgaagagctgtgccgagtgggtgtccctgagcaaggcccgcatcgtggagtatgagaaggagatggagaagatgaagaacctgatcccctttgaccagatgaccatcgaggacctgaatgaggccttccctgagaccaagctggacaagaagaagtacccctactggccccaccagcccatcgagaacctgtag

SEQ ID NO: 32459 - DNA, 414 bp, Artificial Sequence
  Description of Artificial Sequence: Synthetic coding sequence
atggccggcaggaagctggccctgaagaccatcgactgggtggcctttgctgagatcatcccccagaaccagaaggccatcgccagcagcctgaagtcctggaatgagaccctgaccagccggctggccgccctgcctgaaaatcctccagccatcgactgggcctactacaaggccaacgtggccaaggccggcctggtggatgactttgagaagaaggtgaagagctgtgccgagtgggtgtccctgagcaaggcccgcatcgtggagtatgagaaggagatggagaagatgaagaacctgatcccctttgaccagatgaccatcgaggacctgaatgaggccttccctgagaccaagctggacaagaagaagtacccctactggccccaccagcccatcgagaacctgtag

SEQ ID NO: 32460 - DNA, 309 bp, Artificial Sequence
  Description of Artificial Sequence: Synthetic coding sequence
atggccggcaggaagctggccctgaagaccatcgactgggtggcctttgctgagatcatcccccagaaccagaaggccatcgccagcagcctgaagtcctggaatgagaccctgaccagccggctggccgccctgcctgaaaatcctccagccatcgactgggcctactacaaggccaacgtggccaaggccggcctggtggatgactttgagaagaagttcaatgccctgaaggtgcctgtgcctgaggacaagtacacagcccaggtggatgctgaggagaaggaggacaagaagaagaagaagtag

SEQ ID NO: 32461 - DNA, 285 bp, Artificial Sequence
  Description of Artificial Sequence: Synthetic coding sequence
atggcctctgtgggggagtgcccagcccctgtgcctgtgaaggacaagaagctgctggaggtgaagctgggggagctgcccagctggatcctgatgagggacttcagccccagcggcatctttggagccttccagaggggctactaccgctactacaacaagtacatcaacgtgaagaagggcagcatcagcggcatcaccatggtgctggcctgctacgtgctcttctcctacagcttctcctacaagcacctgaagcatgagcggctgaggaagtaccactag

SEQ ID NO: 32462 - DNA, 168 bp, Artificial Sequence
  Description of Artificial Sequence: Synthetic coding sequence
atggcctctgtgggggagtgcccagcccctgtgcctgtgaaggacaagaagctgctggaggtgaagctgggggagctgcccagctggatcctgatgagggacttcagccccagcggcatctttggagccttccagcgggagcacgagcggctgaggaagtaccactag

SEQ ID NO: 32463 - DNA, 267 bp, Artificial Sequence
  Description of Artificial Sequence: Synthetic coding sequence
atggcctctgtggtgcctgtgaaggacaagaagctgctggaggtgaagctgggggagctgcccagctggatcctgatgagggacttcagccccagcggcatctttggagccttccagaggggctactaccgctactacaacaagtacatcaacgtgaagaagggcagcatcagcggcatcaccatggtgctggcctgctacgtgctcttctcctacagcttctcctacaagcacctgaagcatgagcggctgaggaagtaccactag

SEQ ID NO: 32464 - DNA, 150 bp, Artificial Sequence
  Description of Artificial Sequence: Synthetic coding sequence
atggcctctgtggtgcctgtgaaggacaagaagctgctggaggtgaagctgggggagctgcccagctggatcctgatgagggacttcagccccagcggcatctttggagccttccagcgggagcacgagcggctgaggaagtaccactag

SEQ ID NO: 32465 - DNA, 267 bp, Artificial Sequence
  Description of Artificial Sequence: Synthetic coding sequence
atgagcagcaagctgcctgtgaaggacaagaagctgctggaggtgaagctgggggagctgcccagctggatcctgatgagggacttcagccccagcggcatctttggagccttccagaggggctactaccgctactacaacaagtacatcaacgtgaagaagggcagcatcagcggcatcaccatggtgctggcctgctacgtgctcttctcctacagcttctcctacaagcacctgaagcatgagcggctgaggaagtaccactag

SEQ ID NO: 32466 - DNA, 312 bp, Artificial Sequence
  Description of Artificial Sequence: Synthetic coding sequence
atggcccagtttgtgaggaacctggtggagaagaccccagccctggtgaatgctgctgtgacctacagcaagccccggctggccaccttctggtactatgccaaggtggagctggtgccccccaccccagctgagatcccccgggccatccagagcctgaagaagatcgtgaacagcgcccagacaggcagcttcaagcagctgactgtgaaggaggccgtgctgaatggcctggtggccacagaggtgctgatgtggttctacgtgggggagatcatcggcaagaggggcatcatcggctatgatgtgtag

SEQ ID NO: 32467 - DNA, 303 bp, Artificial Sequence
  Description of Artificial Sequence: Synthetic coding sequence
atggccccctttgtgaggaacctggtggagaagaccccagccctggtgaatgctgctgtgacctacctgaagccccggctggccgccttctggtactacaccaccgtggagctggtgccccccaccccagctgagatcccccgggccatccagagcctgaagaagatcgtgtcctctgcccagacaggcagcttcaagcagctgactgtgaaggaggccctgctgaatggcctggtggccacagaggtgtccacctggttctacgtgcgggagatcaccgggaagaggggcatcattggatag

SEQ ID NO: 32468 - DNA, 648 bp, Artificial Sequence
  Description of Artificial Sequence: Synthetic coding sequence
atgtgctgtgctgtgtctgagcagaggctgacctgtgccgaccagatgatgccctttgggaagatcagccagcagctgtgtggggtgaagaagctgccctggagctgtgacagccgctacttctggggctggctgaatgctgtgttcaacaaggtggactatgaccgcatcagagatgtgggccctgacagagctgccagcgagtggctgctgcgctgtggggccatggtgcgctaccacggccaggagcgctggcagaaggactacaaccacctgcccaccggccccctggacaagtacaagatccaggccattgatgccacagacagctgcatcatgagcattggatttgaccacatggagggcctggagcacgtggagaagatccggctgtgcaagtgccactacattgaagatgactgcctgctgcggctgagccagctggagaacctgcagaagaccatcctggagatggagatcatcagctgtggcaacatcacagacaagggcatcatcgccctgcggcacctgaggaacctgaagtacctgctgctgagtgacctgcccggggtgcgggagaaggagaacctggtgcaggccttcaagacagccctgcccagcctggagctgaagctgcagctgaagtag

SEQ ID NO: 32469 - DNA, 801 bp, Artificial Sequence
  Description of Artificial Sequence: Synthetic coding sequence
atgatccggggcagcggggctgaggcctgcagcaatgaagatggctgcagcgagaagggcatgaagggcgtggactatgaccgcatcagagatgtgggccctgacagagctgccagcgagtggctgctgcgctgtggggccatggtgcgctaccacggccaggagcgctggcagaaggactacaaccacctgcccaccggccccctggacaagtacaagatccaggccattgatgccacagacagctgcatcatgagcattggatttgaccacatggagggcctggagcacgtggagaagatccggctgtgcaagtgccactacattgaagatgactgcctgctgcggctgagccagctggagaacctgcagaagaccatcctggagatggagatcatcagctgtggcaacatcacagacaagggcatcatcgccctgcggcacctgaggaacctgaagtacctgctgctgagtgacctgcctggagctggcaaccctggcccctgtgtggccagcggcagcagcaggacccgggcccccctgggcttccgggagcggggcctgcaggagacagatgtgcctggggccctggtggacaggagctatgacctgagccccagcgctggcatgaggatgctggagctgaaggccaccacagccatcctgaagagccgcttccagctgtctgtgcctgggggcagcctgctcttcaagcagagccctgtgggccacagcagcatctccttctggccctacaaggccatcctgcggcagagcagagctggggacaaccaggagtag

SEQ ID NO: 32470 - DNA, 444 bp, Artificial Sequence
  Description of Artificial Sequence: Synthetic coding sequence
atggccggccggggcaagctgattgctgtgattggagatgaggacacagtgacaggcttcctgctgggcggcattggagagctgaacaagaacagacaccccaacttcctggtggtggagaaggacaccaccatcaatgaaattgaggacaccttccgcagcctgggcagcctgcccggctctgtggtggaggccaaccccaaccagagggacccccccctgtgggatgaaattgacagccggcagttcctgaacagagatgacatcggcatcatcctgatcaaccagtacatcgccgagatggtgagacatgccctggatgcccaccagcagagcatcccagctgtgctggagatccccagcaaggagcacccctatgatgctgccaaggacagcatcctgcggcgggcccggggcatgttcaccgctgaggacctgaggtag

SEQ ID NO: 32471 - DNA, 321 bp, Artificial Sequence
  Description of Artificial Sequence: Synthetic coding sequence
atggctgtgacagccctggccgcccggacctggctgggcgtgtggggcgtgaggaccatgcaggcccggggctttggaagtgaccagagtgaaaatgtggacagaggagctggcagcatccgggaggccggcggggccttcggcaagcgggagcaggccgaggaggagcgctacttccgggcccagagccgggagcagctggccgccctgaagaagcaccacgaggaggagatcgtgcaccacaagaaggagattgagcggctgcagaaggagattgaaagacacaagcagaagatcaagatgctgaagcatgatgactag

SEQ ID NO: 32472 - DNA, 183 bp, Artificial Sequence
  Description of Artificial Sequence: Synthetic coding sequence
atggctgtgacagccctggccgcccggacctggctgggcgtgtggggcgtgaggaccatgcaggcccggggctttggaagtgaccagagtgaaaatgtggacagaggagctggcagcatccgggaggccggcggggccttcggcaagcgggagcaggccgaggaggagcgctacttcagatag

SEQ ID NO: 32473 - DNA, 216 bp, Artificial Sequence
  Description of Artificial Sequence: Synthetic coding sequence
atggctgtgacagccctggccgcccggacctggctgggcgtgtggggcgtgaggaccatgcaggcccggggctttggaagtgaccagagtgaaaatgtggacagaggagctggcagcatccgggaggccggcggggccttcggcaagcgggagcaggccgaggaggagcgctacttccgccactaccgcctgtgctttgagatcagcctgggctag

SEQ ID NO: 32474 - DNA, 3261 bp, Artificial Sequence
  Description of Artificial Sequence: Synthetic coding sequence
atggagaagtgggaggagctgaacagccaccagcccggggaggagtatgaccccagcaaggccacctttgtgaaggtggtgcccacccccaacaacggcagcacagagctggtggccctgcacagaaatgaaggagaagatggcctggaggtgctgagctttgagttccagaagatcaagtacagctatgatgccctggagaagaagcagttcctgcctgtggccttccctgtgggcaatgccttctcctactaccagagcaacagaggcttccaggaggacagcgagatccgggctgctgagaagaagtttggcagcaacaaggccgagatggtggtgcctgacttcagcgagctgttcaaggagcgggccacagcccccttctttgtgttccaggtgttctgtgtgggcctgtggtgcctggatgagtactggtactacagcgtcttcaccctgtccatgctggtggcctttgaggccagcctggtgcagcagcagatgaggaacatgtctgagatcaggaagatgggcaacaagccccacatgatccaggtgtaccgcagcaggaagtggaggcccatcgccagtgatgaaattgtgcctggggacatcgtgtccatcggccgcagcccccaggagaacctggtgccctgtgatgtgctgctgctgcggggccgctgcatcgtggatgaggccatgctgactggagagagcgtgccccagatgaaggagcccatcgaggacctgagcccagacagagtgctggacctgcaggccgacagccggctgcacgtgatctttggaggcaccaaggtggtgcagcacatccccccccagaaggccaccaccggcctgaagcctgtggacagcggctgtgtggcctacgtgctgaggacaggcttcaacaccagccagggcaagctgctgcggaccatcctgtttggagtgaagagggtgacagccaacaacctggagaccttcatcttcatcctcttcctgctggtgtttgccatcgctgctgctgcctacgtgtggattgagggcaccaaggaccccagcaggaaccgctacaagctgttcctggagtgcaccctcatcctgacctctgtggtgcccccagagctgcccatcgagctgagcctggccgtgaacaccagcctcatcgccctggccaagctgtacatgtactgcacagagcccttccgcatcccctttgctgggaaggtggaggtgtgctgctttgacaagacaggcaccctgaccagtgacagcctggtggtgcggggcgtggccggcctgagagatggcaaggaggtgacccctgtgagcagcatccctgtggagacccaccgggccctggccagctgccacagcctgatgcagctggatgatggcaccctggtgggggaccccctggagaaggccatgctgacagctgtggactggaccctgaccaaggatgagaaggtgttccccaggagcatcaagacccagggcctgaagatccaccagcgcttccactttgccagcgccctgaagaggatgtctgtgctggccagctatgagaagctgggcagcacagacctgtgctacatcgctgctgtgaagggggcccctgagaccctgcacagcatgttcagccagtgccccccagactaccaccacatccacacagagatcagccgggagggcgcccgggtgctggccctgggctacaaggagctgggccacctgacccaccagcaggcccgggaggtgaagcgggaggccctggagtgcagcctgaagtttgtgggcttcatcgtggtgtcctgccccctgaaggctgacagcaaggctgtgatccgggagatccagaatgccagccaccgggtggtgatgatcactggagacaaccccctgacagcctgccacgtggcccaggagctgcacttcatcgagaaggcccacaccctcatcctgcagccccccagcgagaagggccggcagtgtgagtggaggagcattgatggcagcatcgtgctgcccctggcccggggcagccccaaggccctggccctggagtatgccctgtgcctgactggagatggcctggcccacctgcaggccacagacccccagcagctgctgcggctcatcccccacgtgcaggtgtttgcccgggtggcccccaagcagaaggagtttgtgatcaccagcctgaaggagctgggctacgtgaccctgatgtgtggagatggcaccaatgatgtgggcgccctgaagcatgctgatgtgggcgtggccctgctggccaatgcccctgagcgggtggtggagaggagaagaagaccccgggacagccccaccctgagcaacagcggcatccgggccaccagcaggacagccaagcagaggagcggcctgcccccatctgaggagcagcccaccagccagagggaccggctgagccaggtgctgcgggacctggaggatgagagcacccccatcgtgaagctgggagatgccagcattgctgcccccttcaccagcaagctgagcagcatccagtgcatctgccacgtgatcaagcagggccgctgcaccctggtgaccaccctgcagatgttcaagatcctggccctgaatgccctgatcctggcctacagccagagcgtgctgtacctggagggcgtgaagttcagtgacttccaggccaccctgcagggcctgctgctggccggctgcttcctgttcatcagccgcagcaagcccctgaagaccctgagccgggagcggcccctgcccaacatcttcaacctgtacaccatcctgactgtgatgctgcagttctttgtgcacttcctgagcctggtgtacctgtaccgggaggcccaggcccggagccctgagaagcaggagcagtttgtggacctgtacaaggagtttgagcccagcctggtgaacagcacagtgtacatcatggccatggccatgcagatggccacctttgccatcaactacaagggcccccccttcatggagagcctgcctgagaacaagcccctggtgtggagcctggccgtgtccctgctggccatcatcggcctgctgctgggcagcagcccagacttcaacagccagtttggcctggtggacatccctgtggagttcaagctggtgattgcccaggtgctgctgctggacttctgcctggccctgctggccgacagagtgctgcagttcttcctgggcacccccaagctgaaggtgcccagctag

SEQ ID NO: 32475 - DNA, 3615 bp, Artificial Sequence
  Description of Artificial Sequence: Synthetic coding sequence
atggctgctgctgctgctgtgggcaatgctgtgccctgtggggcccggccctgtggggtgcggccagatggccagcccaagccaggcccccagccccgggccctgctggccgccggccctgccctgattgccaatggagatgagctggtggccgctgtgtggccctacagaaggctggccctgctgcggcggctgactgtgctgccctttgctggcctgctgtacccagcctggctgggcgctgctgctgctggctgctggggctggggcagctcctgggtgcagatccctgaggccgccctgctggtgctggccaccatctgcctggcccacgccctgactgtgctgagcggccactggagcgtgcacgcccactgtgccctgacctgcaccccagaatatgaccccagcaaggccacctttgtgaaggtggtgcccacccccaacaacggcagcacagagctggtggccctgcacagaaatgaaggagaagatggcctggaggtgctgagctttgagttccagaagatcaagtacagctatgatgccctggagaagaagcagttcctgcctgtggccttccctgtgggcaatgccttctcctactaccagagcaacagaggcttccaggaggacagcgagatccgggctgctgagaagaagtttggcagcaacaaggccgagatggtggtgcctgacttcagcgagctgttcaaggagcgggccacagcccccttctttgtgttccaggtgttctgtgtgggcctgtggtgcctggatgagtactggtactacagcgtcttcaccctgtccatgctggtggcctttgaggccagcctggtgcagcagcagatgaggaacatgtctgagatcaggaagatgggcaacaagccccacatgatccaggtgtaccgcagcaggaagtggaggcccatcgccagtgatgaaattgtgcctggggacatcgtgtccatcggccgcagcccccaggagaacctggtgccctgtgatgtgctgctgctgcggggccgctgcatcgtggatgaggccatgctgactggagagagcgtgccccagatgaaggagcccatcgaggacctgagcccagacagagtgctggacctgcaggccgacagccggctgcacgtgatctttggaggcaccaaggtggtgcagcacatccccccccagaaggccaccaccggcctgaagcctgtggacagcggctgtgtggcctacgtgctgaggacaggcttcaacaccagccagggcaagctgctgcggaccatcctgtttggagtgaagagggtgacagccaacaacctggagaccttcatcttcatcctcttcctgctggtgtttgccatcgctgctgctgcctacgtgtggattgagggcaccaaggaccccagcaggaaccgctacaagctgttcctggagtgcaccctcatcctgacctctgtggtgcccccagagctgcccatcgagctgagcctggccgtgaacaccagcctcatcgccctggccaagctgtacatgtactgcacagagcccttccgcatcccctttgctgggaaggtggaggtgtgctgctttgacaagacaggcaccctgaccagtgacagcctggtggtgcggggcgtggccggcctgagagatggcaaggaggtgacccctgtgagcagcatccctgtggagacccaccgggccctggccagctgccacagcctgatgcagctggatgatggcaccctggtgggggaccccctggagaaggccatgctgacagctgtggactggaccctgaccaaggatgagaaggtgttccccaggagcatcaagacccagggcctgaagatccaccagcgcttccactttgccagcgccctgaagaggatgtctgtgctggccagctatgagaagctgggcagcacagacctgtgctacatcgctgctgtgaagggggcccctgagaccctgcacagcatgttcagccagtgccccccagactaccaccacatccacacagagatcagccgggagggcgcccgggtgctggccctgggctacaaggagctgggccacctgacccaccagcaggcccgggaggtgaagcgggaggccctggagtgcagcctgaagtttgtgggcttcatcgtggtgtcctgccccctgaaggctgacagcaaggctgtgatccgggagatccagaatgccagccaccgggtggtgatgatcactggagacaaccccctgacagcctgccacgtggcccaggagctgcacttcatcgagaaggcccacaccctcatcctgcagccccccagcgagaagggccggcagtgtgagtggaggagcattgatggcagcatcgtgctgcccctggcccggggcagccccaaggccctggccctggagtatgccctgtgcctgactggagatggcctggcccacctgcaggccacagacccccagcagctgctgcggctcatcccccacgtgcaggtgtttgcccgggtggcccccaagcagaaggagtttgtgatcaccagcctgaaggagctgggctacgtgaccctgatgtgtggagatggcaccaatgatgtgggcgccctgaagcatgctgatgtgggcgtggccctgctggccaatgcccctgagcgggtggtggagaggagaagaagaccccgggacagccccaccctgagcaacagcggcatccgggccaccagcaggacagccaagcagaggagcggcctgcccccatctgaggagcagcccaccagccagagggaccggctgagccaggtgctgcgggacctggaggatgagagcacccccatcgtgaagctgggagatgccagcattgctgcccccttcaccagcaagctgagcagcatccagtgcatctgccacgtgatcaagcagggccgctgcaccctggtgaccaccctgcagatgttcaagatcctggccctgaatgccctgatcctggcctacagccagagcgtgctgtacctggagggcgtgaagttcagtgacttccaggccaccctgcagggcctgctgctggccggctgcttcctgttcatcagccgcagcaagcccctgaagaccctgagccgggagcggcccctgcccaacatcttcaacctgtacaccatcctgactgtgatgctgcagttctttgtgcacttcctgagcctggtgtacctgtaccgggaggcccaggcccggagccctgagaagcaggagcagtttgtggacctgtacaaggagtttgagcccagcctggtgaacagcacagtgtacatcatggccatggccatgcagatggccacctttgccatcaactacaagggcccccccttcatggagagcctgcctgagaacaagcccctggtgtggagcctggccgtgtccctgctggccatcatcggcctgctgctgggcagcagcccagacttcaacagccagtttggcctggtggacatccctgtggagttcaagctggtgattgcccaggtgctgctgctggacttctgcctggccctgctggccgacagagtgctgcagttcttcctgggcacccccaagctgaaggtgcccagctag

SEQ ID NO: 32476 - DNA, 3681 bp, Artificial Sequence
  Description of Artificial Sequence: Synthetic coding sequence
atggaccgggaggagaggaagaccatcaaccagggccaggaggatgagatggagatctacggctacaacctgagccgctggaagctggccatcgtgtccctgggcgtcatctgcagcggcggcttcctgctgctgctgctgtactggatgcctgagtggagggtgaaggccacctgtgtgcgggccgccatcaaggactgtgaggtggtgctgctgcggaccacagatgagttcaagatgtggttctgtgccaagatccgggtgctgagcctggagacctaccctgtgagcagccccaagtccatgagcaacaagctgagcaatggacatgctgtgtgcctgattgagaaccccacagaagaaaatagacaccgcatcagcaagtacagccagacagagagccagcagatccgctacttcacccaccacagcgtgaagtacttctggaatgacaccatccacaactttgacttcctgaagggcctggatgaaggagtgtcctgcaccagcatctatgagaagcacagcgctggcctgaccaagggcatgcacgcctacaggaagctgctgtatggagtgaatgaaattgctgtgaaggtgcccagcgtcttcaagctgctgatcaaggaggtgctgaaccccttctacatcttccagctgttcagcgtcatcctgtggagcacagatgagtactactactatgccctggccatcgtggtgatgagcatcgtgtccatcgtgagcagcctgtacagcatcaggaagcagtatgtgatgctgcatgacatggtggccacccacagcacagtgcgggtgtctgtgtgccgggtgaatgaggagattgaggagatcttcagcacagacctggtgcctggagatgtgatggtgatccccctgaatggcaccatcatgccctgtgatgctgtgctgatcaatggcacctgcatcgtgaatgaatccatgctgactggagagagcgtgcctgtgaccaagaccaacctgcccaaccccagcgtggatgtgaagggcattggagatgagctgtacaaccctgagacccacaagaggcacaccctcttctgtggcaccaccgtcatccagacccgcttctacaccggggagctggtgaaggccatcgtggtgaggacaggcttcagcaccagcaagggccagctggtgcgcagcatcctgtaccccaagcccacagacttcaagctgtacagagatgcctacctgttcctgctgtgcctggtggccgtggccggcatcggcttcatctacaccatcatcaacagcatcctgaatgaggtgcaggtgggcgtcatcatcatcgagagcctggacatcatcaccatcaccgtgcccccagccctgcctgctgccatgacagctggcatcgtgtatgcccagaggcggctgaagaagattggcatcttctgcatcagcccccagaggatcaacatctgtggccagctgaacctggtgtgctttgacaagacaggcaccctgacagaagatggcctggacctgtggggcatccagagggtggagaatgcccgcttcctgagccctgaggagaatgtgtgcaatgagatgctggtgaagagccagtttgtggcctgcatggccacctgccacagcctgaccaagattgaaggagtgctgagcggggaccccctggacctgaagatgtttgaggccatcggctggatcctggaggaggccacagaggaggagacagccctgcacaaccgcatcatgcccaccgtggtgcggccccccaagcagctgctgcctgagagcaccccagctggcaaccaggagatggagctgtttgagctgcctgccacctatgagatcggcatcgtgcggcagttccccttcagcagcgccctgcagaggatgtctgtggtggcccgggtgctgggggacaggaagatggatgcctacatgaagggggcccctgaggccatcgccggcctgtgcaagccagagaccgtgcctgtggacttccagaatgtgctggaggacttcaccaagcagggcttccgggtcatcgccctggcccacaggaagctggagagcaagctgacctggcacaaggtgcagaacatcagcagagatgccatcgagaacaacatggacttcatgggcctcatcatcatgcagaacaagctgaagcaggagaccccagctgtgctggaggacctgcacaaggccaacatcagaacagtgatggtgactggagacagcatgctgacagctgtgtctgtggcccgggactgtggcatgatcctgccccaggacaaggtgatcatcgccgaggccctgccccccaaggatggcaaggtggccaagatcaactggcactacgccgacagcctgacccagtgcagccaccccagcgccatcgaccctgaggccatccctgtgaagctggtgcatgacagcctggaggacctgcagatgacccgctaccactttgccatgaatggcaagagcttcagcgtcatcctggagcacttccaggacctggtgcccaagctgatgctgcacggcaccgtgtttgccaggatggccccagaccagaagacccagctgattgaggccctgcagaatgtggactactttgtgggcatgtgtggagatggagccaatgactgtggggccctgaagagggcccatggaggcatcagcctgtctgagctggaggcctctgtggccagccccttcaccagcaagacccccagcatcagctgtgtgcccaacctgatccgggagggccgggccgccctgatcaccagcttctgtgtgttcaagttcatggccctgtacagcatcatccagtacttctctgtgaccctgctgtacagcatcctgagcaacctgggggacttccagttcctgttcatcgacctggccatcatcctggtggtggtgttcaccatgagcctgaacccagcctggaaggagctggtggcccagaggcctccttctggcctcatcagcggggccctgctcttctctgtgctgagccagatcatcatctgcatcggcttccagagcctgggcttcttctgggtgaagcagcagccctggtatgaggtgtggcaccccaagagtgatgcctgcaacaccactggaagtggcttctggaacagcagccacgtggacaatgaaacagagctggatgagcacaacatccagaactatgagaacaccaccgtcttcttcatcagcagcttccagtacctgattgtggccatcgccttcagcaagggcaagcccttccggcagccctgctacaagaactacttctttgtgttcagcgtcatcttcctgtacatcttcatcctcttcatcatgctgtaccctgtggcctctgtggaccaggtgctgcagatcgtgtgtgtgccctaccagtggagggtgaccatgctgatcatcgtgctggtgaatgcctttgtgtccatcaccgtggaggagagcgtggaccgctggggcaagtgctgcctgccctgggccctgggctgcaggaagaagacccccaaggccaagtacatgtacctggcccaggagctgctggtggaccctgagtggccacccaagccccagaccaccacagaggccaaggccctggtgaaggaaaatggcagctgccagatcatcaccatcacctag

SEQ ID NO: 32477 - DNA, 2151 bp, Artificial Sequence
  Description of Artificial Sequence: Synthetic coding sequence
atggtggccacccacagcacagtgcgggtgtctgtgtgccgggtgaatgaggagattgaggagatcttcagcacagacctggtgcctggagatgtgatggtgatccccctgaatggcaccatcatgccctgtgatgctgtgctgatcaatggcacctgcatcgtgaatgaatccatgctgactggagagagcgtgcctgtgaccaagaccaacctgcccaaccccagcgtggatgtgaagggcattggagatgagctgtacaaccctgagacccacaagaggcacaccctcttctgtggcaccaccgtcatccagacccgcttctacaccggggagctggtgaaggccatcgtggtgaggacaggcttcagcaccagcaagggccagctggtgcgcagcatcctgtaccccaagcccacagacttcaagctgtacagagatgcctacctgttcctgctgtgcctggtggccgtggccggcatcggcttcatctacaccatcatcaacagcatcctgaatgaggtgcaggtgggcgtcatcatcatcgagagcctggacatcatcaccatcaccgtgcccccagccctgcctgctgccatgacagctggcatcgtgtatgcccagaggcggctgaagaagattggcatcttctgcatcagcccccagaggatcaacatctgtggccagctgaacctggtgtgctttgacaagacaggcaccctgacagaagatggcctggacctgtggggcatccagagggtggagaatgcccgcttcctgagccctgaggagaatgtgtgcaatgagatgctggtgaagagccagtttgtggcctgcatggccacctgccacagcctgaccaagattgaaggagtgctgagcggggaccccctggacctgaagatgtttgaggccatcggctggatcctggaggaggccacagaggaggagacagccctgcacaaccgcatcatgcccaccgtggtgcggccccccaagcagctgctgcctgagagcaccccagctggcaaccaggagatggagctgtttgagctgcctgccacctatgagatcggcatcgtgcggcagttccccttcagcagcgccctgcagaggatgtctgtggtggcccgggtgctgggggacaggaagatggatgcctacatgaagggggcccctgaggccatcgccggcctgtgcaagccagagaccgtgcctgtggacttccagaatgtgctggaggacttcaccaagcagggcttccgggtcatcgccctggcccacaggaagctggagagcaagctgacctggcacaaggtgcagaacatcagcagagatgccatcgagaacaacatggacttcatgggcctcatcatcatgcagaacaagctgaagcaggagaccccagctgtgctggaggacctgcacaaggccaacatcagaacagtgatggtgactggagacagcatgctgacagctgtgtctgtggcccgggactgtggcatgatcctgccccaggacaaggtgatcatcgccgaggccctgccccccaaggatggcaaggtggccaagatcaactggcactacgccgacagcctgacccagtgcagccaccccagcgccatcgaccctgaggccatccctgtgaagctggtgcatgacagcctggaggacctgcagatgacccgctaccactttgccatgaatggcaagagcttcagcgtcatcctggagcacttccaggacctggtgcccaagctgatgctgcacggcaccgtgtttgccaggatggccccagaccagaagacccagctgattgaggccctgcagaatgtggactactttgtgggcatgtgtggagatggagccaatgactgtggggccctgaagagggcccatggaggcatcagcctgtctgagctggaggcctctgtggccagccccttcaccagcaagacccccagcatcagctgtgtgcccaacctgatccgggagggccgggccgccctgatcaccagcttctgtgagctggccctcttcagcatcgtgacctacagcctggaccacttcatcatcagcatcctgatcagcaacatgctggtgctcttcttcagtgacttccacaactgtgccttctacagcctggtgtag

SEQ ID NO: 32478 - DNA, 3681 bp, Artificial Sequence; identical to SEQ ID NO: 32476
  Description of Artificial Sequence: Synthetic coding sequence

SEQ ID NO: 32479 - DNA, 144 bp, Artificial Sequence
  Description of Artificial Sequence: Synthetic coding sequence
atggaccgggaggagaggaagaccatcaaccagggccaggaggatgagatggagatctacggctacaacctgagccgctggaagctggccatcgtgtccctgggcgtcatctgcagcggcggcttcctgctgctgctgctgtag

SEQ ID NO: 32480 - DNA, 312 bp, Artificial Sequence
  Description of Artificial Sequence: Synthetic coding sequence
atggaccgggaggagaggaagaccatcaaccagggccaggaggatgagatggagatctacggctacaacctgagccgctggaagctggccatcgtgtccctgggcgtcatctgcagcggcggcttcctgctgctgctgctgtactggatgcctgagtggagggtgaaggccacctgtgtgcgggccgccatcaaggactgtgaggtggtgctgctgcggaccacagatgagttcaagatgtggttctgtgccaagatccgggtgctgagcctggagacctaccctgtgagcagccccaagtccatgtcctag

SEQ ID NO: 32481 - DNA, 1731 bp, Artificial Sequence
  Description of Artificial Sequence: Synthetic coding sequence
atgggccactttgagaagggccagcacgccctgctgaatgaaggagaagaaaatgagatggagatcttcggctaccgcacccagggctgcaggaagagcctgtgcctggccggcagcatcttctcctttggcatcctgcccctggtgttctactggaggcctgcctggcacgtgtgggcccactgtgtgccctgcagcctgcaggaggccgacacagtgctgctgcggaccacagatgagttccagatctacagctggaagaaggtgatctggatctacctgagcgccctgaacagcgccttcggcctgaccccagaccaccccctgatgacagatgaggagtacatcatcaacagagccatcaggaagccagacctgaaggtgcgctgcatcaaggtgcagaagatccgctacgtgtggaactacctggagggccagttccagaagattggcagcctggaggactggctgagcagcgccaagatccaccagaagtttggcagcggcctgacccgggaggagcaggagatccggcggctcatctgtggccccaacaccattgatgtggaggtgacccccatctggaagctgctgatcaaggaggtgctgaaccccttctacatcttccagctgttctctgtgtgcctgtggttcagcgaggactacaaggagtatgcctttgccatcatcatcatgagcatcatcagcatcagcctgactgtgtatgacctgcgggagcagagcgtgaagctgcaccacctggtggagagccacaacagcatcaccgtgtctgtgtgtggcaggaaggccggcgtgcaggagctggagagccgggtgctggtgcctggggacctgctgatcctgactggaaacaaggtgctgatgccctgtgatgctgtgctgattgagggcagctgtgtggtggatgagggcatgctgaccggggagagcatccctgtgaccaagacccccctgcccaagatggacagctctgtgccctggaagacccagagcgaggccgactacaagagacatgtgctcttctgtggcacagaggtgatccaggccaaggccgcctgcagcggcaccgtgcgggctgtggtgctgcagacaggcttcaacacagccaagggggacctggtgcgcagcatcctgtaccccaagcctgtgaacttccagctgtacagagatgccatccgcttcctgctgtgcctggtgggcacagccaccatcggcatgatctacaccctgtgtgtgtatgtgctgtctggagagcccccagaggaggtggtgaggaaggccctggatgtgatcaccatcgctgtgcccccagccctgcctgctgccctgaccaccggcatcatctatgcccagaggcggctgaagaagaggggcatcttctgcatcagcccccagaggatcaacgtgtgtggccagctgaacctggtgtgctttgacaagacaggcaccctgaccagagatggcctggacctgtggggcgtggtgtcctgtgacagaaatggcttccaggaggtgcacagctttgccagcggccaggccctgccctggggccccctgtgtgccgccatggccagctgccacagcctcatcctgctggatggcaccatccagggcgaccccctggacctgaagatgtttgaggccaccacctgggtgtccctgtgcagcagcgagaacctgcgctccttcttcaatgcccgggccacctag

SEQ ID NO: 32482 - DNA, 3591 bp, Artificial Sequence
  Description of Artificial Sequence: Synthetic coding sequence
atgggccactttgagaagggccagcacgccctgctgaatgaaggagaagaaaatgagatggagatcttcggctaccgcacccagggctgcaggaagagcctgtgcctggccggcagcatcttctcctttggcatcctgcccctggtgttctactggaggcctgcctggcacgtgtgggcccactgtgtgccctgcagcctgcaggaggccgacacagtgctgctgcggaccacagatgagttccagatctacagctggaagaaggtgatctggatctacctgagcgccctgaacagcgccttcggcctgaccccagaccaccccctgatgacagatgaggagtacatcatcaacagagccatcaggaagccagacctgaaggtgcgctgcatcaaggtgcagaagatccgctacgtgtggaactacctggagggccagttccagaagattggcagcctggaggactggctgagcagcgccaagatccaccagaagtttggcagcggcctgacccgggaggagcaggagatccggcggctcatctgtggccccaacaccattgatgtggaggtgacccccatctggaagctgctgatcaaggaggtgctgaaccccttctacatcttccagctgttctctgtgtgcctgtggttcagcgaggactacaaggagtatgcctttgccatcatcatcatgagcatcatcagcatcagcctgactgtgtatgacctgcgggagcagagcgtgaagctgcaccacctggtggagagccacaacagcatcaccgtgtctgtgtgtggcaggaaggccggcgtgcaggagctggagagccgggtgctggtgcctggggacctgctgatcctgactggaaacaaggtgctgatgccctgtgatgctgtgctgattgagggcagctgtgtggtggatgagggcatgctgaccggggagagcatccctgtgaccaagacccccctgcccaagatggacagctctgtgccctggaagacccagagcgaggccgactacaagagacatgtgctcttctgtggcacagaggtgatccaggccaaggccgcctgcagcggcaccgtgcgggctgtggtgctgcagacaggcttcaacacagccaagggggacctggtgcgcagcatcctgtaccccaagcctgtgaacttccagctgtacagagatgccatccgcttcctgctgtgcctggtgggcacagccaccatcggcatgatctacaccctgtgtgtgtatgtgctgtctggagagcccccagaggaggtggtgaggaaggccctggatgtgatcaccatcgctgtgcccccagccctgcctgctgccctgaccaccggcatcatctatgcccagaggcggctgaagaagaggggcatcttctgcatcagcccccagaggatcaacgtgtgtggccagctgaacctggtgtgctttgacaagacaggcaccctgaccagagatggcctggacctgtggggcgtggtgtcctgtgacagaaatggcttccaggaggtgcacagctttgccagcggccaggccctgccctggggccccctgtgtgccgccatggccagctgccacagcctcatcctgctggatggcaccatccagggcgaccccctggacctgaagatgtttgaggccaccacctgggagatggccttctctggagatgacttccacatcaagggcgtgcctgcccacgccatggtggtgaagccctgcaggacagccagccaggtgcctgtggagggcatcgccatcctgcaccagttccccttcagcagcgccctgcagaggatgacagtgattgtgcaggagatgggcggggaccggctggccttcatgaagggggcccctgagcgggtggccagcttctgccagcctgagaccgtgcccaccagctttgtgtctgagctgcagatctacaccacccagggcttccgggtcatcgccctggcctacaagaagctggagaatgaccaccacgccaccaccctgacccgggagaccgtggagagtgacctgatcttcctgggcctgctgatcctggagaaccggctgaaggaggagaccaagcctgtgctggaggagctgatcagcgcccgcatcagaacagtgatgatcactggagacaacctgcagacagccatcaccgtggccaggaagagcggcatggtgtctgagagccagaaggtgatcctgattgaggccaatgagaccaccggcagcagcagcgccagcatctcctggaccctggtggaggagaagaagcacatcatgtatggcaaccaggacaactacatcaacatcagagatgaggtgtctgacaagggccgggagggcagctaccactttgccctgaccgggaagagcttccacgtgatcagccagcacttcagcagcctgctgcccaagatcctgatcaatggcaccatctttgccaggatgagccctggccagaagagcagcctggtggaggagttccagaagctggactactttgtgggcatgtgtggagatggagccaatgactgtggggccctgaagatggcccacgtgggcatcagcctgtctgagcaggaggcctctgtggccagccccttcaccagcaagacccccaacattgaatgtgtgccccacctgatcaaggagggccgggccgccctggtgaccagcttctgcatgttcaagtacatggccctgtacagcatgatccagtatgtgggcgtgctgctgctgtactgggagaccaacagcctgagcaactaccagttcctgttccaggacctggccatcaccaccctcatcggcgtgaccatgaacctgaatggagcctaccccaagctggtgcccttccggcctgctggccgcctcatcagcccccccctgctgctgagcgtcatcttcaacatcctgctgagcctggccatgcacatcgccggcttcatcctggtgcagaggcagccctggtacagcgtggagatccacagcgcctgcaccgtgcagaatgaaagcatcagcgagctgaccatgagccccacagcccctgagaagatggagagcaacagcaccttcaccagctttgagaacaccaccgtgtggttcctgggcaccatcaactgcatcaccgtggccctggtgttcagcaagggcaagcccttccggcagcccacctacaccaactacatctttgtgctggtgctgatcatccagctgggcgtgtgcctcttcatcctgtttgctgacatccctgagctgtaccgccgcctggacctgctgtgcacccctgtgctgtggagggccagcatcgtcatcatgctgagcctgaacttcatcgtgtccctggtggccgaggaggccgtgattgaaaatagagccctgtggatgatgatcaagcgctgcttcggctaccagagcaagagccagtaccgcatctggcagagggacctggccaatgaccccagctggccacccctgaaccagaccagccacagcgacatgccagaatgtggccggggcgtgtcctacagcaaccctgtgtttgagagcaatgaggagcagctgtag

SEQ ID NO: 32483 - DNA, 639 bp, Artificial Sequence
  Description of Artificial Sequence: Synthetic coding sequence
atgcacatcgccggcttcatcctggtgcagaggcagccctggtacagcgtggagatccacagcgcctgcaccgtgcagaatgaaagcatcagcgagctgaccatgagccccacagcccctgagaagatggagagcaacagcaccttcaccagctttgagaacaccaccgtgtggttcctgggcaccatcaactgcatcaccgtggccctggtgttcagcaagggcaagcccttccggcagcccacctacaccaactacatctttgtgctggtgctgatcatccagctgggcgtgtgcctcttcatcctgtttgctgacatccctgagctgtaccgccgcctggacctgctgtgcacccctgtgctgtggagggccagcatcgtcatcatgctgagcctgaacttcatcgtgtccctggtggccgaggaggccgtgattgaaaatagagccctgtggatgatgatcaagcgctgcttcggctaccagagcaagagccagtaccgcatctggcagagggacctggccaatgaccccagctggccacccctgaaccagaccagccacagcgacatgccagaatgtggccggggcgtgtcctacagcaaccctgtgtttgagagcaatgaggagcagctgtag

SEQ ID NO: 32484 - DNA, 3657 bp, Artificial Sequence
  Description of Artificial Sequence: Synthetic coding sequence
atggaggagaacagcaagaaggaccaccgggccctgctgaaccagggcgaggaggatgagctggaggtgtttggctacagagaccacaacgtgaggaaggccttctgcctggtggcctctgtgctgacctgtggcggcctgctgctggtgttctactggaggccccagtggagggtgtgggccaactgcatcccctgccccctgcaggaggccgacacagtgctgctgcggaccacagatgagttccagcgctacatgaggaagaaggtgttctgcctgtacctgagcaccctgaagtttcctgtgtccaagaagtgggaggagagcctggtggccgacagacacagcgtcatcaaccaggccctgatcaagccagagctgaagctgcgctgcatggaggtgcagaagatccgctacgtgtggaatgacctggagaagcgcttccagaaggtgggcctgctggaggacagcaacagctgcagcgacatccaccagaccttcggcctgggcctgaccagcgaggagcaggaggtgcggcggctggtgtgtggccccaatgccatcgaggtggagatccagcccatctggaagctgctggtgaagcaggtgctgaaccccttctacgtgttccaggccttcaccctgaccctgtggctgagccagggctacatcgagtacagcgtggccatcatcatcctgaccgtcatcagcatcgtgctgtctgtgtatgacctgcggcagcagagcgtgaagctgcacaacctggtggaggaccacaacaaggtgcaggtgaccatcatcgtgaaggacaagggcctggaggagctggagagccggctgctggtgcctggggacatcctgatcctgcccgggaagttcagcctgccctgtgatgctgtgctgattgatggcagctgtgtggtgaatgaaggcatgctgaccggggagagcatccctgtgaccaagacccccctgccccagatggagaacaccatgccctggaagtgccacagcctggaggactacaggaagcacgtgctcttctgtggcacagaggtgatccaggtgaagcccagcggccagggccctgtgcgggctgtggtgctgcagacaggctacaacacagccaagggggacctggtgcgcagcatcctgtacccccggcccctgaacttcaagctgtacagtgatgccttcaagttcatcgtgttcctggcctgcctgggcgtgatgggcttcttctacgccctgggcgtgtacatgtaccatggagtgccccccaaggacacagtgaccatggccctgatcctgctgactgtgacagtgccccctgtgctgcctgctgccctgaccatcggaaatgtgtatgcccagaagaggctgaagaagaagaagatcttctgcatcagcccccagaggatcaacatgtgtggccagatcaacctggtgtgctttgacaagacaggcaccctgacagaagatggcctggacctgtggggcaccgtgcccacagctgacaactgcttccaggaggcccacagctttgccagcggccaggccgtgccctggagccccctgtgtgccgccatggccagctgccacagcctcatcctgctgaatggcaccatccagggcgaccccctggacctgaagatgtttgagggcacagcctggaagatggaggactgcatcgtggacagctgcaagtttggcacctctgtgagcaacatcatcaagccaggccccaaggccagcaagagccctgtggaggccatcatcaccctgtgccagttccccttcagcagcagcctgcagaggatgtctgtcatcgcccagctggccggggagaaccacttccacgtgtacatgaagggggcccctgagatggtggcccgcttctgccgctctgagaccgtgcccaagaacttcccccaggagctgcggagctacacagtgcagggcttccgggtcatcgccctggcccacaagaccctgaagatgggcaacctgtctgaggtggagcacctggcccgggagaaggtggagagcgagctgaccttcctgggcctgctgatcatggagaaccggctgaagaaggagaccaagctggtgctgaaggagctgtctgaggcccgcatcagaacagtgatgatcactggagacaacctgcagacagccatcaccgtggccaagaacagcgagatgatccccccaggcagccaggtgatcatcgtggaggctgatgagcctgaggagtttgtgcctgcctctgtgacctggcagctggtggagaaccaggagaccggccctgggaagaaggagatctacatgcacactggaaacagcagcaccccaagaggagagggcggcagctgctaccactttgccatgtctgggaagagctaccaggtgatcttccagcacttcaacagcctgctgcccaagatcctggtgaatggaacagtgtttgccaggatgagccctggccagaagagcagcctgattgaggagttccagaagctgaactactacgtgggcatgtgtggagatggagccaatgactgtggggccctgaaggccgcccatgctggcatcagcctgtctgagcaggaggcctctgtggccagccccttcaccagcaagaccaccaacatccagtgtgtgccccacctgatccgggagggccgggccgccctggtgagcagctttggagtcttcaagtacctgaccatgtatggcatcatccagttcatcagcgccctgctgctgtactggcagctgcagctgtttggaaactaccagtacctgatgcaggatgtggccatcaccctgatggtgtgcctgaccatgagcagcacccacgcctaccccaagctggccccctacagacctgctggccagctgctgagcccccccctgctgctgagcatcttcctgaacagctgcttcagctgcatcgtgcagatcagcgccttcctgtatgtgaagcagcagccctggtactgtgaggtgtaccagtacagcgagtgcttcctggccaaccagagcaacttcagcaccaacgtgtccctggagaggaactggacaggaaatgccaccctcatccctggcagcatcctgagctttgagaccaccaccctgtggcccatcaccaccatcaactacatcaccgtggccttcatcttcagcaagggcaagcccttcaggaagcccatctacaccaactacatcttctccttcctgctgctggccgccctgggcctgaccatcttcatcctcttcagtgacttccaggtgatctaccggggcatggagctgatccccaccatcacctcctggagggtgctgatcctggtggtggccctgacccagttctgtgtggccttctttgtggaggacagcatcctgcagaaccacgagctgtggctgctgatcaagcgggagtttggcttctacagcaagagccagtaccgcacctggcagaagaagctggccgaggacagcacctggccacccatcaacagaacagactacagcggagatggcaagaatggcttctacatcaatggaggctatgagagccatgagcagatccccaagaggaagctgaagctgggcggccagcccacagagcagcacttctgggcccggctgtag

SEQ ID NO: 32485 - DNA, 3450 bp, Artificial Sequence
  Description of Artificial Sequence: Synthetic coding sequence
atgcccaccatgagaagaacagtgtctgagatccgcagcagagctgagggctatgagaagacagatgatgtgtctgagaagaccagcctggccgaccaggaggaggtgaggaccatcttcatcaaccagccccagctgaccaagttctgcaacaaccacgtgtccacagccaagtacaacatcatcaccttcctgccccgcttcctgtacagccagttccggcgggccgccaacagcttcttcctgttcatcgccctgctgcagcagatcccagatgtgagccccaccggccgctacaccaccctggtgcccctgctcttcatcctggccgtggccgccatcaaggagatcatcgaggacatcaagaggcacaaggctgacaatgctgtgaacaagaagcagacccaggtgctgagaaatggagcctgggagatcgtgcactgggagaaggtgaatgtgggggacatcgtcatcatcaagggcaaggagtacatcccagctgacacagtgctgctgagcagcagcgagccccaggccatgtgctacatcgagaccagcaacctggatggagagaccaacctgaagatccggcagggcctgcctgccaccagtgacatcaaggatgtggacagcctgatgaggatcagcggcagaattgaatgtgagagccccaacagacacctgtatgactttgtgggcaacatccggctggatggccacggcaccgtgcccctgggcgctgaccagatcctgctgcggggggcccagctgaggaacacccagtgggtgcacggcatcgtggtgtacacaggccatgacaccaagctgatgcagaacagcaccagcccccccctgaagctgagcaatgtggagcgcatcaccaacgtgcagatcctgatcctcttctgcatcctgattgccatgagcctggtgtgcagcgtgggcagcgccatctggaacagaagacacagcggcaaggactggtacctgaacctgaactacggcggggccagcaactttggcctgaacttcctgaccttcatcatcctcttcaacaacctgatccccatcagcctgctggtgaccctggaggtggtgaagttcacccaggcctacttcatcaactgggacctggacatgcactatgagcccacagacacagctgccatggcccggaccagcaacctgaatgaggagctgggccaggtgaagtacatcttcagtgacaagacaggcaccctgacctgcaatgtgatgcagttcaagaagtgcaccatcgccggcgtggcctacggccagaacagccagtttggagatgagaagaccttcagtgacagcagcctgctggagaacctgcagaacaaccaccccacagcccccatcatctgtgagttcctgaccatgatggctgtgtgccacacagctgtgcctgagcgggagggggacaagatcatctaccaggccgccagcccagatgagggcgccctggtgcgggccgccaagcagctgaactttgtgttcaccggccgcaccccagacagcgtcatcatcgacagcctgggccaggaggagagatatgagctgctgaatgtgctggagttcaccagcgccaggaagaggatgtctgtcatcgtgaggaccccatctgggaagctgcggctgtactgcaagggagctgacaccgtcatctatgaccggctggccgagaccagcaagtacaaggagatcaccctgaagcacctggagcagtttgccacagagggcctgcggaccctgtgctttgctgtggccgagatcagcgagagtgacttccaggagtggagggctgtgtaccagagggccagcacctctgtgcagaaccggctgctgaagctggaggagagctatgagctgattgagaagaacctgcagctgctgggcgccacagccatcgaggacaagctgcaggaccaggtgcctgagaccatcgagaccctgatgaaggctgacatcaagatctggatcctgaccggggacaagcaggagacagccatcaacatcggccacagctgcaagctgctgaagaagaacatgggcatgatcgtcatcaatgaaggcagcctggatggcacccgggagaccctgagccgccactgcaccaccctgggagatgccctgaggaaagaaaatgactttgccctgatcattgatggcaagaccctgaagtatgccctgaccttcggcgtgcggcagtacttcctggacctggccctgagctgcaaggctgtgatctgctgccgggtgagccccctgcagaagtctgaggtggtggagatggtgaagaagcaggtgaaggtggtgaccctggccatcggagatggagccaatgatgtgtccatgatccagacagcccacgtgggcgtgggcatctctggaaatgaaggcctgcaggccgccaacagcagtgactacagcatcgcccagttcaagtacctgaagaacctgctgatgatccacggggcctggaactacaacagagtgtccaagtgcatcctgtactgcttctacaagaacatcgtgctgtacatcatcgagatctggtttgcctttgtgaatggcttcagcggccagatcctgtttgagcgctggtgcatcggcctgtacaacgtgatgttcaccgccatgccacccctgaccctgggcatctttgagaggagctgcaggaaagaaaacatgctgaagtacccagagctgtacaagaccagccagaatgccctggacttcaacaccaaggtgttctgggtgcactgcctgaatggcctcttccacagcgtcatcctcttctggttccccctgaaggccctgcagtatggaacagcctttggaaatggcaagaccagtgactacctgctgctgggcaactttgtgtacacctttgtggtgatcaccgtgtgcctgaaggccggcctggagaccagctactggacctggttcagccacatcgccatctggggcagcatcgccctgtgggtggtgttcttcggcatctacagcagcctgtggccagccatccccatggccccagacatgtctggagaggccgccatgctgttcagcagtggagtcttctggatgggcctgctcttcatccctgtggccagcctgctgctggatgtggtgtacaaggtgatcaagaggacagccttcaagaccctggtggatgaggtgcaggagctggaggccaagagccaggaccctggagctgtggtgctgggcaagagcctgacagagcgggcccagctgctgaagaatgtgttcaagaagaaccacgtgaacctgtacagaagtgagagcctgcagcagaacctgctgcacggctacgccttcagccaggatgaaaatggaattgtgtcccagagcgaggtgatccgggcctatgacaccaccaagcagaggccagatgagtggtag

SEQ ID NO: 32486 - DNA, 3495 bp, Artificial Sequence
  Description of Artificial Sequence: Synthetic coding sequence
atgcccaccatgagaagaacagtgtctgagatccgcagcagagctgagggctatgagaagacagatgatgtgtctgagaagaccagcctggccgaccaggaggaggtgaggaccatcttcatcaaccagccccagctgaccaagttctgcaacaaccacgtgtccacagccaagtacaacatcatcaccttcctgccccgcttcctgtacagccagttccggcgggccgccaacagcttcttcctgttcatcgccctgctgcagcagatcccagatgtgagccccaccggccgctacaccaccctggtgcccctgctcttcatcctggccgtggccgccatcaaggagatcatcgaggacatcaagaggcacaaggctgacaatgctgtgaacaagaagcagacccaggtgctgagaaatggagcctgggagatcgtgcactgggagaaggtggccgtgggggagatcgtgaaggtgaccaatggagagcacctgcctgctgacctgatcagcctgagcagcagcgagccccaggccatgtgctacatcgagaccagcaacctggatggagagaccaacctgaagatccggcagggcctgcctgccaccagtgacatcaaggatgtggacagcctgatgaggatcagcggcagaattgaatgtgagagccccaacagacacctgtatgactttgtgggcaacatccggctggatggccacggcaccgtgcccctgggcgctgaccagatcctgctgcggggggcccagctgaggaacacccagtgggtgcacggcatcgtggtgtacacaggccatgacaccaagctgatgcagaacagcaccagcccccccctgaagctgagcaatgtggagcgcatcaccaacgtgcagatcctgatcctcttctgcatcctgattgccatgagcctggtgtgcagcgtgggcagcgccatctggaacagaagacacagcggcaaggactggtacctgaacctgaactacggcggggccagcaactttggcctgaacttcctgaccttcatcatcctcttcaacaacctgatccccatcagcctgctggtgaccctggaggtggtgaagttcacccaggcctacttcatcaactgggacctggacatgcactatgagcccacagacacagctgccatggcccggaccagcaacctgaatgaggagctgggccaggtgaagtacatcttcagtgacaagacaggcaccctgacctgcaatgtgatgcagttcaagaagtgcaccatcgccggcgtggcctacggccacgtgcctgagcctgaggactatggctgcagcccagatgagtggcagaacagccagtttggagatgagaagaccttcagtgacagcagcctgctggagaacctgcagaacaaccaccccacagcccccatcatctgtgagttcctgaccatgatggctgtgtgccacacagctgtgcctgagcgggagggggacaagatcatctaccaggccgccagcccagatgaaggagccctggtgcgggccgccaagcagctgaactttgtgttcaccggccgcaccccagattctgtcatcatcgacagcctgggccaggaggagagatatgagctgctgaatgtgctggagttcaccagcgccaggaagaggatgtctgtgattgtgaggacccccagcggcaagctgcggctgtactgcaagggagctgacaccgtcatctatgaccggctggccgagaccagcaagtacaaggagatcaccctgaagcacctggagcagtttgccacagagggcctgcggaccctgtgctttgctgtggccgagatcagcgagagtgacttccaggagtggagggctgtgtaccagagggccagcacctctgtgcagaaccggctgctgaagctggaggagagctatgagctgattgagaagaacctgcagctgctgggcgccacagccatcgaggacaagctgcaggaccaggtgcctgagaccatcgagaccctgatgaaggctgacatcaagatctggatcctgactggagacaagcaggagacagccatcaacatcggccacagctgcaagctgctgaagaagaacatgggcatgatcgtcatcaatgaaggcagcctggatggcacccgggagaccctgagccgccactgcaccaccctgggagatgccctgaggaaagaaaatgactttgccctgatcattgatggcaagaccctgaagtatgccctgacctttggagtgcggcagtacttcctggacctggccctgagctgcaaggccgtcatctgctgccgggtgagccccctgcagaagtctgaggtggtggagatggtgaagaagcaggtgaaggtggtgaccctggccatcggagatggagccaatgatgtgtccatgatccagacagcccacgtgggcgtgggcatctctggaaatgaaggcctgcaggccgccaacagcagtgactacagcatcgcccagttcaagtacctgaagaacctgctgatgattcatggagcctggaactacaacagagtgtccaagtgcatcctgtactgcttctacaagaacatcgtgctgtacatcatcgagatctggtttgcctttgtgaatggcttcagcggccagatcctgtttgagcgctggtgcatcggcctgtacaacgtgatgttcaccgccatgccacccctgaccctgggcatctttgagaggagctgcaggaaggagaacatgctgaagtacccagagctgtacaagaccagccagaatgccctggacttcaacaccaaggtgttctgggtgcactgcctgaatggcctcttccacagcgtcatcctcttctggttccccctgaaggccctgcagtatggaacagcctttggaaatggcaagaccagtgactacctgctgctgggcaactttgtgtacacctttgtggtgatcaccgtgtgcctgaaggccggcctggagaccagctactggacctggttcagccacatcgccatctggggcagcatcgccctgtgggtggtgttcttcggcatctacagcagcctgtggccagccatccccatggccccagacatgtctggagaggccgccatgctgttcagcagcggggtcttctggatgggcctgctcttcatccctgtggccagcctgctgctggatgtggtgtacaaggtgatcaagaggacagccttcaagaccctggtggatgaggtgcaggagctggaggccaagagccaggaccccggggctgtggtgctgggcaagagcctgacagagcgggcccagctgctgaagaatgtgttcaagaagaaccacgtgaacctgtacagaagtgagagcctgcagcagaacctgctgcacggctacgccttcagccaggatgaaaatggcatcgtgtcccagagcgaggtgatccgggcctatgacaccaccaagcagaggccagatgagtggtag

SEQ ID NO: 32487 - DNA, 3579 bp, Artificial Sequence
  Description of Artificial Sequence: Synthetic coding sequence
atgttctgcagcgagaagaagctgcgggaggtggagcgcatcgtgaaggccaatgaccgggagtacaatgagaagttccagtatgctgacaaccgcatccacaccagcaagtacaacatcctgaccttcctgcccatcaacctgtttgagcagttccagagggtggccaatgcctacttcctgtgcctgctgatcctgcagctgatccctgagatcagcagcctgacctggttcaccaccatcgtgcccctggtgctggtgatcaccatgacagctgtgaaggatgccacagatgactacttccgccacaagagtgacaaccaggtgaacaaccggcagagcgaggtgctgatcaacagcaagctgcagaatgagaagtggatgaatgtgaaggtgggggacatcatcaagctggagaacaaccagtttgtggccgctgacctgctgctgctgagcagcagcgagccccacggcctgtgctacgtggagacagctgagctggatggagagaccaacctgaaggtgagacatgccctgtctgtgaccagcgagctgggcgctgacatcagccggctggccggctttgatggcatcgtggtgtgtgaggtgcccaacaacaagctggacaagttcatgggcatcctgtcctggaaggacagcaagcacagcctgaacaatgagaagatcatcctgcggggctgcatcctgaggaacacctcctggtgcttcggcatggtgatctttgctggccctgacaccaagctgatgcagaacagcggcaagaccaagttcaagaggaccagcattgaccggctgatgaacaccctggtgctgtggatcttcggcttcctgatctgcctgggcatcatcctggccatcggcaacagcatctgggagagccagacaggagaccagttccgcaccttcctgttctggaatgaaggagagaagagctctgtgttcagcggcttcctgaccttctggagctacatcatcatcctgaacacagtggtgcccatcagcctgtatgtgtctgtggaggtgatccggctgggccacagctacttcatcaactgggacaggaagatgtactacagcaggaaggccatcccagctgtggcccggaccaccaccctgaatgaggagctgggccagatcgagtacatcttcagtgacaagacaggcaccctgacccagaacatcatgaccttcaagcgctgcagcatcaatggccgcatctacggggaggtgcatgatgacctggaccagaagacagagatcacccaggagaaggagcctgtggacttctctgtgaagagccaggccgaccgggagttccagttctttgaccaccacctgatggagagcatcaagatgggagaccccaaggtgcatgagttcctgcggctgctggccctgtgccacacagtgatgtctgaagaaaattctgctggggagctgatctaccaggtgcagagcccagatgaaggagccctggtgacagctgccaggaactttggcttcatcttcaagagcaggaccccagagaccatcaccatcgaggagctgggcaccctggtgacctaccagctgctggccttcctggacttcaacaacaccaggaagaggatgtctgtgattgtgagaaatcctgagggccagatcaagctgtacagcaaaggagctgacaccatcctgtttgagaagctgcaccccagcaatgaggtgctgctgagcctgaccagtgaccacctgtctgaatttgctggggagggcctgcggaccctggccatcgcctacagagacctggatgacaagtacttcaaggagtggcacaagatgctggaggatgccaatgctgccacagaggagagagatgaaagaattgctggcctgtatgaggagattgaaagagacctgatgctgctgggcgccacagctgtggaggacaagctgcaggagggcgtgattgaaacagtgaccagcctgagcctggccaacatcaagatctgggtgctgaccggggacaagcaggagacagccatcaacatcggctacgcctgcaacatgctgacagatgacatgaatgatgtgtttgtgattgctggcaacaatgctgtggaggtgcgggaggagctgaggaaggccaagcagaacctgtttggccagaacagaaacttcagcaatggacatgtggtgtgtgagaagaagcagcagctggagctggacagcatcgtggaggagaccatcactggagactatgccctgatcatcaatggccacagcctggcccacgccctggagagtgatgtgaagaatgacctgctggagctggcctgcatgtgcaagacagtcatctgctgccgggtgacccccctgcagaaggcccaggtggtggagctggtgaagaagtacagaaatgctgtgaccctggccatcggagatggagccaatgatgtgtccatgatcaagagcgcccacatcggcgtgggcatcagcggccaggagggcctgcaggccgtgctggccagtgactacagctttgcccagttccgctacctgcagaggctgctgctggtgcacggccgctggagctacttcaggatgtgcaagttcctgtgctacttcttctacaagaactttgccttcaccctggtgcacttctggtttggcttcttctgtggcttcagcgcccagacagtgtatgaccagtggttcatcaccctcttcaacatcgtgtacaccagcctgcctgtgctggccatgggcatctttgaccaggatgtgtctgaccagaacagcgtggactgcccccagctgtacaagccaggccagctgaacctgctcttcaacaagaggaagttcttcatctgtgtgctgcacggcatctacaccagcctggtgctcttcttcatcccctacggggccttctacaacgtggccggagaagatggccagcacatcgctgactaccagagctttgctgtgaccatggccaccagcctggtgattgtggtgtctgtgcagatcgccctggacaccagctactggaccttcatcaaccacgtgttcatctggggcagcatcgccatctacttcagcatcctcttcaccatgcacagcaatggcatcttcggcatcttccccaaccagttcccctttgtgggcaatgcccggcacagcctgacccagaagtgcatctggctggtgatcctgctgaccaccgtggcctctgtgatgcctgtggtggccttccgcttcctgaaggtggacctgtaccccaccctgagtgaccagatccgccgctggcagaaggcccagaagaaggcccggccccccagcagccggcggcccaggaccaggaggagcagcagccgccgcagcggctacgcctttgcccaccaggagggctacggggagctgatcaccagcggcaagaacatgagggccaagaaccccccacccaccagcggcctggagaagacccactacaacagcacctcctggattgagaacctgtgcaagaagaccacagacacagtgtcctccttcagccaggacaagacagtgaagctgtag

SEQ ID NO: 32488 - DNA, 162 bp, Artificial Sequence
  Description of Artificial Sequence: Synthetic coding sequence
atgttctgcagcgagaagaagctgcgggaggtggagcgcatcgtgaaggccaatgaccgggagtacaatgagaagttccagtatgctgacaaccgcatccacaccagcaagtacaacatcctgaccttcctgcccatcaacctgtttgagcagttccagtag

SEQ ID NO: 32489 - DNA, 3579 bp, Artificial Sequence; identical to SEQ ID NO: 32487
  Description of Artificial Sequence: Synthetic coding sequence

SEQ ID NO: 32490 - DNA, 2736 bp, Artificial Sequence
  Description of Artificial Sequence: Synthetic coding sequence
atggacagccggcccagggctggctgctgtgagtggctgcgctgctgcggcggcggggaggcccggcccaggacagtgtggctgggccaccctgagaagagggaccagcgctaccccagaaatgtcatcaacaaccagaagtacaacttcttcaccttcctgcccggggtgctcttcaaccagttcaagtacttcttcaacctgtacttcctgctgctggcctgcagccagtttgtgcctgagatgaggctgggcgccctgtacacctactgggtgcccctgggctttgtgctggccgtgaccgtcatccgggaggccgtggaggagatccgctgctacgtgcgggacaaggaggtgaacagccaggtgtacagccggctgacagcccggggcaccgtggtgggcgtggtgctgtacacaggccgggagctgcggtctgtgatgaacaccagcaaccccaggagcaagattggcctgtttgacctggaggtgaactgcctgaccaagatcctgtttggagccctggtggtggtgtccctggtgatggtggccctgcagcactttgctggccgctggtacctgcagatcatccgcttcctgctgctcttcagcaacatcatccccatcagcctgcgggtgaacctggacatgggcaagatcgtgtacagctgggtgatcagaagagacagcaagatccctggcaccgtggtgcgcagcagcaccatccctgagcagctgggccgcatctcctacctgctgacagacaagacaggcaccctgacccagaatgagatgatcttcaagaggctgcacctgggcaccgtggcctacggcctggacagcatggatgaggtgcagagccacatcttcagcatctacacccagcagagccaggaccccccagcccagaagggccccaccctgaccaccaaggtgcggaggaccatgagcagccgggtgcatgaagctgtgaaggccatcgccctgtgccacaacgtgacccctgtgtatgagagcaatggagtgacagaccaggccgaggccgagaagcagtatgaggacagctgccgggtgtaccaggccagcagcccagatgaggtggccctggtgcagtggacagaatctgtgggcctgaccctggtgggccgggaccagagctccatgcagctgcggacccctggggaccagatcctgaacttcaccatcctgcagatcttccccttcacctatgagagcaagaggatgggcatcatcgtgagagatgagagcactggagagatcaccttctacatgaagggagcagatgtggtgatggccggcatcgtgcagtacaatgactggctggaggaggagtgtggcaacatggcccgggagggcctgcgggtgctggtggtggccaagaagagcctggccgaggagcagtaccaggactttgaggcccgctacgtgcaggccaagctgtctgtgcatgacaggagcctgaaggtggccaccgtcatcgagagcctggagatggagatggagctgctgtgcctgactggagtggaggaccagctgcaggctgatgtgcggcccaccctggagaccctgagaaatgccggcatcaaggtgtggatgctgactggagacaagctggagacagccacctgcacagccaagaatgcccacctggtgaccaggaaccaggacatccacgtgttccggctggtgaccaacagaggagaggcccacctggagctgaatgccttccggaggaagcatgactgtgccctggtgatcagcggggacagcctggaggtgtgcctgaagtactatgaatatgagttcatggagctggcctgccagtgcccagctgtggtgtgctgccgctgtgcccccacccagaaggcccagatcgtgcggctgctgcaggagaggacaggcaagctgacctgtgctgtgggagatggcggcaatgatgtgtccatgatccaggagagtgactgtggggtgggcgtggagggcaaggagggcaagcaggccagcctggccgctgacttcagcatcacccagttcaagcacctgggccgcctgctgatggtgcatggaagaaattcctacaagaggtctgctgccctgagccagtttgtgatccacaggagcctgtgcatcagcaccatgcaggccgtgttcagcagcgtcttctactttgcctctgtgcccctgtaccagggcttcctgatcatcggctacagcaccatctacaccatgtttcctgtgttcagcctggtgctggacaaggatgtgaagtctgaggtggccatgctgtacccagagctgtacaaggacctgctgaagggccggcccctgagctacaagaccttcctgatctgggtgctgatcagcatctaccagggcagcaccatcatgtacggggccctgctgctgtttgagagcgagtttgtgcacatcgtggccatctccttcaccagcctcatcctgacagagctgctgatggtggccctgaccatccagacctggcactggctgatgacagtggccgagctgctgagcctggcctgctacatcgccagcctggtgttcctgcacgagttcattgatgtgtacttcatcgccaccctgtccttcctgtggaaggtgtctgtcatcaccctggtgtcctgcctgcccctgtatgtgctgaagtacctgcggcggcgcttcagccccccatcctacagcaagctgaccagctag

SEQ ID NO: 32491 - DNA, 3144 bp, Artificial Sequence
  Description of Artificial Sequence: Synthetic coding sequence
atgacagacaacatccccctgcagcctgtgcggcagaagaagaggatggacagccggccccgggccggctgctgtgagtggctgcgctgctgcggcggcggggaggcccggcccaggacagtgtggctgggccaccctgagaagagggaccagcgctaccccagaaatgtcatcaacaaccagaagtacaacttcttcaccttcctgcccggggtgctcttcaaccagttcaagtacttcttcaacctgtacttcctgctgctggcctgcagccagtttgtgcctgagatgaggctgggcgccctgtacacctactgggtgcccctgggctttgtgctggccgtgaccgtcatccgggaggccgtggaggagatccgctgctacgtgcgggacaaggaggtgaacagccaggtgtacagccggctgacagcccggggcaccgtgaaggtgaagagcagcaacatccaggtgggggacctgatcatcgtggagaagaaccagagggtgcctgctgacatgatcttcctgcggaccagcgagaagaatggcagctgcttcctgaggacagaccagctggatggagaaacagactggaagctgcggctgcctgtggcctgcacccagaggctgcccacagctgctgacctgctgcagatccgctcctatgtgtatgcagaggagcccaacatcgacatccacaactttgtgggcaccttcacccgggaggacagcgacccccccatcagcgagagcctgagcattgagaacaccctgtgggccggcaccgtggtggccagcggcaccgtggtgggcgtggtgctgtacacaggccgggagctgcggtctgtgatgaacaccagcaaccccaggagcaagattggcctgtttgacctggaggtgaactgcctgaccaagatcctgtttggagccctggtggtggtgtccctggtgatggtggccctgcagcactttgctggccgctggtacctgcagatcatccgcttcctgctgctcttcagcaacatcatccccatcagcctgcgggtgaacctggacatgggcaagatcgtgtacagctgggtgatcagaagagacagcaagatccctggcaccgtggtgcgcagcagcaccatccctgagcagctgggccgcatctcctacctgctgacagacaagacaggcaccctgacccagaatgagatgatcttcaagaggctgcacctgggcaccgtggcctacggcctggacagcatggatgaggtgcagagccacatcttcagcatctacacccagcagagccaggaccccccagcccagaagggccccaccctgaccaccaaggtgcggaggaccatgagcagccgggtgcatgaagctgtgaaggccatcgccctgtgccacaacgtgacccctgtgtatgagagcaatggagtgacagaccaggccgaggccgagaagcagtatgaggacagctgccgggtgtaccaggccagcagcccagatgaggtggccctggtgcagtggacagaatctgtgggcctgaccctggtgggccgggaccagagctccatgcagctgcggacccctggggaccagatcctgaacttcaccatcctgcagatcttccccttcacctatgagagcaagaggatgggcatcatcgtgagagatgagagcactggagagatcaccttctacatgaagggagcagatgtggtgatggccggcatcgtgcagtacaatgactggctggaggaggagtgtggcaacatggcccgggagggcctgcgggtgctggtggtggccaagaagagcctggccgaggagcagtaccaggactttgaggcccgctacgtgcaggccaagctgtctgtgcatgacaggagcctgaaggtggccaccgtcatcgagagcctggagatggagatggagctgctgtgcctgactggagtggaggaccagctgcaggctgatgtgcggcccaccctggagaccctgagaaatgccggcatcaaggtgtggatgctgactggagacaagctggagacagccacctgcacagccaagaatgcccacctggtgaccaggaaccaggacatccacgtgttccggctggtgaccaacagaggagaggcccacctggagctgaatgccttccggaggaagcatgactgtgccctggtgatcagcggggacagcctggaggtgtgcctgaagtactatgaatatgagttcatggagctggcctgccagtgcccagctgtggtgtgctgccgctgtgcccccacccagaaggcccagatcgtgcggctgctgcaggagaggacaggcaagctgacctgtgctgtgggagatggcggcaatgatgtgtccatgatccaggagagtgactgtggggtgggcgtggagggcaaggagggcaagcaggccagcctggccgctgacttcagcatcacccagttcaagcacctgggccgcctgctgatggtgcatggaagaaattcctacaagaggtctgctgccctgagccagtttgtgatccacaggagcctgtgcatcagcaccatgcaggccgtgttcagcagcgtcttctactttgcctctgtgcccctgtaccagggcttcctgatcatcggctacagcaccatctacaccatgtttcctgtgttcagcctggtgctggacaaggatgtgaagtctgaggtggccatgctgtacccagagctgtacaaggacctgctgaagggccggcccctgagctacaagaccttcctgatctgggtgctgatcagcatctaccagggcagcaccatcatgtacggggccctgctgctgtttgagagcgagtttgtgcacatcgtggccatctccttcaccagcctcatcctgacagagctgctgatggtggccctgaccatccagacctggcactggctgatgacagtggccgagctgctgagcctggcctgctacatcgccagcctggtgttcctgcacgagttcattgatgtgtacttcatcgccaccctgtccttcctgtggaaggtgtctgtcatcaccctggtgtcctgcctgcccctgtatgtgctgaagtacctgcggcggcgcttcagccccccatcctacagcaagctgaccagctag

SEQ ID NO: 32492 - DNA, 2781 bp, Artificial Sequence
  Description of Artificial Sequence: Synthetic coding sequence
atgacagacaacatccccctgcagcctgtgcggcagaagaagaggatggacagccggccccgggccggctgctgtgagtggctgcgctgctgcggcggcggggaggcccggcccaggacagtgtggctgggccaccctgagaagagggaccagcgctaccccagaaatgtcatcaacaaccagaagtacaacttcttcaccttcctgcccggggtgctcttcaaccagttcaagtacttcttcaacctgtacttcctgctgctggcctgcagccagtttgtgcctgagatgaggctgggcgccctgtacacctactgggtgcccctgggctttgtgctggccgtgaccgtcatccgggaggccgtggaggagatccgctgctacgtgcgggacaaggaggtgaacagccaggtgtacagccggctgacagcccggggcaccgtggtgggcgtggtgctgtacacaggccgggagctgcggtctgtgatgaacaccagcaaccccaggagcaagattggcctgtttgacctggaggtgaactgcctgaccaagatcctgtttggagccctggtggtggtgtccctggtgatggtggccctgcagcactttgctggccgctggtacctgcagatcatccgcttcctgctgctcttcagcaacatcatccccatcagcctgcgggtgaacctggacatgggcaagatcgtgtacagctgggtgatccggcgggacagcaagatccctggcaccgtggtgcgcagcagcaccatccctgagcagctgggccgcatctcctacctgctgacagacaagacaggcaccctgacccagaatgagatgatcttcaagaggctgcacctgggcaccgtggcctacggcctggacagcatggatgaggtgcagagccacatcttcagcatctacacccagcagagccaggaccccccagcccagaagggccccaccctgaccaccaaggtgcggaggaccatgagcagccgggtgcatgaggccgtgaaggccatcgccctgtgccacaacgtgacccctgtgtatgagagcaatggagtgacagaccaggccgaggccgagaagcagtatgaggacagctgccgggtgtaccaggccagcagcccagatgaggtggccctggtgcagtggacagagagcgtgggcctgaccctggtgggccgggaccagagctccatgcagctgcggacccctggggaccagatcctgaacttcaccatcctgcagatcttccccttcacctatgagagcaagaggatgggcatcatcgtgagagatgagagcactggagagatcaccttctacatgaagggagcagatgtggtgatggccggcatcgtgcagtacaatgactggctggaggaggagtgtggcaacatggcccgggagggcctgcgggtgctggtggtggccaagaagagcctggccgaggagcagtaccaggactttgaggcccgctacgtgcaggccaagctgtctgtgcatgacaggagcctgaaggtggccaccgtgattgagagcctggagatggagatggagctgctgtgcctgactggagtggaggaccagctgcaggctgatgtgcggcccaccctggagaccctgagaaatgccggcatcaaggtgtggatgctgaccggggacaagctggagacagccacctgcacagccaagaatgcccacctggtgaccaggaaccaggacatccacgtgttccggctggtgaccaacagaggagaggcccacctggagctgaatgccttccggaggaagcatgactgtgccctggtgatcagcggggacagcctggaggtgtgcctgaagtactatgaatatgagttcatggagctggcctgccagtgcccagctgtggtgtgctgccgctgtgcccccacccagaaggcccagatcgtgcggctgctgcaggagaggacaggcaagctgacctgtgctgtgggagatggcggcaatgatgtgtccatgatccaggagagtgactgtggggtgggcgtggagggcaaggagggcaagcaggccagcctggccgctgacttcagcatcacccagttcaagcacctgggccgcctgctgatggtgcacggcaggaacagctacaagaggtctgctgccctgagccagtttgtgatccacaggagcctgtgcatcagcaccatgcaggccgtgttcagctctgtgttctactttgcctctgtgcccctgtaccagggcttcctgatcatcggctacagcaccatctacaccatgtttcctgtgttcagcctggtgctggacaaggatgtgaagtctgaggtggccatgctgtacccagagctgtacaaggacctgctgaagggccggcccctgagctacaagaccttcctgatctgggtgctgatcagcatctaccagggcagcaccatcatgtatggagccctgctgctgtttgaaagtgaatttgtgcacatcgtggccatctccttcaccagcctcatcctgacagagctgctgatggtggccctgaccatccagacctggcactggctgatgacagtggccgagctgctgagcctggcctgctacatcgccagcctggtgttcctgcacgagttcattgatgtgtacttcatcgccaccctgtccttcctgtggaaggtgtctgtcatcaccctggtgtcctgcctgcccctgtatgtgctgaagtacctgcggcggcgcttcagcccccccagctacagcaagctgaccagctag

SEQ ID NO: 32493 - DNA, 4386 bp, Artificial Sequence
  Description of Artificial Sequence: Synthetic coding sequence
atggccctgtctgtggacagctcctggcaccgctggcagtggagggtgagagatggcttcccccactgccccagcgagaccacccccctgctgagccctgagaagggccggcagagctacaacctgacccagcagagggtggtgttccccaacaacagcatcttccaccaggactgggaggaggtgagccgccgctacccaggcaacagaacctgcaccaccaagtacaccctcttcaccttcctgcccaggaacctgtttgagcagttccaccgctgggccaacctgtacttcctgttcctggtgatcctgaactggatgcccagcatggaggtgttccaccgggagatcaccatgctgcccctggccatcgtgctgtttgtgatcatgatcaaggatggcatggaggacttcaagaggcacagatttgacaaggccatcaactgcagcaacatccgcatctatgaaaggaaggagcagacctacgtgcagaagtgctggaaggatgtgcgggtgggggacttcatccagatgaagtgcaatgaaattgtgcctgctgacatcctgctgctcttcagcagtgaccccaacggcatctgccacctggagacagccagcctggatggagagaccaacctgaagcagagatgtgtggtgaagggcttcagccagcaggaggtgcagtttgagcctgagctgttccacaacaccatcgtgtgtgagaagcccaacaaccacctgaacaagttcaagggctacatggagcacccagaccagaccaggacaggcttcggctgtgagagcctgctgctgcggggctgcaccatccggaacacagagatggctgtgggcatcgtcatctatgccggccacgagaccaaggccatgctgaacaacagcggcccccgctacaagaggagcaagattgaaagaaggatgaacatcgacatcttcttctgcatcggcatcctgatcctgatgtgcctgattggagctgtgggccacagcatctggaatggcacctttgaggagcaccccccatttgatgtgcctgatgccaacggcagcttcctgcccagcgccctgggcggcttctacatgttcctgaccatgatcatcctgctgcaggtgctgatccccatcagcctgtatgtgtccattgagctggtgaagctgggccaggtgttcttcctgagcaatgacctggacctgtatgatgaggagacagacctgagcatccagtgccgggccctgaacattgctgaggacctgggccagatccagtacatcttcagtgacaagacaggcaccctgacagagaacaagatggtgttccgccgctgcaccatcatgggcagcgagtacagccaccaggagaatgccaagaggctggagacccccaaggagctggacagtgatggagaggagtggacccagtaccagtgcctgtccttcagcgcccgctgggcccaggaccctgccaccatgaggagccagaagggggcccagcccctgcggcgcagccagagcgcccgggtgcccatccagggccactaccggcagaggtccatgggccaccgggagagcagccagccccctgtggccttcagcagcagcattgagaaggatgtgaccccagacaagaacctgctgaccaaggtgagagatgctgccctgtggctggagaccctgagtgacagcaggcctgccaaggccagcctgagcaccaccagcagcattgctgacttcttcctggccctgaccatctgcaacagcgtgatggtgtccaccaccacagagccccggcagagggtgaccatcaagcccagcagcaaggccctgggcaccagcctggagaagatccagcagctgttccagaagctgaagctgctgagcctgagccagagcttcagcagcacagcccccagcgacacagacctgggggagagcctgggcgccaacgtggccaccacagacagtgatgaaagagatgatgcctctgtgtgcagcggcggggacagcacagatgatggcggctaccgcagctccatgtgggaccagggcgacatcctggagagcggcagcggcaccagcctggaggaggccctggaggccccagccacagacctggcccggcctgagttctgctatgaagctgagagcccagatgaagctgccctggtgcacgccgcccacgcctacagcttcaccctggtgtccaggaccccagagcaggtgacagtgcggctgccccagggcacctgcctgaccttcagcctgctgtgcaccctgggctttgacagcgtgaggaagaggatgtctgtggtggtgcgccaccccctgaccggggagatcgtggtgtacaccaagggagctgacagcgtcatcatggacctgctggaggaccctgcctgtgtgcctgacatcaacatggagaagaagctgaggaagatccgggcccggacccagaagcacctggacctgtatgccagagatggcctgcggaccctgtgcatcgccaagaaggtggtgtctgaggaggacttccgccgctgggccagcttccggcgggaggccgaggccagcctggacaacagagatgagctgctgatggagacagcccagcacctggagaaccagctgaccctgctgggcgccactggaattgaggaccggctgcaggagggcgtgcctgacaccatcgccaccctgcgggaggccggcatccagctgtgggtgctgactggagacaagcaggagacagctgtgaacatcgcccacagctgccgcctgctgaaccagacagacacagtgtacaccatcaacacagagaaccaggagacctgtgagagcatcctgaactgtgccctggaggagctgaagcagttccgggagctgcagaagccagacaggaagctgtttggcttccggctgcccagcaagacccccagcatcaccagcgaggccgtggtgcctgaggccggcctggtgattgatggcaagaccctgaatgccatcttccagggcaagctggagaagaagttcctggagctgacccagtactgccgctctgtgctgtgctgccgcagcacccccctgcagaagtccatgattgtgaagctggtgcgggacaagctgcgggtgatgaccctgagcattggagatggagccaatgatgtgtccatgatccaggccgctgacatcggcatcggcatcagcggccaggagggcatgcaggccgtgatgagcagtgactttgccatcacccgcttcaagcacctgaagaagctgctgctggtgcacggccactggtgctacagccggctggccaggatggtggtgtactacctgtacaagaatgtgtgctacgtgaacctgctcttctggtaccagttcttctgtggcttcagcagcagcaccatgattgactactggcagatgatcttcttcaacctcttcttcaccagcctgccccccctggtgtttggagtgctggacaaggacatctctgctgagaccctgctggccctgcctgagctgtacaagagcggccagaacagcgagtgctacaacctgagcaccttctggatctccatggtggatgccttctaccagagcctcatctgcttcttcatcccctacctggcctacaagggcagtgacattgatgtgttcaccttcggcacccccatcaacaccatcagcctgaccaccatcctgctgcaccaggccatggagatgaagacctggaccatcttccacggcgtggtgctgctgggcagcttcctgatgtacttcctggtgtccctgctgtacaatgccacctgtgtgatctgcaacagccccaccaacccctactgggtgatggagggccagctgagcaaccccaccttctacctggtgtgcttcctgacccctgtggtggccctgctgccccgctacttcttcctgagcctgcagggcacctgtgggaagagcctcatcagcaaggcccagaagattgacaagctgcccccagacaagaggaacctggagatccagagctggaggagccggcagaggcctgcccctgtgcctgaggtggcccggcccacccaccaccctgtgagcagcatcaccggccaggacttcagcgccagcacccccaagagcagcaacccccccaagaggaagcacgtggaggagagcgtgctgcacgagcagagatgtggcacagagtgcatgagagatgacagctgcagcggggacagcagcgcccagctgagcagtggagagcacctgctgggccccaaccgcatcatggcctacagccggggccagacagacatgtgccgctgcagcaagaggagcagccacagaagaagccagagcagcctgaccatctag

SEQ ID NO: 32494 - DNA, 4281 bp, Artificial Sequence
  Description of Artificial Sequence: Synthetic coding sequence
atgacagaggccctgcagtgggcccgctaccactggaggaggctcatccggggggccaccagagatgatgattctggcccctacaactacagcagcctgctggcctgtggcaggaagagcagccagacccccaagctgagcggccgccaccgcatcgtggtgccccacatccagcccttcaaggatgaatatgagaagttcagcggggcctacgtgaacaaccgcatccgcaccaccaagtacaccctgctgaactttgtgcccaggaacctgtttgagcagttccaccgggccgccaacctgtacttcctgttcctggtggtgctgaactgggtgcccctggtggaggccttccagaaggagatcaccatgctgcccctggtggtggtgctgaccatcatcgccatcaaggatggcctggaggactacaggaagtacaagattgacaagcagatcaacaacctgatcaccaaggtgtacagcaggaaggagaagaagtacatcgaccgctgctggaaggatgtgacagtgggggacttcatccggctgagctgcaatgaggtgatcccagctgacatggtgctgctcttcagcacagatcctgatggcatctgccacatcgagaccagcggcctggatggagagagcaacctgaagcagaggcaggtggtgcggggctacgccgagcaggacagcgaggtggaccctgagaagttcagcagcagaattgaatgtgagagccccaacaatgacctgagccgcttccggggcttcctggagcacagcaacaaggagcgggtgggcctgagcaaggagaacctgctgctgcggggctgcaccatccggaacacagaggccgtggtgggcatcgtggtgtatgccggccacgagaccaaggccatgctgaacaacagcggcccccgctacaagaggagcaagctggagcggcgggccaacacagatgtgctgtggtgtgtgatgctgctggtgatcatgtgcctgactggagctgtgggccacggcatctggctgagccgctatgagaagatgcacttcttcaacgtgcctgagccagatggccacatcatcagccccctgctggccggcttctacatgttctggaccatgatcatcctgctgcaggtgctgatccccatcagcctgtatgtgtccattgagatcgtgaagctgggccagatctacttcatccagagtgatgtggacttctacaatgagaagatggacagcatcgtgcagtgccgggccctgaacattgctgaggacctgggccagatccagtacctgttcagtgacaagacaggcaccctgacagagaacaagatggtgttccgccgctgcagcgtggccggctttgactactgccacgaggagaatgcccggcggctggagagctaccaggaggccgtgtctgaagatgaggacttcatcgacacagtgtctggcagcctgagcaacatggccaagccccgggcccccagctgcaggacagtgcacaacggccccctgggcaacaagcccagcaaccacctggccggcagcagcttcaccctgggcagcggggagggcgccagcgaggtgccccacagccggcaggccgccttcagcagccccattgaaacagatgtggtgcctgacacccggctgctggacaagttcagccagatcacccccaggctcttcatgcccctggatgagaccatccagaacccccccatggagaccctgtacatcatcgacttcttcatcgccctggccatctgcaacacagtggtggtgtctgcccccaaccagccccggcagaagatccgccaccccagcctgggcggcctgcccatcaagagcctggaggagatcaagagcctcttccagcgctggagcgtgagaagaagcagcagccccagcctgaacagcggcaaggagcccagcagcggcgtgcccaatgcctttgtgtcccggctgcccctcttcagcaggatgaagccagccagccctgtggaggaggaggtgtcccaggtgtgtgagagcccccagtgcagcagcagcagcgcctgctgcacagaaacagagaagcagcacggagatgctggcctgctgaatggcaaggccgagagcctgcccggccagcccctggcctgcaacctgtgctatgaagctgagagcccagatgaagctgccctggtgtatgctgcccgggcctaccagtgcaccctgcggagcaggaccccagagcaggtgatggtggactttgctgccctgggccccctgaccttccagctgctgcacatcctgccctttgacagcgtgaggaagaggatgtctgtggtggtgcgccaccccctgagcaaccaggtggtggtgtacaccaagggagctgacagcgtcatcatggagctgctgtctgtggccagcccagatggagccagcctggagaagcagcagatgattgtgcgggagaagacccagaagcacctggatgattatgccaagcagggcctgcggaccctgtgcatcgccaagaaggtgatgtctgacacagaatatgcagagtggctgaggaaccacttcctggccgagaccagcattgacaaccgggaggagctgctgctggagagcgccatgaggctggagaacaagctgaccctgctgggcgccaccggcattgaagatcggctgcaggagggcgtgcctgagagcattgaggccctgcacaaggccggcatcaagatctggatgctgaccggggacaagcaggagacagctgtgaacatcgcctatgcctgcaagctgctggagccagatgacaagctgttcatcctgaacacccagagcaaggatgcctgtggcatgctgatgagcaccatcctgaaggagctgcagaagaagacccaggccctgcctgagcaggtgtccctgtctgaggacctgctgcagccccctgtgccccgggacagcggcctgcgggccggcctcatcatcaccgggaagaccctggagtttgccctgcaggagagcctgcagaagcagttcctggagctgacctcctggtgccaggccgtggtgtgctgccgggccacccccctgcagaagtctgaggtggtgaagctggtgcgcagccacctgcaggtgatgaccctggccatcggagatggagccaatgatgtgtccatgatccaggtggccgacattggaattggagtgtctggccaggagggcatgcaggccgtgatggccagtgactttgctgtgtcccagttcaagcacctgagcaagctgctgctggtgcacggccactggtgctacacccggctgagcaacatgatcctgtacttcttctacaagaatgtggcctacgtgaacctgctcttctggtaccagttcttctgtggcttcagcggcacctccatgacagactactgggtgctgatcttcttcaacctgctcttcaccagcgcccctcctgtgatctatggagtgctggagaaggatgtgtctgctgagaccctgatgcagctgcctgagctgtaccgcagcggccagaagtctgaggcctacctgccccacaccttctggatcaccctgctggatgccttctaccagagcctggtgtgcttctttgtgccctacttcacctaccagggcagtgacacagacatctttgccttcggcaaccccctgaacacagctgccctcttcatcgtgctgctgcacctggtgattgagagcaagagcctgacctggatccacctgctggtgatcatcggcagcatcctgagctacttcctgtttgccatcgtgtttggagccatgtgtgtgacctgcaacccccccagcaacccctactggatcatgcaggagcacatgctggaccctgtgttctacctggtgtgcatcctgaccaccagcatcgccctgctgcccaggtttgtgtacagagtgctgcagggcagcctcttccccagccccatcctgcgggccaagcactttgaccggctgaccccagaggagaggaccaaggccctgaagaagtggagaggagctgggaagatgaaccaggtgaccagcaaatatgccaaccagagcgctgggaagtctggaagaagacccatgcctggccccagcgctgtgtttgccatgaagagcgccagcagctgtgccatcgagcagggcaacctgagcctgtgtgaaacagccctggaccagggctacagcgagaccaaggcctttgagatggccggccccagcaagggcaaggagagctag

SEQ ID NO: 32495 - DNA, 1608 bp, Artificial Sequence
  Description of Artificial Sequence: Synthetic coding sequence
atgacagaggccctgcagtgggcccgctaccactggaggaggctcatccggggggccaccagagatgatgattctggcccctacaactacagcagcctgctggcctgtggcaggaagagcagccagacccccaagctgagcggccgccaccgcatcgtggtgccccacatccagcccttcaaggatgaatatgagaagttcagcggggcctacgtgaacaaccgcatccgcaccaccaagtacaccctgctgaactttgtgcccaggaacctgtttgagcagttccaccgggccgccaacctgtacttcctgttcctggtggtgctgaactgggtgcccctggtggaggccttccagaaggagatcaccatgctgcccctggtggtggtgctgaccatcatcgccatcaaggatggcctggaggactacaggaagtacaagattgacaagcagatcaacaacctgatcaccaaggtgtacagcaggaaggagaagaagtacatcgaccgctgctggaaggatgtgacagtgggggacttcatccggctgagctgcaatgaggtgatcccagctgacatggtgctgctcttcagcacagatcctgatggcatctgccacatcgagaccagcggcctggatggagagagcaacctgaagcagaggcaggtggtgcggggctacgccgagcaggacagcgaggtggaccctgagaagttcagcagcagaattgaatgtgagagccccaacaatgacctgagccgcttccggggcttcctggagcacagcaacaaggagcgggtgggcctgagcaaggagaacctgctgctgcggggctgcaccatccggaacacagaggccgtggtgggcatcgtggtgtatgccggccacgagaccaaggccatgctgaacaacagcggcccccgctacaagaggagcaagctggagcggcgggccaacacagatgtgctgtggtgtgtgatgctgctggtgatcatgtgcctgactggagctgtgggccacggcatctggctgagccgctatgagaagatgcacttcttcaacgtgcctgagccagatggccacatcatcagccccctgctggccggcttctacatgttctggaccatgatcatcctgctgcagctgggccagatctacttcatccagagtgatgtggacttctacaatgagaagatggacagcatcgtgcagtgccgggccctgaacattgctgaggacctgggccagatccagtacctgttcagtgacaagacaggcaccctgacagagaacaagatggtgttccgccgctgcagcgtggccggctttgactactgccatgaagaaaatgcccggcggctggagagctaccaggaggccgtgtctgaagatgaggacttcatcgacacagtgtctggcagcctgagcaacatggccaagccccgggcccccagctgcaggacagtgcacaacggccccctgggcaacaagcccagcaaccacctggccggcagcagcttcaccctgggcagcggggagggcgccagcgaggtgccccacagccggcaggccgccttcagcagccccatcgtgtccatgaatgcctag

SEQ ID NO: 32496 - DNA, 3399 bp, Artificial Sequence
  Description of Artificial Sequence: Synthetic coding sequence
atgcagatggtgcccagcctgcccccagcctctgaatgtgccggggaggagaagagggtgggcaccaggacagtgtttgtgggcaaccaccctgtgtctgaaacagaggcctacatcgcccagcgcttctgtgacaaccgcatcgtgagcagcaagtacaccctgtggaacttcctgcccaagaacctgtttgagcagttccgccgcatcgccaacttctacttcctgatcatcttcctggtgcaggtgacagtggacacccccaccagccctgtgaccagcggcctgcccctcttcttcgtcatcaccgtgacagccatcaagcagggctatgaggactgcctgcggcacagagctgacaatgaggtgaacaagagcacagtgtacatcattgaaaatgccaagagggtgaggaaggagagcgagaagatcaaggtgggagatgtggtggaggtgcaggctgatgagaccttcccctgtgacctgatcctgctgagcagctgcaccacagatggcacctgctacgtgaccacagccagcctggatggagagagcaactgcaagacccactatgctgtgcgggacaccatcgccctgtgcacagctgagagcattgacaccctgcgggccgccattgaatgtgagcagccccagcctgacctgtacaagtttgtgggccgcatcaacatctacagcaacagcctggaggccgtggcccggagcctgggccctgagaacctgctgctgaagggggccaccctgaagaacacagagaagatctatggagtggccgtgtacacaggcatggagaccaagatggccctgaactaccagggcaagagccagaagaggtctgctgtggagaagagcatcaatgccttcctgattgtgtacctgttcatcctgctgaccaaggctgctgtgtgcaccaccctgaagtatgtgtggcagagcaccccctacaatgatgagccctggtacaaccagaagacccagaaggagcgggagaccctgaaggtgctgaagatgttcacagacttcctgtccttcatggtgctcttcaacttcatcatccctgtgtccatgtatgtgacagtggagatgcagaagttcctgggcagcttcttcatctcctgggacaaggacttctatgatgaggagatcaatgaaggagccctggtgaacaccagtgacctgaatgaggagctgggccaggtggactatgtgttcacagacaagacaggcaccctgacagaaaattccatggagttcatcgagtgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagaatctgctgagctgacctacatcagcagcagcccagatgagatcgccctggtgaagggggccaagagatatggcttcaccttcctgggcaacagaaatggctacatgagggtggagaaccagaggaaggagattgaggagtatgagctgctgcacaccctgaactttgatgctgtgagaagaaggatgtctgtgattgtgaagacccaggagggggacatcctgctcttctgcaagggagctgacagcgctgtgttcccccgggtgcagaaccatgaaattgagctgaccaaggtgcacgtggagagaaatgccatggatggctaccgcaccctgtgtgtggccttcaaggagatcgccccagatgattatgagcgcatcaaccggcagctgattgaggccaagatggccctgcaggaccgggaggagaagatggagaaggtgtttgatgacatcgagaccaacatgaacctgattggagccacagctgtggaggacaagctgcaggaccaggccgctgagaccatcgaggccctgcacgccgccggcctgaaggtgtgggtgctgactggagacaagatggagacagccaagagcacctgctacgcctgccgcctcttccagaccaacacagagctgctggagctgaccaccaagaccatcgaggagagcgagaggaaagaagatcggctgcacgagctgctgattgagtacaggaagaagctgctgcacgagttccccaagagcaccaggagcttcaagaaggcctggacagagcaccaggagtatggcctcatcattgatggcagcaccctgagcctcatcctgaacagcagccaggacagcagcagcaacaactacaagagcatcttcctgcagatctgcatgaagtgcacagctgtgctgtgctgcaggatggcccccctgcagaaggcccagatcgtgaggatggtgaagaacctgaagggcagccccatcaccctgagcattggagatggagccaatgatgtgtccatgatcctggagagccacgtgggcatcggcatcaagggcaaggagggccggcaggccgccaggaacagcgactacagcgtgcccaagttcaagcacctgaagaagctgctgctggcccacggccacctgtactacgtgagaattgcccacctggtgcagtacttcttctacaagaacctgtgcttcatcctgccccagttcctgtaccagttcttctgtggcttcagccagcagcccctgtatgatgctgcctacctgaccatgtacaacatctgcttcaccagcctgcccatcctggcctacagcctgctggagcagcacatcaacatcgacaccctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgcccggaggaacctgagctgcagaagagccagtgacagcctgagcgcccggcccagcgtgcggcccctgctgctgcggaccttcagtgatgagagcaatgtgctgtag

SEQ ID NO: 32497 - DNA, 3327 bp, Artificial Sequence
  Description of Artificial Sequence: Synthetic coding sequence
atgcagatggtgcccagcctgcccccagcctctgaatgtgccggggaggagaagagggtgggcaccaggacagtgtttgtgggcaaccaccctgtgtctgaaacagaggcctacatcgcccagcgcttctgtgacaaccgcatcgtgagcagcaagtacaccctgtggaacttcctgcccaagaacctgtttgagcagttccgccgcatcgccaacttctacttcctgatcatcttcctggtgcaggtgacagtggacacccccaccagccctgtgaccagcggcctgcccctcttcttcgtcatcaccgtgacagccatcaagcagggctatgaggactgcctgcggcacagagctgacaatgaggtgaacaagagcacagtgtacatcattgaaaatgccaagagggtgaggaaggagagcgagaagatcaaggtgggagatgtggtggaggtgcaggctgatgagaccttcccctgtgacctgatcctgctgagcagctgcaccacagatggcacctgctacgtgaccacagccagcctggatggagagagcaactgcaagacccactatgctgtgcgggacaccatcgccctgtgcacagctgagagcattgacaccctgcgggccgccattgaatgtgagcagccccagcctgacctgtacaagtttgtgggccgcatcaacatctacagcaacagcctggaggccgtggcccggagcctgggccctgagaacctgctgctgaagggggccaccctgaagaacacagagaagatctatggagtggccgtgtacacaggcatggagaccaagatggccctgaactaccagggcaagagccagaagaggtctgctgtggagaagagcatcaatgccttcctgattgtgtacctgttcatcctgctgaccaaggctgctgtgtgcaccaccctgaagtatgtgtggcagagcaccccctacaatgatgagccctggtacaaccagaagacccagaaggagcgggagaccctgaaggtgctgaagatgttcacagacttcctgtccttcatggtgctcttcaacttcatcatccctgtgtccatgtatgtgacagtggagatgcagaagttcctgggcagcttcttcatctcctgggacaaggacttctatgatgaggagatcaatgaaggagccctggtgaacaccagtgacctgaatgaggagctgggccaggtggactatgtgttcacagacaagacaggcaccctgacagaaaattccatggagttcatcgagtgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagaatctgctgagctgacctacatcagcagcagcccagatgagatcgccctggtgaagggggccaagagatatggcttcaccttcctgggcaacagaaatggctacatgagggtggagaaccagaggaaggagattgaggagtatgagctgctgcacaccctgaactttgatgctgtgagaagaaggatgtctgtgattgtgaagacccaggagggggacatcctgctcttctgcaagggagctgacagcgctgtgttcccccgggtgcagaaccatgaaattgagctgaccaaggtgcacgtggagagaaatgccatggatggctaccgcaccctgtgtgtggccttcaaggagatcgccccagatgattatgagcgcatcaaccggcagctgattgaggccaagatggccctgcaggaccgggaggagaagatggagaaggtgtttgatgacatcgagaccaacatgaacctgattggagccacagctgtggaggacaagctgcaggaccaggccgctgagaccatcgaggccctgcacgccgccggcctgaaggtgtgggtgctgactggagacaagatggagacagccaagagcacctgctacgcctgccgcctcttccagaccaacacagagctgctggagctgaccaccaagaccatcgaggagagcgagaggaaagaagatcggctgcacgagctgctgattgagtacaggaagaagctgctgcacgagttccccaagagcaccaggagcttcaagaaggcctggacagagcaccaggagtatggcctcatcattgatggcagcaccctgagcctcatcctgaacagcagccaggacagcagcagcaacaactacaagagcatcttcctgcagatctgcatgaagtgcacagctgtgctgtgctgcaggatggcccccctgcagaaggcccagatcgtgaggatggtgaagaacctgaagggcagccccatcaccctgagcattggagatggagccaatgatgtgtccatgatcctggagagccacgtgggcatcggcatcaagggcaaggagggccggcaggccgccaggaacagcgactacagcgtgcccaagttcaagcacctgaagaagctgctgctggcccacggccacctgtactacgtgagaattgcccacctggtgcagtacttcttctacaagaacctgtgcttcatcctgccccagttcctgtaccagttcttctgtggcttcagccagcagcccctgtatgatgctgcctacctgaccatgtacaacatctgcttcaccagcctgcccatcctggcctacagcctgctggagcagcacatcaacatcgacaccctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgcccgggtgcaccacctgatcagcagcagcgcctag

SEQ ID NO: 32498 - DNA, 3360 bp, Artificial Sequence
  Description of Artificial Sequence: Synthetic coding sequence
atgcagatggtgcccagcctgcccccagcctctgaatgtgccggggaggagaagagggtgggcaccaggacagtgtttgtgggcaaccaccctgtgtctgaaacagaggcctacatcgcccagcgcttctgtgacaaccgcatcgtgagcagcaagtacaccctgtggaacttcctgcccaagaacctgtttgagcagttccgccgcatcgccaacttctacttcctgatcatcttcctggtgcaggtgacagtggacacccccaccagccctgtgaccagcggcctgcccctcttcttcgtcatcaccgtgacagccatcaagcagggctatgaggactgcctgcggcacagagctgacaatgaggtgaacaagagcacagtgtacatcattgaaaatgccaagagggtgaggaaggagagcgagaagatcaaggtgggagatgtggtggaggtgcaggctgatgagaccttcccctgtgacctgatcctgctgagcagctgcaccacagatggcacctgctacgtgaccacagccagcctggatggagagagcaactgcaagacccactatgctgtgcgggacaccatcgccctgtgcacagctgagagcattgacaccctgcgggccgccattgaatgtgagcagccccagcctgacctgtacaagtttgtgggccgcatcaacatctacagcaacagcctggaggccgtggcccggagcctgggccctgagaacctgctgctgaagggggccaccctgaagaacacagagaagatctatggagtggccgtgtacacaggcatggagaccaagatggccctgaactaccagggcaagagccagaagaggtctgctgtggagaagagcatcaatgccttcctgattgtgtacctgttcatcctgctgaccaaggctgctgtgtgcaccaccctgaagtatgtgtggcagagcaccccctacaatgatgagccctggtacaaccagaagacccagaaggagcgggagaccctgaaggtgctgaagatgttcacagacttcctgtccttcatggtgctcttcaacttcatcatccctgtgtccatgtatgtgacagtggagatgcagaagttcctgggcagcttcttcatctcctgggacaaggacttctatgatgaggagatcaatgaaggagccctggtgaacaccagtgacctgaatgaggagctgggccaggtggactatgtgttcacagacaagacaggcaccctgacagaaaattccatggagttcatcgagtgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagaatctgctgagctgacctacatcagcagcagcccagatgagatcgccctggtgaagggggccaagagatatggcttcaccttcctgggcaacagaaatggctacatgagggtggagaaccagaggaaggagattgaggagtatgagctgctgcacaccctgaactttgatgctgtgagaagaaggatgtctgtgattgtgaagacccaggagggggacatcctgctcttctgcaagggagctgacagcgctgtgttcccccgggtgcagaaccatgaaattgagctgaccaaggtgcacgtggagagaaatgccatggatggctaccgcaccctgtgtgtggccttcaaggagatcgccccagatgattatgagcgcatcaaccggcagctgattgaggccaagatggccctgcaggaccgggaggagaagatggagaaggtgtttgatgacatcgagaccaacatgaacctgattggagccacagctgtggaggacaagctgcaggaccaggccgctgagaccatcgaggccctgcacgccgccggcctgaaggtgtgggtgctgactggagacaagatggagacagccaagagcacctgctacgcctgccgcctcttccagaccaacacagagctgctggagctgaccaccaagaccatcgaggagagcgagaggaaagaagatcggctgcacgagctgctgattgagtacaggaagaagctgctgcacgagttccccaagagcaccaggagcttcaagaaggcctggacagagcaccaggagtatggcctcatcattgatggcagcaccctgagcctcatcctgaacagcagccaggacagcagcagcaacaactacaagagcatcttcctgcagatctgcatgaagtgcacagctgtgctgtgctgcaggatggcccccctgcagaaggcccagatcgtgaggatggtgaagaacctgaagggcagccccatcaccctgagcattggagatggagccaatgatgtgtccatgatcctggagagccacgtgggcatcggcatcaagggcaaggagggccggcaggccgccaggaacagcgactacagcgtgcccaagttcaagcacctgaagaagctgctgctggcccacggccacctgtactacgtgagaattgcccacctggtgcagtacttcttctacaagaacctgtgcttcatcctgccccagttcctgtaccagttcttctgtggcttcagccagcagcccctgtatgatgctgcctacctgaccatgtacaacatctgcttcaccagcctgcccatcctggcctacagcctgctggagcagcacatcaacatcgacaccctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgccaggaaccccaacctggagctgcccatgctgctgagctacaagcacacagacagcggctacagctag

SEQ ID NO: 32499 - DNA, 3387 bp, Artificial Sequence
  Description of Artificial Sequence: Synthetic coding sequence
atgcagatggtgcccagcctgcccccagcctctgaatgtgccggggaggagaagagggtgggcaccaggacagtgtttgtgggcaaccaccctgtgtctgaaacagaggcctacatcgcccagcgcttctgtgacaaccgcatcgtgagcagcaagtacaccctgtggaacttcctgcccaagaacctgtttgagcagttccgccgcatcgccaacttctacttcctgatcatcttcctggtgcaggtgacagtggacacccccaccagccctgtgaccagcggcctgcccctcttcttcgtcatcaccgtgacagccatcaagcagggctatgaggactgcctgcggcacagagctgacaatgaggtgaacaagagcacagtgtacatcattgaaaatgccaagagggtgaggaaggagagcgagaagatcaaggtgggagatgtggtggaggtgcaggctgatgagaccttcccctgtgacctgatcctgctgagcagctgcaccacagatggcacctgctacgtgaccacagccagcctggatggagagagcaactgcaagacccactatgctgtgcgggacaccatcgccctgtgcacagctgagagcattgacaccctgcgggccgccattgaatgtgagcagccccagcctgacctgtacaagtttgtgggccgcatcaacatctacagcaacagcctggaggccgtggcccggagcctgggccctgagaacctgctgctgaagggggccaccctgaagaacacagagaagatctatggagtggccgtgtacacaggcatggagaccaagatggccctgaactaccagggcaagagccagaagaggtctgctgtggagaagagcatcaatgccttcctgattgtgtacctgttcatcctgctgaccaaggctgctgtgtgcaccaccctgaagtatgtgtggcagagcaccccctacaatgatgagccctggtacaaccagaagacccagaaggagcgggagaccctgaaggtgctgaagatgttcacagacttcctgtccttcatggtgctcttcaacttcatcatccctgtgtccatgtatgtgacagtggagatgcagaagttcctgggcagcttcttcatctcctgggacaaggacttctatgatgaggagatcaatgaaggagccctggtgaacaccagtgacctgaatgaggagctgggccaggtggactatgtgttcacagacaagacaggcaccctgacagaaaattccatggagttcatcgagtgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagaatctgctgagctgacctacatcagcagcagcccagatgagatcgccctggtgaagggggccaagagatatggcttcaccttcctgggcaacagaaatggctacatgagggtggagaaccagaggaaggagattgaggagtatgagctgctgcacaccctgaactttgatgctgtgagaagaaggatgtctgtgattgtgaagacccaggagggggacatcctgctcttctgcaagggagctgacagcgctgtgttcccccgggtgcagaaccatgaaattgagctgaccaaggtgcacgtggagagaaatgccatggatggctaccgcaccctgtgtgtggccttcaaggagatcgccccagatgattatgagcgcatcaaccggcagctgattgaggccaagatggccctgcaggaccgggaggagaagatggagaaggtgtttgatgacatcgagaccaacatgaacctgattggagccacagctgtggaggacaagctgcaggaccaggccgctgagaccatcgaggccctgcacgccgccggcctgaaggtgtgggtgctgactggagacaagatggagacagccaagagcacctgctacgcctgccgcctcttccagaccaacacagagctgctggagctgaccaccaagaccatcgaggagagcgagaggaaagaagatcggctgcacgagctgctgattgagtacaggaagaagctgctgcacgagttccccaagagcaccaggagcttcaagaaggcctggacagagcaccaggagtatggcctcatcattgatggcagcaccctgagcctcatcctgaacagcagccaggacagcagcagcaacaactacaagagcatcttcctgcagatctgcatgaagtgcacagctgtgctgtgctgcaggatggcccccctgcagaaggcccagatcgtgaggatggtgaagaacctgaagggcagccccatcaccctgagcattggagatggagccaatgatgtgtccatgatcctggagagccacgtgggcatcggcatcaagggcaaggagggccggcaggccgccaggaacagcgactacagcgtgcccaagttcaagcacctgaagaagctgctgctggcccacggccacctgtactacgtgagaattgcccacctggtgcagtacttcttctacaagaacctgtgcttcatcctgccccagttcctgtaccagttcttctgtggcttcagccagcagcccctgtatgatgctgcctacctgaccatgtacaacatctgcttcaccagcctgcccatcctggcctacagcctgctggagcagcacatcaacatcgacaccctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgcccgggtgaccaagaggctgcccagcagcggcaccagcgccatcttcatgctgagccagaccagcagcaaccacagcttctcctggagcgagtag

SEQ ID NO: 32500 - DNA, 3342 bp, Artificial Sequence
  Description of Artificial Sequence: Synthetic coding sequence
atgttcagaagaagcctgaaccgcttctgtgccggggaggagaagagggtgggcaccaggacagtgtttgtgggcaaccaccctgtgtctgaaacagaggcctacatcgcccagcgcttctgtgacaacagaattgtgagcagcaagtacaccctgtggaacttcctgcccaagaacctgtttgagcagttcagaagaattgccaacttctacttcctgatcatcttcctggtgcaggtgacagtggacacccccaccagccctgtgaccagcggcctgcccctcttctttgtgatcaccgtgacagccatcaagcagggctatgaggactgcctgcggcacagagctgacaatgaggtgaacaagagcacagtgtacatcattgaaaatgccaagagggtgaggaaggagagcgagaagatcaaggtgggagatgtggtggaggtgcaggctgatgagaccttcccctgtgacctgatcctgctgagcagctgcaccacagatggcacctgctacgtgaccacagccagcctggatggagagagcaactgcaagacccactatgctgtgcgggacaccatcgccctgtgcacagctgagagcattgacaccctgcgggccgccattgaatgtgagcagccccagcctgacctgtacaagtttgtgggccgcatcaacatctacagcaacagcctggaggccgtggcccggagcctgggccctgagaacctgctgctgaagggggccaccctgaagaacacagagaagatctacggcgtggccgtgtacacaggcatggagaccaagatggccctgaactaccagggcaagagccagaagaggtctgctgtggagaagagcatcaatgccttcctgattgtgtacctgttcatcctgctgaccaaggctgctgtgtgcaccaccctgaagtatgtgtggcagagcaccccctacaatgatgagccctggtacaaccagaagacccagaaggagcgggagaccctgaaggtgctgaagatgttcacagacttcctgtccttcatggtgctcttcaacttcatcatccctgtgtccatgtatgtgacagtggagatgcagaagttcctgggcagcttcttcatctcctgggacaaggacttctatgatgaggagatcaatgaaggagccctggtgaacaccagtgacctgaatgaggagctgggccaggtggactatgtgttcacagacaagacaggcaccctgacagagaacagcatggagttcatcgagtgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagagagcgctgagctgacctacatcagcagcagcccagatgaaattgccctggtgaagggggccaagagatatggcttcaccttcctgggcaacagaaatggctacatgagggtggagaaccagaggaaggagattgaggagtatgagctgctgcacaccctgaactttgatgctgtgagaagaaggatgtctgtcatcgtgaagacccaggagggggacatcctgctcttctgcaagggagctgacagcgctgtgttcccccgggtgcagaaccacgagattgagctgaccaaggtgcacgtggagagaaatgccatggatggctaccgcaccctgtgtgtggccttcaaggagatcgccccagatgattatgaaagaatcaaccggcagctgattgaggccaagatggccctgcaggaccgggaggagaagatggagaaggtgtttgatgacatcgagaccaacatgaacctgattggagccacagctgtggaggacaagctgcaggaccaggccgctgagaccatcgaggccctgcatgctgctggcctgaaggtgtgggtgctgaccggggacaagatggagacagccaagagcacctgctacgcctgccgcctcttccagaccaacacagagctgctggagctgaccaccaagaccatcgaggagagcgagaggaaggaggaccggctgcacgagctgctgattgagtacaggaagaagctgctgcacgagttccccaagagcaccaggagcttcaagaaggcctggacagagcaccaggagtatggcctcatcattgatggcagcaccctgagcctcatcctgaacagcagccaggacagcagcagcaacaactacaagagcatcttcctgcagatctgcatgaagtgcacagctgtgctgtgctgcaggatggcccccctgcagaaggcccagatcgtgaggatggtgaagaacctgaagggcagccccatcaccctgagcattggagatggagccaatgatgtgtccatgatcctggagagccacgtgggcatcggcaaggagggccggcaggccgccaggaacagcgactacagcgtgcccaagttcaagcacctgaagaagctgctgctggcccacggccacctgtactacgtgagaattgcccacctggtgcagtacttcttctacaagaacctgtgcttcatcctgccccagttcctgtaccagttcttctgtggcttcagccagcagcccctgtatgatgctgcctacctgaccatgtacaacatctgcttcaccagcctgcccatcctggcctacagcctgctggagcagcacatcaacatcgacaccctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgccaggaaccccaacctggagctgcccatgctgctgagctacaagcacacagacagcggctacagctag

SEQ ID NO: 32501 - DNA, 609 bp, Artificial Sequence
  Description of Artificial Sequence: Synthetic coding sequence
tgagaatgctgcattgatggccacaagtacaagggcgtgacccaggaggtggatggcctgagccagacagatggcaccctgacctactttgacaaggtggacaagaaccgggaggagctgttcctgcgggccctgtgcctgtgccacacagtggagatcaagaccaatgatgctgtggatggagccacagaatctgctgagctgacctacatcagcagcagcccagatgagatcgccctggtgaagggggccaagagatatgagctgctgcacaccctgaactttgatgctgtgagaagaaggatgtctgtgattgtgaagacccaggagggggacatcctgctcttctgcaagggagctgacagcgctgtgttcccccgggtgcagaaccatgaaattgagctgaccaaggtgcacgtggagagaaatgccatggatggctaccgcaccctgtgtgtggccttcaaggagatcgccccagatgattatgagcgcatcaaccggcagctgattgaggccaagatggccctgcaggaccgggaggagaagatggagaaggtgtttgatgacatcgagaccaacatgaacctgattggagccacagcctag

SEQ ID NO: 32502 - DNA, 498 bp, Artificial Sequence
  Description of Artificial Sequence: Synthetic coding sequence
tgagaaggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccacttcgtcatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgcccggaggaacctgagctgccggcgggccagtgacagcctgagcgcccggcccagcgtgcggcccctgctgctgcggaccttcagtgatgagagcaatgtgctgtag

SEQ ID NO: 32503 - DNA, 519 bp, Artificial Sequence
  Description of Artificial Sequence: Synthetic coding sequence
accctgaccagtgacccccggctgtacatgaagatctctggaaatgccatgctgcagctgggccccttcctgtactggaccttcctggccgcctttgagggcaccgtcttcttcttcggcacctacttcctgttccagacagccagcctggaggagaatggcaaggtgtatggcaactggaccttcggcaccatcgtgttcaccgtgctggtgttcaccgtgaccctgaagctggccctggacacccgcttctggacctggatcaaccactttgtgatctggggcagcctggccttctacgtgttcttctccttcttctggggcggcatcatctggcccttcctgaagcagcagaggatgtactttgtgtttgcccagatgctgagctctgtgtccacctggctggccatcatcctgctgatcttcatcagcctcttccctgagatcctgctgattgtgctgaagaatgtgagaagaagaagtgcccgggtgcaccacctgatcagcagcagcgcctag

SEQ ID NO: 32504 - DNA, 357 bp, Artificial Sequence
  Description of Artificial Sequence: Synthetic coding sequence
atgaccagccagagccagggcatccaccagctgctgcaggccgagaagagggccaaggacaagctggaggaggccaagaagaggaagggcaagaggctgaagcaggccaaggaggaggccatggtggagattgaccagtacaggatgcagagggacaaggagttccggctgaagcagagcaagatcatgggcagccagaacaacctgagtgatgaaattgaggagcagaccctgggcaagatccaggagctgaatggccactacaacaagtacatggagagcgtgatgaaccagctgctgtccatggtgtgtgacatgaagccagagatccacgtgaactaccgggccaccaactag

SEQ ID NO: 32505 - DNA, 180 bp, Artificial Sequence
  Description of Artificial Sequence: Synthetic coding sequence
atgaccagccagagccagggcatccaccagctgctgcaggccgagaagagggccaaggacaagctggaggaggccaagaagatcctgcacctgctcttcctgaagaggcgggactgggactgcttctggaagaggaaggccatcgaggccagccagggcggcagcaatggaagaaattag

SEQ ID NO: 32506 - DNA, 375 bp, Artificial Sequence
  Description of Artificial Sequence: Synthetic coding sequence
atgaccagccagagccagggcatccaccagctgctgcaggccgagaagagggccaaggacaagctggaggaggccaagaagaagacaggaacagccagcggcaagggcaagaggctgaagcaggccaaggaggaggccatggtggagattgaccagtacaggatgcagagggacaaggagttccggctgaagcagagcaagatcatgggcagccagaacaacctgagtgatgaaattgaggagcagaccctgggcaagatccaggagctgaatggccactacaacaagtacatggagagcgtgatgaaccagctgctgtccatggtgtgtgacatgaagccagagatccacgtgaactaccgggccaccaactag

SEQ ID NO: 32507 - DNA, 357 bp, Artificial Sequence; identical to SEQ ID NO: 32504
  Description of Artificial Sequence: Synthetic coding sequence

SEQ ID NO: 32508 - DNA, 375 bp, Artificial Sequence; identical to SEQ ID NO: 32506
  Description of Artificial Sequence: Synthetic coding sequence

SEQ ID NO: 32509 - DNA, 360 bp, Artificial Sequence
  Description of Artificial Sequence: Synthetic coding sequence
atggccggccggggcaagctgattgctgtgattggagatgaggacacagtgacaggcttcctgctgggcggcattggagagctgaacaagaacagacaccccaacttcctggtggtggagaaggacaccaccatcaatgaaattgaggacaccttccggcagttcctgaacagagatgacatcggcatcatcctgatcaaccagtacatcgccgagatggtgagacatgccctggatgcccaccagcagagcatcccagctgtgctggagatccccagcaaggagcacccctatgatgctgccaaggacagcatcctgcggcgggcccggggcatgttcaccgctgaggacctgaggtag

SEQ ID NO: 32510 - DNA, 681 bp, Artificial Sequence
  Description of Artificial Sequence: Synthetic coding sequence
atggccctgagtgatgtggatgtgaagaagcagatcaagcacatgatggccttcatcgagcaggaggccaatgagaaggccgaggagattgatgccaaggccgaggaggagttcaacatcgagaagggccgcctggtgcagacccagaggctgaagatcatggagtactatgagaagaaggagaagcagatcgagcagcagaagaagatcctgatgagcaccatgaggaaccaggcccggctgaaggtgctgcgggccagaaatgacctgatcagtgacctgctgtctgaggccaagctgcggctgagcagaattgtggaggaccctgaggtgtaccagggcctgctggacaagctggtgctgcagggcctgctgcggctgctggagcctgtgatgattgtgcgctgccggccccaggacctgctgctggtggaggccgctgtgcagaaggccatccctgagtacatgaccatcagccagaagcacgtggaggtgcagattgacaaggaggcctacctggccgtgaatgctgctgggggcgtggaggtgtacagcggcaaccagaggatcaaggtgagcaacaccctggagagccggctggacctgagcgccaagcagaagatgcctgagatccgcatggccctgtttggagccaacaccaacaggaagttcttcatctag

SEQ ID NO: 32511 - DNA, 681 bp, Artificial Sequence; identical to SEQ ID NO: 32510
  Description of Artificial Sequence: Synthetic coding sequence

SEQ ID NO: 32512 - DNA, 999 bp, Artificial Sequence
  Description of Artificial Sequence: Synthetic coding sequence
atggctgctgtgttcctggtgaccctgtatgagtacagccccctcttctacatcgctgtggtgttcacctgcttcatcgtgaccaccggcctggtgctgggctggtttggctgggatgtgcctgtgatcctgagaaattctgaggagacccagttcagcaccagggtcttcaagaagcagatgaggcaggtgaagaaccccttcggcctggagatcaccaaccccagcagcgccagcatcaccaccggcatcaccctgaccacagactgcctggaggacagcctgctgacctgctactggggctgcagcgtgcagaagctgtatgaggccctgcagaagcacgtgtactgcttccgcatcagcaccccccaggccctggaggatgccctgtacagcgagtacctgtaccaggagcagtacttcatcaagaaggacagcaaggaggagatctactgccagctgccccgggacaccaagattgaagattttggaacagtgcccaggagccgctaccccctggtggccctgctgaccctggctgatgaagatgaccgggagatctatgacatcatctccatggtgtctgtcatccacatcccagacaggacctacaagctgagctgccgcatcctgtaccagtacctgctgctggcccagggccagttccatgacctgaagcagctgttcatgtctgccaacaacaacttcacccccagcaacaacagcagcagcgaggagaagaacacagacaggagcctgctggagaaggtgggcctgtctgagagcgaggtggagcccagcgaggagaacagcaaggactgtgtggtgtgccagaatggaacagtgaactgggtgctgctgccctgccgccacacctgcctgtgtgatggctgtgtgaagtacttccagcagtgccccatgtgccggcagtttgtgcaggagagctttgccctgtgcagccagaaggagcaggacaaggacaagcccaagaccctgtag

SEQ ID NO: 32513 - DNA, 744 bp, Artificial Sequence
  Description of Artificial Sequence: Synthetic coding sequence
atgtctgggaaggacagaattgagatcttccccagcaggatggcccagaccatcatgaaggcccggctgaagggggcccagacaggcaggaacctgctgaagaagaagagtgatgccctgaccctgcgcttccggcagatcctgaagaagatcatcgagaccaagatgctgatgggagaggtgatgagggaggccgccttcagcctggccgaggccaagttcaccgctggggacttcagcaccaccgtcatccagaatgtgaacaaggcccaggtgaagatccgggccaagaaggacaacgtggccggcgtgaccctgcctgtgtttgagcactaccacgagggcacagacagctatgagctgaccggcctggcccggggcggggagcagctggccaagctgaagaggaactatgccaaggctgtggagctgctggtggagctggccagcctgcagaccagctttgtgaccctggatgaggccatcaagatcaccaacagaagagtgaatgccatcgagcacgtgatcatcccccgcatcgagaggaccctggcctacatcatcacagagctggatgagcgggagcgggaggagttctaccgcctgaagaagatccaggagaagaagaagatcctgaaggagaagtctgagaaggacctggagcagaggagagctgctggggaggtgctggagcccgccaacctgctggccgaggagaaggatgaggacctgctgtttgaatag

SEQ ID NO: 32514 - DNA, 219 bp, Artificial Sequence
  Description of Artificial Sequence: Synthetic coding sequence
atgtctgggaaggacagaattgagatcttccccagcaggatggcccagaccatcatgaaggcccggctgaagggggcccagacaggcaggaacctgctgaagaagaagagtgatgccctgaccctgcgcttccggcagatcctgaagaagatcatcgagaccaagatgctgatgggagaggtgatgagggaggccgccttcagcctggccgaggcctag

SEQ ID NO: 32515 - DNA, 1053 bp, Artificial Sequence
  Description of Artificial Sequence: Synthetic coding sequence
atgctggagggcgctgagctgtacttcaacgtggaccacggctacctggagggcctggtgcggggctgcaaggccagcctgctgacccagcaggactacatcaacctggtgcagtgtgagaccctggaggacctgaagatccacctgcagaccacagattatggcaacttcctggccaaccacaccaaccccctgactgtgtccaagattgacacagagatgaggaagaggctgtgtggggagtttgagtacttcaggaaccacagcctggagcccctgagcaccttcctgacctacatgacctgcagctacatgattgacaacgtcatcctgctgatgaatggagccctgcagaagaagtctgtgaaggagatcctgggcaagtgccaccccctgggccgcttcacagagatggaggccgtgaacattgctgagacccccagcgacctcttcaatgccatcctgattgagacccccctggcccccttcttccaggactgcatgtctgaaaatgccctggatgagctgaacatcgagctgctgaggaacaagctgtacaagagctacctggaggccttctacaagttctgcaagaaccacggagatgtgacagctgaggtgatgtgccccatcctggagtttgaggccgaccggcgggccttcatcatcaccctgaacagctttggaacagagctgagcaaagaagatcgggagaccctgtaccccaccttcggcaagctgtacccagagggcctgcggctgctggcccaggctgaagattttgaccagatgaagaatgtggccgaccactatggagtgtacaagcccctgtttgaggccgtgggcggcagcggcggcaagaccctggaggatgtgttctatgaaagagaggtgcagatgaatgtgctggccttcaaccggcagttccactatggagtcttctacgcctacgtgaagctgaaggagcaggagatccggaacatcgtgtggattgctgagtgcatcagccagaggcacaggaccaagatcaacagctacatccccatcctgtag

SEQ ID NO: 32516 - DNA, 111 bp, Artificial Sequence
  Description of Artificial Sequence: Synthetic coding sequence
atgctggagggcgctgagctgtacttcaacgtggaccacggctacctggagggcctggtgcggggctgcaaggccagcctgctgacccagcaggactacatcaacctgtag

SEQ ID NO: 32517 - DNA, 132 bp, Artificial Sequence
  Description of Artificial Sequence: Synthetic coding sequence
atgctggagggcgctgagctgtacttcaacgtggaccacggctacctggagggcctggtgcggggctgcaaggccagcctgctgacccagcaggactacatcaacctggtgcagtgtgagaccctggagtag

SEQ ID NO: 32518 - DNA, 1284 bp, Artificial Sequence
  Description of Artificial Sequence: Synthetic coding sequence
atgtctgagttctggctgatcagcgcccctggggacaaggagaacctgcaggccctggagaggatgaacacagtgaccagcaagagcaacctgagctacaacaccaagtttgccatcccagacttcaaggtgggcaccctggacagcctggtgggcctgagtgatgagctgggcaagctggacacctttgctgagagcctcatccggaggatggcccagagcgtggtggaggtgatggaggacagcaagggcaaggtgcaggagcacctgctggccaatggagtggacctgaccagctttgtgacccactttgagtgggacatggccaagtaccctgtgaagcagcccctggtgtctgtggtggacaccatcgccaagcagctggcccagatcgagatggacctgaagagcaggacagctgcctacaacaccctgaagaccaacctggagaacctggagaagaagtccatgggcaacctcttcaccaggaccctgagtgacatcgtgtccaaggaggactttgtgctggacagcgagtacctggtgaccctgctggtgattgtgcccaagcccaactacagccagtggcagaagacctatgagagcctgagtgacatggtggtgcccaggagcaccaagctgatcacagaggacaaggagggcggcctcttcaccgtgaccctcttcaggaaggtgattgaggacttcaagaccaaggccaaggagaacaagttcaccgtgcgggagttctactatgatgagaaggagattgagcgggagcgggaggagatggcccggctgctgagtgacaagaagcagcagtaccagaccagctgtgtggccctgaagaagggcagcagcaccttcccagaccacaaggtgaaggtgacccccctgggcaacccagacaggcctgctgctggccagacagaccgggagcgggagagcgagggggagggggagggccccctgctgcgctggctgaaggtgaacttcagcgaggccttcatcgcctggatccacatcaaggccctgcgggtgtttgtggagagcgtgctgcgctatggcctgcctgtgaacttccaggccgtgctgctgcagccccacaagaagagcagcaccaagaggctgcgggaggtgctgaacagcgtcttccgccacctggatgaggtggccgccaccagcatcctggatgcctctgtggagatccctggcctgcagctgaacaaccaggactacttcccctacgtgtacttccacatcgacctgagcctgctggactag

SEQ ID NO: 32519 - DNA, 1146 bp, Artificial Sequence
  Description of Artificial Sequence: Synthetic coding sequence
atgtctgagttctggctgatcagcgcccctggggacaaggagaacctgcaggccctggagaggatgaacacagtgaccagcaagagcaacctgagctacaacaccaagtttgccatcccagacttcaaggtgggcaccctggacagcctggtgggcctgagtgatgagctgggcaagctggacacctttgctgagagcctcatccggaggatggcccagagcgtggtggaggtgatggaggacagcaagggcaaggtgcaggagcacctgctggccaatggagtggacctgaccagctttgtgacccactttgagtgggacatggccaagtaccctgtgaagcagcccctggtgtctgtggtggacaccatcgccaagcagctggcccagatcgagatggacctgaagagcaggacagctgcctacaacaccctgaagaccaacctggagaacctggagaagaagtccatgggcaacctcttcaccaggaccctgagtgacatcgtgtccaaggaggactttgtgctggacagcgagtacctggtgaccctgctggtgattgtgcccaagcccaactacagccagtggcagaagacctatgagagcctgagtgacatggtggtgcccaggagcaccaagctgatcacagaggacaaggagggcggcctcttcaccgtgaccctcttcaggaaggtgattgaggacttcaagaccaaggccaaggagaacaagttcaccgtgcgggagttctactatgatgagaaggagattgagcgggagcgggaggagatggcccggctgctgagtgacaagaagcagcagtatggccccctgctgcgctggctgaaggtgaacttcagcgaggccttcatcgcctggatccacatcaaggccctgcgggtgtttgtggagagcgtgctgcgctatggcctgcctgtgaacttccaggccgtgctgctgcagccccacaagaagagcagcaccaagaggctgcgggaggtgctgaacagcgtcttccgccacctggatgaggtggccgccaccagcatcctggatgcctctgtggagatccctggcctgcagctgaacaaccaggactacttcccctacgtgtacttccacatcgacctgagcctgctggactag

SEQ ID NO: 32520 - DNA, 1398 bp, Artificial Sequence
  Description of Artificial Sequence: Synthetic coding sequence
atgaccaagatggacatcagaggagctgtggatgctgctgtgcccaccaacatcatcgccgccaaggctgctgaggtgcgggccaacaaggtgaactggcagagctacctgcagggccagatgatctctgctgaggactgtgagttcatccagagatttgagatgaagaggagccctgaggagaagcaggagatgctgcagacagagggcagccagtgtgccaagaccttcatcaacctgatgacccacatctgcaaggagcagacagtgcagtacatcctgaccatggtggatgacatgctgcaggagaaccaccagagggtgtccatcttctttgattatgcccgctgcagcaagaacacagcctggccctacttcctgcccatgctgaaccggcaggaccccttcaccgtgcacatggccgcccgcatcatcgccaagctggccgcctggggcaaggagctgatggagggcagtgacctgaactactacttcaactggatcaagacccagctgagcagccagagcagccagtatgtgcagtgtgtggccggctgcctgcagctgatgctgcgggtgaatgagtacagatttgcctgggtggaggctgatggagtgaactgcatcatgggcgtgctgagcaacaagtgtggcttccagctgcagtaccagatgatcttcagcatctggctgctggccttcagcccccagatgtgtgagcacctgcggcgctacaacatcatccctgtgctgagtgacatcctgcaggagagcgtgaaggagaaggtgacccgcatcatcctggccgccttcaggaacttcctggagaagagcacagagcgggagacccggcaggagtatgccctggccatgatccagtgcaaggtgctgaagcagctggagaacctggagcagcagaagtatgatgatgaggacatcagcgaggacatcaagttcctgctggagaagctgggggagagcgtgcaggacctgagcagctttgatgagtacagcagcgagctgaagagcggccgcctggagtggagccctgtgcacaagtctgagaagttctggagagaaaatgctgtgcggctgaatgagaagaactatgagctgctgaagatcctgaccaagctgctggaggtgtctgatgacccccaggtgctggccgtggccgcccatgatgtgggggagtatgtgcgccactacccccggggcaagagggtcatcgagcagctgggcggcaagcagctggtgatgaaccacatgcaccacgaggaccagcaggtgcgctacaatgccctgctggccgtgcagaagctgatggtgcacaactgggagtacctgggcaagcagctgcagagcgagcagccccagacagctgctgcccggagctag

SEQ ID NO: 32521 - DNA, 1452 bp, Artificial Sequence
  Description of Artificial Sequence: Synthetic coding sequence
atgaccaagatggacatcagaggagctgtggatgctgctgtgcccaccaacatcatcgccgccaaggctgctgaggtgcgggccaacaaggtgaactggcagagctacctgcagggccagatgatctctgctgaggactgtgagttcatccagagatttgagatgaagaggagccctgaggagaagcaggagatgctgcagacagagggcagccagtgtgccaagaccttcatcaacctgatgacccacatctgcaaggagcagacagtgcagtacatcctgaccatggtggatgacatgctgcaggagaaccaccagagggtgtccatcttctttgattatgcccgctgcagcaagaacacagcctggccctacttcctgcccatgctgaaccggcaggaccccttcaccgtgcacatggccgcccgcatcatcgccaagctggccgcctggggcaaggagctgatggagggcagtgacctgaactactacttcaactggatcaagacccagctgagcagccagaagctgcggggcagcggcgtggccgtggagaccggcaccgtgagcagcagtgacagcagccagtatgtgcagtgtgtggccggctgcctgcagctgatgctgcgggtgaatgagtacagatttgcctgggtggaggctgatggagtgaactgcatcatgggcgtgctgagcaacaagtgtggcttccagctgcagtaccagatgatcttcagcatctggctgctggccttcagcccccagatgtgtgagcacctgcggcgctacaacatcatccctgtgctgagtgacatcctgcaggagagcgtgaaggagaaggtgacccgcatcatcctggccgccttcaggaacttcctggagaagagcacagagcgggagacccggcaggagtatgccctggccatgatccagtgcaaggtgctgaagcagctggagaacctggagcagcagaagtatgatgatgaggacatcagcgaggacatcaagttcctgctggagaagctgggggagagcgtgcaggacctgagcagctttgatgagtacagcagcgagctgaagagcggccgcctggagtggagccctgtgcacaagtctgagaagttctggagagaaaatgctgtgcggctgaatgagaagaactatgagctgctgaagatcctgaccaagctgctggaggtgtctgatgacccccaggtgctggccgtggccgcccatgatgtgggggagtatgtgcgccactacccccggggcaagagggtcatcgagcagctgggcggcaagcagctggtgatgaaccacatgcaccacgaggaccagcaggtgcgctacaatgccctgctggccgtgcagaagctgatggtgcacaactgggagtacctgggcaagcagctgcagagcgagcagccccagacagctgctgcccggagctag

SEQ ID NO: 32522 - DNA, 1452 bp, Artificial Sequence; identical to SEQ ID NO: 32521
  Description of Artificial Sequence: Synthetic coding sequence

SEQ ID NO: 32523 - DNA, 309 bp, Artificial Sequence
  Description of Artificial Sequence: Synthetic coding sequence
atgaccaagatggacatcagaggagctgtggatgctgctgtgcccaccaacatcatcgccgccaaggctgctgaggtgcgggccaacaaggtgaactggcagagctacctgcagggccagatgatctctgctgaggactgtgagttcatccagagatttgagatgaagaggagccctgaggagaagcaggagatgctgcagacagagggcagccagtgtgccaagaccttcatcaacctgatgacccacatctgcaaggagcagacagtgcagtacatcctgaccatggtggatgacatgctgcagtag

SEQ ID NO: 32524 - DNA, 306 bp, Artificial Sequence
  Description of Artificial Sequence: Synthetic coding sequence
atgaccaagatggacatcagaggagctgtggatgctgctgtgcccaccaacatcatcgccgccaaggctgctgaggtgcgggccaacaaggtgaactggcagagctacctgcagggccagatgatctctgctgaggactgtgagttcatccagagatttgagatgaagaggagccctgaggagaagcaggagatgctgcagacagagggcagccagtgtgccaagaccttcatcaacctgatgacccacatctgcaaggagcagacagtgcagtacatcctgaccatggtggatgacatgctgtag

SEQ ID NO: 32525 - DNA, 873 bp, Artificial Sequence
  Description of Artificial Sequence: Synthetic coding sequence
atgggagatggaggagctgagcgggaccggggccctgcccggcgggcagagagcggcggcggcggcggccgctgtggggacagaagtggagctggggacctgcgggcagatggcggcggccacagccccacagaggtggccggcaccagcgccagcagccctgctggcagccgggagagcggggctgacagtgatggccagcccggccctggagaggccgaccactgccgccgcatcctggtgagagatgccaagggcaccatccgggagatcgtgctgcccaagggcctggacctggaccggcccaagaggaccaggaccagcttcaccgctgagcagctgtaccgcctggagatggagttccagcgctgccagtatgtggtgggccgggagaggacagagctggcccggcagctgaacctgtctgagacccaggtgaaggtgtggttccagaacagaaggaccaagcagaagaaggaccagagccgggacctggagaagagggccagcagcagcgccagcgaggcctttgccaccagcaacatcctgcggctgctggagcagggccgcctgctgtctgtgccccgggcccccagcctgctggccctgacccccagcctgcccggcctgcctgccagccaccggggcaccagcctgggggaccccaggaacagcagcccccggctgaaccccctgagcagcgccagcgccagcccccccctgcccccacccctgcctgctgtgtgcttcagcagcgcccccctgctggacctgcctgctggctatgagctgggcagcagcgcctttgagccctacagctggctggagaggaaggtgggcagcgccagcagctgcaagaaggccaacacctag

SEQ ID NO: 32526 - DNA, 1491 bp, Artificial Sequence
  Description of Artificial Sequence: Synthetic coding sequence
atggccatggagattgacagcaggcctgggggcctgcccggcagcagctgcaacctgggcgccgcccgggagcacatgcaggccgtgaccaggaactacatcacccacccccgggtgacctacagaacagtgtgcagcgtgaatggccccctggtggtgctggacagagtgaagtttgcccagtatgcagaaattgtgcacttcaccctgcctgatggcacccagaggagcggccaggtgctggaggtggccggcaccaaggccatcgtgcaggtgtttgagggcaccagcggcattgatgccaggaagaccacctgtgagttcaccggggacatcctgcggacccctgtgtctgaggacatgctgggccgggtcttcaatggaagtggcaagcccatcgacaagggccctgtggtgatggccgaggacttcctggacatcaatggccagcccatcaacccccacagccgcatctacccagaggagatgatccagacaggcatcagccccattgatgtgatgaacagcatcgcccggggccagaagatccccatcttctctgctgctggcctgccccacaatgaaattgctgcccagatctgccggcaggccggcctggtgaagaagagcaaggctgtgctggactaccatgatgacaactttgccatcgtgtttgctgccatgggcgtgaacatggagacagcccgcttcttcaagagtgactttgagcagaatggcaccatgggaaatgtgtgcctcttcctgaacctggccaatgaccccaccatcgagcgcatcatcaccccccggctggccctgaccacagctgagttcctggcctaccagtgtgagaagcacgtgctggtgatcctgacagacatgagcagctatgcagaggccctgcgggaggtgtctgctgcccgggaggaggtgcccggccggcggggcttccctggctacatgtacacagacctggccaccatctatgagcgggccggccgggtggaggacatcacccaccccatcccagacctgaccggcttcatcacagagggccagatctacgtggaccggcagctgcacaaccggcagatctacccacccatcaacgtgctgcccagcctgagccggctgatgaagagcgccatcggggagggcatgaccaggaaggaccatggagatgtgagcaaccagctgtatgcctgctacgccatcggcaaggatgtgcaggccatgaaggctgtggtgggggaggaggccctgaccagcgaggacctgctgtacctggagttcctgcagaagtttgagaagaacttcatcaaccagggcccctatgagaacagatctgtgtttgagagcctggacctgggctggaagctgctgcgcatcttccccaaggagatgctgaagaggatcccccaggccgtgattgatgagttctacagccgggagggcgccctgcaggacctggccccagacacagccctgtag

SEQ ID NO: 32527 - DNA, 1467 bp, Artificial Sequence
  Description of Artificial Sequence: Synthetic coding sequence
atgcaggccgtgaccaggaactacatcacccacccccgggtgacctacagaacagtgtgcagcgtgaatggccccctggtggtgctggacagagtgaagtttgcccagtatgcagagatcgtgcacttcaccctgcctgatggcacccagaggagcggccaggtgctggaggtggccggcaccaaggccatcgtgcaggtgtttgagggcaccagcggcattgatgccaggaagaccacctgtgagttcaccggggacatcctgcggacccctgtgtctgaggacatgctgggccgggtcttcaacggcagcggcaagcccatcgacaagggccctgtggtgatggccgaggacttcctggacatcaatggccagcccatcaacccccacagccgcatctacccagaggagatgatccagacaggcatcagccccattgatgtgatgaacagcatcgcccggggccagaagatccccatcttctctgctgctggcctgccccacaatgaaattgctgcccagatctgccggcaggccggcctggtgaagaagagcaaggctgtgctggactaccatgatgacaactttgccatcgtgtttgctgccatgggcgtgaacatggagacagcccgcttcttcaagagtgactttgagcagaatggcaccatgggaaatgtgtgcctcttcctgaacctggccaatgaccccaccatcgagcgcatcatcaccccccggctggccctgaccacagctgagttcctggcctaccagtgtgagaagcacgtgctggtgatcctgacagacatgagcagctatgcagaggccctgcgggaggtgtctgctgcccgggaggaggtgcctggaagaagaggcttccctggctacatgtacacagacctggccaccatctatgaaagagctggccgggtggagggccggggcggcagcatcacccagatccccatcctgaccatgcccaatgatgacatcacccaccccatcccagacctgaccggcttcatcacagagggccagatctacgtggaccggcagctgcacaaccggcagatctacccacccatcaacgtgctgcccagcctgagccggctgatgaagagcgccatcggggagggcatgaccaggaaggaccatggagatgtgagcaaccagctgtatgcctgctacgccatcggcaaggatgtgcaggccatgaaggctgtggtgggggaggaggccctgaccagcgaggacctgctgtacctggagttcctgcagaagtttgagaagaacttcatcaaccagggcccctatgagaacagatctgtgtttgagagcctggacctgggctggaagctgctgcgcatcttccccaaggagatgctgaagaggatcccccaggccgtgattgatgagttctacagccgggagggcgccctgcaggacctggccccagacacagccctgtag

SEQ ID NO: 32528 - DNA, 1536 bp, Artificial Sequence
  Description of Artificial Sequence: Synthetic coding sequence
atggccctgcgggccatgaggggcatcgtgaatggagctgcccctgagctgcctgtgcccactggaggccctgctgtgggcgcccgggagcaggccctggccgtgtccaggaactacctgagccagccccggctgacctacaagacagtgtctggagtgaatggccccctggtgatcctggaccacgtgaagttccccaggtatgcagaaattgtgcacctgaccctgcctgatggcaccaagaggagcggccaggtgctggaggtgtctggcagcaaggctgtggtgcaggtgtttgagggcaccagcggcattgatgccaagaagaccagctgtgagttcaccggggacatcctgcggacccctgtgtctgaggacatgctgggccgggtcttcaatggaagtggcaagcccatcgaccggggccctgtggtgctggccgaggacttcctggacatcatgggccagcccatcaacccccagtgccgcatctacccagaggagatgatccagacaggcatcagcgccattgatggcatgaacagcatcgcccggggccagaagatccccatcttctctgctgctggcctgccccacaatgaaattgctgcccagatctgccggcaggccggcctggtgaagaagagcaaggatgtggtggactacagtgaagaaaattttgccatcgtgtttgctgccatgggcgtgaacatggagacagcccgcttcttcaagagtgactttgaggagaatggctccatggacaacgtgtgcctcttcctgaacctggccaatgaccccaccatcgagcgcatcatcaccccccggctggccctgaccacagctgagttcctggcctaccagtgtgagaagcacgtgctggtgatcctgacagacatgagcagctatgcagaggccctgcgggaggtgtctgctgcccgggaggaggtgcccggccggcggggcttccctggctacatgtacacagacctggccaccatctatgagcgggccggccgggtggagggcagaaatggcagcatcacccagatccccatcctgaccatgcccaatgatgacatcacccaccccatcccagacctgaccggctacatcacagagggccagatctacgtggaccggcagctgcacaaccggcagatctacccacccatcaacgtgctgcccagcctgagccggctgatgaagagcgccatcggggagggcatgaccaggaaggaccacgcagatgtgagcaaccagctgtatgcctgctacgccatcggcaaggatgtgcaggccatgaaggctgtggtgggggaggaggccctgaccagtgatgacctgctgtacctggagttcctgcagaagtttgagaggaacttcatcgcccagggcccctatgaaaatagaacagtgtttgagaccctggacatcggctggcagctgctgcgcatcttccccaaggagatgctgaagaggatcccccagagcaccctgtctgagttctacccccgggacagcgccaagcactag

SEQ ID NO: 32529 - DNA, 1158 bp, Artificial Sequence
  Description of Artificial Sequence: Synthetic coding sequence
atgctgggccgggtcttcaatggaagtggcaagcccatcgaccggggccctgtggtgctggccgaggacttcctggacatcatgggccagcccatcaacccccagtgccgcatctacccagaggagatgatccagacaggcatcagcgccattgatggcatgaacagcatcgcccggggccagaagatccccatcttctctgctgctggcctgccccacaatgaaattgctgcccagatctgccggcaggccggcctggtgaagaagagcaaggatgtggtggactacagtgaagaaaattttgccatcgtgtttgctgccatgggcgtgaacatggagacagcccgcttcttcaagagtgactttgaggagaatggctccatggacaacgtgtgcctcttcctgaacctggccaatgaccccaccatcgagcgcatcatcaccccccggctggccctgaccacagctgagttcctggcctaccagtgtgagaagcacgtgctggtgatcctgacagacatgagcagctatgcagaggccctgcgggaggtgtctgctgcccgggaggaggtgcccggccggcggggcttccctggctacatgtacacagacctggccaccatctatgagcgggccggccgggtggagggcagaaatggcagcatcacccagatccccatcctgaccatgcccaatgatgacatcacccaccccatcccagacctgaccggctacatcacagagggccagatctacgtggaccggcagctgcacaaccggcagatctacccacccatcaacgtgctgcccagcctgagccggctgatgaagagcgccatcggggagggcatgaccaggaaggaccacgcagatgtgagcaaccagctgtatgcctgctacgccatcggcaaggatgtgcaggccatgaaggctgtggtgggggaggaggccctgaccagtgatgacctgctgtacctggagttcctgcagaagtttgagaggaacttcatcgcccagggcccctatgaaaatagaacagtgtttgagaccctggacatcggctggcagctgctgcgcatcttccccaaggagatgctgaagaggatcccccagagcaccctgtctgagttctacccccgggacagcgccaagcactag

SEQ ID NO: 32530 - DNA, 1854 bp, Artificial Sequence
  Description of Artificial Sequence: Synthetic coding sequence
atggacttcagcaagctgcccaagatcctggatgaggacaaggagagcaccttcggctacgtgcacggcgtgtctggccctgtggtgacagcctgtgacatggccggggccgccatgtatgagctggtgcgggtgggccacagcgagctggtgggggagatcatccggctggagggggacatggccaccatccaggtgtatgaggagaccagcggcgtgtctgtgggggaccctgtgctgaggacaggcaagcccctgtctgtggagctgggccctggcatcatgggcgccatctttgatggcatccagaggcccctgagtgacatcagcagccagacccagagcatctacatcccccggggcgtgaatgtgtctgccctgagccgggacatcaagtgggacttcaccccctgcaagaacctgcgggtgggcagccacatcaccggcggggacatctatggaattgtgtctgagaacagcctcatcaagcacaagatcatgctgcccccaagaaacagaggaacagtgacctacatcgcccctcctggcaactatgacaccagtgatgtggtgctggagctggagtttgagggcgtgaaggagaagttcaccatggtgcaggtgtggcctgtgcggcaggtgcggcctgtgacagagaagctgcctgccaaccaccccctgctgaccggccagagggtgctggatgccctcttcccctgtgtgcagggcggcaccacagccatccctggggccttcggctgtgggaagacagtcatcagccagagcctgagcaagtacagcaacagtgatgtgatcatctacgtgggctgtggggagagaggaaatgagatgtctgaggtgctgcgggacttccctgagctgaccatggaggtggatggcaaggtggagagcatcatgaagaggacagccctggtggccaacaccagcaacatgcctgtggccgcccgggaggccagcatctacacaggcatcaccctgtctgagtacttccgggacatgggctaccacgtgtccatgatggctgacagcaccagccgctgggccgaggccctgcgggagatcagcggccgcctggccgagatgcctgctgacagcggctacccagcctacctgggcgcccggctggccagcttctatgaaagagctggccgggtgaagtgcctgggcaaccctgagcgggagggctctgtgtccatcgtgggcgctgtgagccccccaggaggagacttcagtgaccctgtgaccagcgccaccctgggcatcgtgcaggtgttctggggcctggacaagaagctggcccagaggaagcacttccccagcgtgaactggctgatctcctacagcaagtacatgagggccctggatgagtactatgacaagcacttcacagaatttgtgcccctgcggaccaaggccaaggagatcctgcaggaggaggaggacctggccgagatcgtgcagctggtgggcaaggccagcctggccgagacagacaagatcaccctggaggtggccaagctgatcaaggatgacttcctgcagcagaatggctacaccccctatgaccgcttctgccccttctacaagacagtgggcatgctgagcaacatgattgccttctatgacatggcccggcgggctgtggagaccacagcccagagcgacaacaagatcacctggagcatcatccgggagcacatgggagacatcctgtacaagctgagctccatgaagttcaaggaccccctgaaggatggagaggccaagatcaagagtgactatgcccagctgctggaggacatgcagaatgccttccgcagcctggaggactag

SEQ ID NO: 32531 - DNA, 666 bp, Artificial Sequence
  Description of Artificial Sequence: Synthetic coding sequence
atggacttcagcaagctgcccaagatcctggatgaggacaaggagagcaccttcggctacgtgcacggcgtgtctggccctgtggtgacagcctgtgacatggccggggccgccatgtatgagctggtgcgggtgggccacagcgagctggtgggggagatcatccggctggagggggacatggccaccatccaggtgtatgaggagaccagcggcgtgtctgtgggggaccctgtgctgaggacaggcaagcccctgtctgtggagctgggccctggcatcatgggcgccatctttgatggcatccagaggcccctgagtgacatcagcagccagacccagagcatctacatcccccggggcgtgaatgtgtctgccctgagccgggacatcaagtgggacttcaccccctgcaagaacctgcgggtgggcagccacatcaccggcggggacatctatggaattgtgtctgagaacagcctcatcaagcacaagatcatgctgcccccaagaaacagaggaacagtgacctacatcgcccctcctggcaactatgacaccagtgatgtggtgctggagctggagtttgagggcgtgaaggagaagttcaccatggtgcaggtgtggcctgtgcggcaggtgcggcctgtgacagagaagctgtag

SEQ ID NO: 32532 - DNA, 1755 bp, Artificial Sequence
  Description of Artificial Sequence: Synthetic coding sequence
atggccggggccgccatgtatgagctggtgcgggtgggccacagcgagctggtgggggagatcatccggctggagggggacatggccaccatccaggtgtatgaggagaccagcggcgtgtctgtgggggaccctgtgctgaggacaggcaagcccctgtctgtggagctgggccctggcatcatgggcgccatctttgatggcatccagaggcccctgagtgacatcagcagccagacccagagcatctacatcccccggggcgtgaatgtgtctgccctgagccgggacatcaagtgggacttcaccccctgcaagaacctgcgggtgggcagccacatcactggaggagacatctacggcatcgtgtctgagaacagcctcatcaagcacaagatcatgctgccccccaggaacagaggcaccgtgacctacatcgcccctcctggcaactatgacaccagtgatgtggtgctggagctggagtttgaaggagtgaaggagaagttcaccatggtgcaggtgtggcctgtgcggcaggtgcggcctgtgacagagaagctgcctgccaaccaccccctgctgaccggccagagggtgctggatgccctcttcccctgtgtgcagggcggcaccacagccatccctggggccttcggctgcggcaagacagtcatcagccagagcctgagcaagtacagcaacagtgatgtgatcatctacgtgggctgtggggagagaggaaatgagatgtctgaggtgctgcgggacttccctgagctgaccatggaggtggatggcaaggtggagagcatcatgaagaggacagccctggtggccaacaccagcaacatgcctgtggccgcccgggaggccagcatctacacaggcatcaccctgtctgagtacttccgggacatgggctaccacgtgtccatgatggctgacagcaccagccgctgggccgaggccctgcgggagatcagcggccgcctggccgagatgcctgctgacagcggctacccagcctacctgggcgcccggctggccagcttctatgagcgggccggccgggtgaagtgcctgggcaaccctgagcgggagggctctgtgtccatcgtgggcgctgtgtccccacctggaggagacttcagtgaccctgtgaccagcgccaccctgggcatcgtgcaggtgttctggggcctggacaagaagctggcccagaggaagcacttccccagcgtgaactggctgatctcctacagcaagtacatgagggccctggatgagtactatgacaagcacttcacagaatttgtgcccctgcggaccaaggccaaggagatcctgcaggaggaggaggacctggccgagatcgtgcagctggtgggcaaggccagcctggccgagacagacaagatcaccctggaggtggccaagctgatcaaggatgacttcctgcagcagaatggctacaccccctatgaccgcttctgccccttctacaagacagtgggcatgctgagcaacatgattgccttctatgacatggccaggagagctgtggagaccacagcccagagcgacaacaagatcacctggagcatcatccgggagcacatgggagacatcctgtacaagctgagctccatgaagttcaaggaccccctgaaggatggagaggccaagatcaagagtgactatgcccagctgctggaggacatgcagaatgccttccgcagcctggaggactag

SEQ ID NO: 32533 - DNA, 1005 bp, Artificial Sequence
  Description of Artificial Sequence: Synthetic coding sequence
atgtctgaggtgctgcgggacttccctgagctgaccatggaggtggatggcaaggtggagagcatcatgaagaggacagccctggtggccaacaccagcaacatgcctgtggccgcccgggaggccagcatctacacaggcatcaccctgtctgagtacttccgggacatgggctaccacgtgtccatgatggctgacagcaccagccgctgggccgaggccctgcgggagatcagcggccgcctggccgagatgcctgctgacagcggctacccagcctacctgggcgcccggctggccagcttctatgagcgggccggccgggtgaagtgcctgggcaaccctgagcgggagggctctgtgtccatcgtgggcgctgtgtccccacctggaggagacttcagtgaccctgtgaccagcgccaccctgggcatcgtgcaggtgttctggggcctggacaagaagctggcccagaggaagcacttccccagcgtgaactggctgatctcctacagcaagtacatgagggccctggatgagtactatgacaagcacttcacagaatttgtgcccctgcggaccaaggccaaggagatcctgcaggaggaggaggacctggccgagatcgtgcagctggtgggcaaggccagcctggccgagacagacaagatcaccctggaggtggccaagctgatcaaggatgacttcctgcagcagaatggctacaccccctatgaccgcttctgccccttctacaagacagtgggcatgctgagcaacatgattgccttctatgacatggccaggagagctgtggagaccacagcccagagcgacaacaagatcacctggagcatcatccgggagcacatgggagacatcctgtacaagctgagctccatgaagttcaaggaccccctgaaggatggagaggccaagatcaagagtgactatgcccagctgctggaggacatgcagaatgccttccgcagcctggaggactag

SEQ ID NO: 32534 - DNA, 246 bp, Artificial Sequence
  Description of Artificial Sequence: Synthetic coding sequence
atggcctaccacggcctgactgtgcccctgattgtgatgtctgtgttctggggctttgtgggcttcctggtgccctggttcatccccaagggccccaacagaggagtcatcatcaccatgctggtgacctgcagcgtgtgctgctacctgttctggctgattgccatcctggcccagctgaaccccctgtttggcccccagctgaagaatgagaccatctggtacctgaagtaccactggccctag

SEQ ID NO: 32535 - DNA, 246 bp, Artificial Sequence; identical to SEQ ID NO: 32534
  Description of Artificial Sequence: Synthetic coding sequence

SEQ ID NO: 32536 - DNA, 1413 bp, Artificial Sequence
  Description of Artificial Sequence: Synthetic coding sequence
atgatggccgccatggccacagcccgggtgaggatgggcccccgctgtgcccaggccctgtggaggatgccctggctgcctgtgttcctgagcctggccgctgctgctgctgctgctgctgctgagcagcaggtgcccctggtgctgtggagcagtgaccgggacctgtgggccccagctgctgacacccatgagggccacatcaccagtgacctgcagctgagcacctacctggaccctgccctggagctgggccccagaaatgtgctgctcttcctgcaggacaagctgagcattgaggacttcaccgcctatggaggagtgtttggaaacaagcaggacagcgccttcagcaacctggagaatgccctggacctggcccccagcagcctggtgctgcctgctgtggactggtatgctgtgtccaccctgaccacctacctgcaggagaagctgggcgccagccccctgcacgtggacctggccaccctgcgggagctgaagctgaatgccagcctgcctgccctgctgctgatccggctgccctacacagccagcagcggcctgatggccccccgggaggtgctgactggaaatgatgaggtgattggccaggtgctgagcaccctgaagtcagaagatgtgccctacacagctgccctgacagctgtgcggcccagccgggtggccagagatgtggccgtggtggccggcggcctgggccggcagctgctgcagaagcagcctgtgtcccctgtgatccacccccctgtgtcctacaatgacacagccccccgcatcctcttctgggcccagaacttctctgtggcctacaaggaccagtgggaggacctgacccccctgaccttcggcgtgcaggagctgaacctgaccggcagcttctggaatgacagctttgcccggctgagcctgacctatgagcggctgtttggcaccaccgtgaccttcaagttcatcctggccaacagactctaccctgtgtctgcccggcactggttcaccatggagcggctggaggtgcacagcaatggatctgtggcctacttcaatgccagccaggtgacaggccccagcatctacagcttccactgtgaatatgtgagcagcctgagcaagaagggcagcctgctggtggcccggacccagcccagcccctggcagatgatgctgcaggacttccagatccaggccttcaacgtgatgggagagcagttctcctatgccagtgactgtgccagcttcttcagccctggcatctggatgggcctgctgaccagcctcttcatgctgttcatcttcacctacggcctgcacatgatcctgagcctgaagaccatggacagatttgatgaccacaagggccccaccatcagcctgacccagatcgtgtag

SEQ ID NO: 32537 - DNA, 822 bp, Artificial Sequence
  Description of Artificial Sequence: Synthetic coding sequence
atgatggccgccatggccacagcccgggtgaggatgggcccccgctgtgcccaggccctgtggaggatgccctggctgcctgtgttcctgagcctggccgctgctgctgctgctgctgctgctgagcagcaggtgcccctggtgctgtggagcagtgaccgggacctgtgggccccagctgctgacacccatgagggccacatcaccagtgacctgcagctgagcacctacctggaccctgccctggagctgggccccagaaatgtgctgctcttcctgcaggacaagctgagcattgaggacttcaccgcctatggaggagtgtttggaaacaagcaggacagcgccttcagcaacctggagaatgccctggacctggcccccagcagcctggtgctgcctgctgtggactggtatgctgtgtccaccctgaccacctacctgcaggagaagctgggcgccagccccctgcacgtggccagagatgtggccgtggtggccggcggcctgggccggcagctgctgcagaagcagcctgtgtcccctgtgatccacccccctgtgtcctacaatgacacagccccccgcatcctcttctgggcccagaacttctctgtggcctacaaggaccagtgggaggacctgacccccctgaccttcggcgtgcaggagctgaacctgaccggcagcttctggaatgacagctttgcccgcttcatcctggccaacagactctaccctgtgtctgcccggcactggttcaccatggagcggctggaggtgcacagcaatggatctgtggcctacttcaatgccagctag

SEQ ID NO: 32538 - DNA, 885 bp, Artificial Sequence
  Description of Artificial Sequence: Synthetic coding sequence
atgaaggccaccagccctgccacctgcagcagcggcctgatggccccccgggaggtgctgactggaaatgatgaggtgattggccaggtgctgagcaccctgaagtcagaagatgtgccctacacagctgccctgacagctgtgcggcccagccgggtggccagagatgtggccgtggtggccggcggcctgggccggcagctgctgcagaagcagcctgtgtcccctgtgatccacccccctgtgtcctacaatgacacagccccccgcatcctcttctgggcccagaacttctctgtggcctacaaggaccagtgggaggacctgacccccctgaccttcggcgtgcaggagctgaacctgaccggcagcttctggaatgacagctttgcccggctgagcctgacctatgagcggctgtttggcaccaccgtgaccttcaagttcatcctggccaacagactctaccctgtgtctgcccggcactggttcaccatggagcggctggaggtgcacagcaatggatctgtggcctacttcaatgccagccaggtgacaggccccagcatctacagcttccactgtgaatatgtgagcagcctgagcaagaagggcagcctgctggtggcccggacccagcccagcccctggcagatgatgctgcaggacttccagatccaggccttcaacgtgatgggagagcagttctcctatgccagtgactgtgccagcttcttcagccctggcatctggatgggcctgctgaccagcctcttcatgctgttcatcttcacctacggcctgcacatgatcctgagcctgaagaccatggacagatttgatgaccacaagggccccaccatcagcctgacccagatcgtgtag

SEQ ID NO: 32539 - DNA, 693 bp, Artificial Sequence
  Description of Artificial Sequence: Synthetic coding sequence
atgatggccgccatggccacagcccgggtgaggatgggcccccgctgtgcccaggccctgtggaggatgccctggctgcctgtgttcctgagcctggccgctgctgctgctgctgctgctgctgagcagcaggtgcccctggtgctgtggagcagtgaccgggacctgtgggccccagctgctgacacccatgagggccacatcaccagtgacctgcagctgagcacctacctggaccctgccctggagctgggccccagaaatgtgctgctcttcctgcaggacaagctgagcattgaggacttcaccgcctatggaggagtgtttggaaacaagcaggacagcgccttcagcaacctggagaatgccctggacctggcccccagcagcctggtgctgcctgctgtggactggtatgctgtgtccaccctgaccacctacctgcaggagaagctgggcgccagccccctgcacgtggacctggccaccctgcgggagctgaagctgaatgccagcctgcctgccctgctgctgatccggctgccctacacagccagcagcggcctgatggccccccgggaggtgctgacagatgaggtgattggccaggtgctgagcaccctgaagtcagaagatgtgccctacacagctgccctgacagctgtgcggcccagccgggtggcccgggactag

SEQ ID NO: 32540 - DNA, 675 bp, Artificial Sequence
  Description of Artificial Sequence: Synthetic coding sequence
atgaggctgtggaaggcccgggtgctgaagctggtgctgaagacagccaaggacagccggctgggcctgaacagcaagtggctgagcctgaagctgggagatgctggcaaccccaggagcctggccatccgcttcatcctgaccaactacaacaagctgagcatccagagctggttcagcctgcggcgggtggagatcatcagcaacaacagcatccaggccgtgttcaaccccactggagtgtatgcccccagcggctacagctaccgctgccagagggtgggcagcctgcagcaggaccaggccctgctgctgcccagcgacacagatgatggcagcagcctgtgggaggtgaccttcatcgacttccagatccagggctttgccatcaagggcggccgcttcaccaaggcccaggactgtgccagcagcttctccccagccttcctgattggcctggccatgagcctcatcctgctgctggtgctggcctatgccctgcacatgctgatctacctgcgctacctggaccagcagtatgacctgattgccagccctgcccacttcagccagctgaaggcccgggacacagctgaggagaaggagctgctgcggagccagggcgctgagtgctacaagctgcggagccagcagatcagcaagatctacgtgtag

SEQ ID NO: 32541 - DNA, 675 bp, Artificial Sequence; identical to SEQ ID NO: 32540
  Description of Artificial Sequence: Synthetic coding sequence

SEQ ID NO: 32542 - DNA, 3327 bp, Artificial Sequence
  Description of Artificial Sequence: Synthetic coding sequence
atgttcctgggcctgggccgcttcagccggctggtgctgtggtttgctgccttcaggaagctgctgggccaccacggcctggccagcgccaagttcctgtggtgcctgtgcctgctgtctgtgatgagcctgccccagcaggtgtggaccctgccctacaagattggagtggtgggcccctgggcctgtgacagcctcttcagcaaggccctgcctgaggtggccgcccggctggccatcgagcgcatcaacagagaccccagctttgacctgagctacagctttgaatatgtgatcctgaatgaagactgccagaccagccgggccctgagcagcttcatcagccaccaccagatggccagcggcttcatcggccccaccaaccctggctactgtgaggccgccagcctgctgggcaacagctgggacaagggcatcttctcctgggcctgtgtgaactatgagctggacaacaagatctcctaccccaccttcagcaggaccctgcccagccccatccgggtgctggtgacagtgatgaagtacttccagtgggcccacgccggggtcatcagcagtgatgaggacatctgggtgcacacagccaacagagtggccagcgccctgcggagccacggcctgcctgtgggcgtggtgctgaccaccggccaggacagccagagcatgaggaaggccctgcagaggatccaccaggccgaccgcatccgcatcatcatcatgtgcatgcacagcgccctgattggaggagagacccagatgcacctgctggagtgtgcccatgacctgaagatgacagatggcacctacgtgtttgtgccctatgatgccctgctgtacagcctgccctacaagcacaccccctacagagtgctgaggaacaaccccaagctgcgggaggcctatgatgctgtgctgaccatcaccgtggagagccaggagaagaccttctaccaggccttcacagaggccgccgcccggggggagatccctgagaagctggagtttgaccaggtgagccccctgtttggcaccatctacaacagcatctacttcatcgcccaggccatgaacaatgccatgaaggaaaatggccaggccggggccgccagcctggtgcagcacagcaggaacatgcagttccacggcttcaaccagctgatgaggacagacagcaatggaaatggcatcagtgaatatgtgatcctggacaccaacctgaaggagtgggagctgcacagcacctacacagtggacatggagatggagctgctgcgctttggaggcacccccatccacttccctgggggccggccccccagggcagatgccaagtgctggtttgctgagggcaagatctgccacggcggcatcgaccctgcctttgccatgatggtgtgcctgaccctgctgattgccctgctgagcatcaatggatttgcctacttcatcagaagacgcatcaacaagatccagctgatcaagggccccaaccgcatcctgctgaccctggaggatgtgaccttcatcaacccccacttcggcagcaagaggggcagccgggcctctgtgtccttccagatcaccagcgaggtgcagagcggccgcagcccccggctgtccttcagcagcggcagcctgaccccagccacctatgagaacagcaacatcgccatctatgaaggagactgggtgtggctgaagaagttcagcctgggggactttggagacctgaagagcatcaagagccgggccagtgatgtgtttgagatgatgaaggacctgcggcatgagaacatcaaccccctgctgggcttcttctatgacagcggcatgtttgccatcgtgacagagttctgcagccggggcagcctggaggacatcctgaccaaccaggatgtgaagctggactggatgttcaagagcagcctgctgctggacctgatcaagggcatgaagtacctgcaccaccgggagtttgtgcacggccgcctgaagagcaggaactgtgtggtggatggccgctttgtgctgaaggtgacagattatggcttcaatgacatcctggagatgctgcggctgtctgaggaggagagctccatggaggagctgctgtggacagcccctgagctgctgcgggccccccggggcagccggctgggcagctttgctggagatgtgtacagctttgccatcatcatgcaggaggtgatggtgcggggcacccccttctgcatgatggacctgcctgcccaggagatcatcaaccggctgaagaagcccccacctgtgtacagacctgtggtgcccccagagcacgcccccccagaatgtctgcagctgatgaagcagtgctgggccgaggccgctgagcagaggcccacctttgatgagatcttcaaccagttcaagaccttcaacaagggcaagaagaccaacatcatcgacagcatgctgaggatgctggagcagtacagcagcaacctggaggacctgatccgggagaggacagaggagctggagattgagaagcagaagacagagaagctgctgacccagatgctgccccccagcgtggccgagagcctgaagaagggctgcaccgtggagcctgagggctttgacctggtgaccctgtacttcagtgacatcgtgggcttcaccaccatcagcgccatgtctgagcccatcgaggtggtggacctgctgaatgacctgtacaccctgtttgatgccatcatcggcagccatgatgtgtacaaggtggagaccatcggagatgcctacatggtggccagcggcctgcccaagagaaatggcagcagacatgctgctgagatcgccaacatgagcctggacatcctgagctctgtgggcaccttcaagatgaggcacatgcctgaggtgcctgtgcgcatcagaattggcctgcacagcggccctgtggtggccggcgtggtgggcctgaccatgccccgctactgcctgtttggagacacagtgaacacagccagcaggatggagagcacaggcctgccctaccgcatccacgtgtccctgagcacagtgaccatcctgcagaacctgtctgagggctatgaggtggagctgcggggccgcacagagctgaagggcaagggcacagaggagaccttctggctgattggcaagaagggcttcatgaagcccctgcctgtgcccccacctgtggacaaggatggccaggtgggccacggcctgcagcctgtggagattgctgccttccagaggaggaaggccgagcggcagctggtgaggaacaagccctag

SEQ ID NO: 32543 - DNA, 1062 bp, Artificial Sequence
  Description of Artificial Sequence: Synthetic coding sequence
atgaggcggcagctgcggagccggcgggcccccagcttcccctacagctaccgctaccgcctggatgatcctgatgaggccaaccagaactacctggctgatgaggaggaggaggccgaggaggaggcccgggtgacagtggtgcccaagtctgaggaggaggaggaggaggaggagaaggaggaggaggaggaggaggagaaggaggaggaggagggccagggccagcccactggaaatgcctggtggcagaagctgcagatcatgtctgagtacctgtgggaccctgagaggaggatgttcctggccaggacaggcctcatcctgctgatctacttcttcttctacgccagcctggccgctgtgatcaccctgtgcatgtacaccctcttcctgaccatcagcccctacatccccaccttcacagagcgggtgaagcccccaggagtgatgatccggccctttgcccacagcctgaacttcaacttcaacgtgtctgagccagacacctggcagcactacgtgatcagcctgaatggcttcctgcagggctacaatgacagcctgcaggaggagatgaatgtggactgccccccaggccagtacttcatccaggatggaaatgaagatgaggacaagaaggcctgccagttcaagaggagcttcctgaagaactgcagcggcctggaggaccccaccttcggctacagcacaggccagccctgcatcctgctgaagatgaaccgcatcgtgggcttccggcctgagctgggggaccctgtgaaggtgtcctgcaaggtgcagagaggagatgaaaatgacatccgcagcatctcctactacccagagagcgccagctttgacctgcgctactacccctactacggcaagctgacccacgtgaactacaccagccccctggtggccatgcacttcacagatgtggtgaagaaccaggccgtgcctgtgcagtgccagctgaagggcaagggcgtcatcaatgatgtgatcaatgacagatttgtgggccgggtcatcttcaccctgaacatcgagacctag

SEQ ID NO: 32544 - DNA, 945 bp, Artificial Sequence
  Description of Artificial Sequence: Synthetic coding sequence
atgaggcggcagctgcggagccggcgggcccccagcttcccctacagctaccgctaccgcctggatgatcctgatgaggccaaccagaactacctggctgatgaggaggaggaggccgaggaggaggcccgggtgacagtggtgcccaagtctgaggaggaggaggaggaggaggagaaggaggaggaggaggaggaggagaaggaggaggaggagggccagggccagcccactggaaatgcctggtggcagaagctgcagatcatgtctgagtacctgtgggaccctgagaggaggatgttcctggccaggacaggccagagctggagggtgatgatccggccctttgcccacagcctgaacttcaacttcaacgtgtctgagccagacacctggcagcactacgtgatcagcctgaatggcttcctgcagggctacaatgacagcctgcaggaggagatgaatgtggactgccccccaggccagtacttcatccaggatggaaatgaagatgaggacaagaaggcctgccagttcaagaggagcttcctgaagaactgcagcggcctggaggaccccaccttcggctacagcacaggccagccctgcatcctgctgaagatgaacagaattgtgggcttccggcctgagctgggggaccctgtgaaggtgtcctgcaaggtgcagagaggagatgaaaatgacatccgcagcatctcctactacccagagagcgccagctttgacctgcgctactacccctactacggcaagctgacccacgtgaactacaccagccccctggtggccatgcacttcacagatgtggtgaagaaccaggccgtgcctgtgcagtgccagctgaagggcaaaggagtcatcaatgatgtgatcaatgacagatttgtgggccgggtcatcttcaccctgaacatcgagacctag

SEQ ID NO: 32545 - DNA, 381 bp, Artificial Sequence
  Description of Artificial Sequence: Synthetic coding sequence
atggtggatgaaaatgacatccgggccctgaatgtgcgccactacagagaccacatcggcgtggtgtcccaggagcctgtgctgtttggcaccaccatcagcaacaacatcaagtatggaagagatgatgtgacagatgaggagatggagcgggccgcccgggaggccaatgcctatgacttcatcatggagttccccaacaagttcaacaccctggtgggggagaagggggcccagatgtctgggggccagaagcagagaattgccatcgcccgggccctggtgaggaaccccaagatcctgatcctggatgaggccaccagcgccctggacagcgagagcaagtctgctgtgcaggccgccctggagaagaagaagtag

SEQ ID NO: 32546 - DNA, 2439 bp, Artificial Sequence
  Description of Artificial Sequence: Synthetic coding sequence
atggtggatgaaaatgacatccgggccctgaatgtgcgccactacagagaccacatcggcgtggtgtcccaggagcctgtgctgtttggcaccaccatcagcaacaacatcaagtatggaagagatgatgtgacagatgaggagatggagcgggccgcccgggaggccaatgcctatgacttcatcatggagttccccaacaagttcaacaccctggtgggggagaagggggcccagatgtctgggggccagaagcagagaattgccatcgcccgggccctggtgaggaaccccaagatcctgatcctggatgaggccaccagcgccctggacagcgagagcaagtctgctgtgcaggccgccctggagaaggccagcaaaggaagaaccaccatcgtggtggcccaccggctgagcaccatccgctctgctgacctgattgtgaccctgaaggatggcatgctggccgagaagggggcccacgccgagctgatggccaagaggggcctgtactacagcctggtgatgagccaggacatcaagaaggcagatgagcagatggagagcatgacctacagcacagagaggaagaccaacagcctgcccctgcacagcgtgaagagcatcaagagtgacttcatcgacaaggccgaggagagcacccagagcaaggagatcagcctgcctgaggtgtccctgctgaagatcctgaagctgaacaagccagagtggccctttgtggtgctgggcaccctggcctctgtgctgaatggaacagtgcaccctgtgttcagcatcatctttgccaagatcatcaccatgtttggaaataatgacaagaccaccctgaagcatgatgctgagatctacagcatgatcttcgtcatcctgggcgtcatctgctttgtgtcctacttcatgcagggcctcttctacggccgggccggggagatcctgaccatgaggctgcggcacctggccttcaaggccatgctgtaccaggacatcgcctggtttgatgagaaggagaacagcactggaggcctgaccaccatcctggccattgatattgcccagatccagggcgccaccggcagccgcatcggcgtgctgacccagaatgccaccaacatgggcctgagcgtcatcatctccttcatctacggctgggagatgaccttcctgatcctgagcatcgcccctgtgctggccgtgacaggcatgattgaaacagctgccatgactggatttgccaacaaggacaagcaggagctgaagcacgccggcaagatcgccacagaggccctggagaacatccgcaccatcgtgtccctgacccgggagaaggcctttgagcagatgtatgaggagatgctgcagacccagcacaggaacaccagcaagaaggcccagatcatcggcagctgctacgccttcagccacgccttcatctactttgcctatgctgctggcttccgctttggagcctacctgatccaggccggccgcatgaccccagagggcatgtttattgtgttcaccgccatcgcctacggggccatggccatcggggagaccctggtgctggcccctgagtacagcaaggccaagagcggggccgcccacctgtttgccctgctggagaagaagcccaacatcgacagccgcagccaggagggcaagaagccagacacctgtgagggcaacctggagttccgggaggtgtccttcttctacccctgcaggccagatgtgttcatcctgcggggcctgagcctgagcattgagcggggcaagacagtggcctttgtgggcagcagcggctgcggcaagagcacctctgtgcagctgctgcagaggctgtatgaccctgtgcagggccaggtgctgtttgatggagtggatgccaaggagctgaatgtgcagtggctgcggagccagatcgccatcgtgccccaggagcctgtgctcttcaactgcagcattgctgagaacatcgcctacggggacaacagccgggtggtgcccctggatgagatcaaggaggccgccaatgctgccaacatccacagcttcatcgagggcctgcctgagaagtacaacacccaggtgggcctgaagggggcccagctgagcggcggccagaagcagaggctggccatcgcccgggccctgctgcagaagcccaagatcctgctgctggatgaggccaccagcgccctggacaatgattctgagaaggtggtgcagcacgccctggacaaggccaggacaggccgcacctgcctggtggtgacccaccggctgagcgccatccagaatgctgacctgattgtggtgctgcacaacgggaagatcaaggagcagggcacccaccaggagctgctgaggaacagagacatctacttcaagctggtgaatgcccagagcgtgcagtag

SEQ ID NO: 32547 - DNA, 3774 bp, Artificial Sequence
  Description of Artificial Sequence: Synthetic coding sequence
atggagaacagcgagagagctgaggagatgcaggagaactaccagagaaatggaacagctgaggagcagcccaagctgaggaaggaggccgtgggcagcattgagatcttccgctttgctgatggcctggacatcaccctgatgatcctgggcatcctggccagcctggtgaatggagcctgcctgcccctgatgcccctggtgctgggggagatgtctgacaacctgatcagcggctgcctggtgcagaccaacaccaccaactaccagaactgcacccagagccaggagaagctgaatgaagacatgaccctgctgaccctgtactacgtgggcattggagtggccgccctgatcttcggctacatccagatcagcctgtggatcatcacagctgcccggcagaccaagaggatcaggaagcagttcttccacagcgtgctggcccaggacatcggctggtttgacagctgtgacatcggggagctgaacaccaggatgacagatgacatcgacaagatcagtgatggcatcggggacaagatcgccctgctcttccagaacatgagcaccttcagcatcggcctggccgtgggcctggtgaagggctggaagctgaccctggtgaccctgagcaccagccccctcatcatggccagcgctgctgcctgcagcaggatggtgatcagcctgaccagcaaggagctgagcgcctacagcaaggccggggctgtggccgaggaggtgctgagcagcatcagaacagtgattgccttccgggcccaggagaaggagctgcagcgctacacccagaacctgaaggatgccaaggactttggcatcaagaggaccatcgccagcaaggtgtccctgggcgctgtgtacttcttcatgaatggcacctacggcctggccttctggtacggcaccagcctcatcctgaatggagagcccggctacaccatcggcaccgtgctggccgtgttcttcagcgtcatccacagcagctactgcattggagctgctgtgccccactttgagacctttgccatcgcccggggagctgccttccacatcttccaggtgattgacaagaagcccagcattgacaacttcagcacagctggctacaagccagagagcattgagggcaccgtggagttcaagaatgtgtccttcaactaccccagccggcccagcatcaagatcctgaagggcctgaacctgcgcatcaagtctggagagaccgtggccctggtgggcctgaatggaagtggcaagagcacagtggtgcagctgctgcagaggctgtatgaccctgatgatggcttcatcatggtggatgaaaatgacatccgggccctgaatgtgcgccactacagagaccacatcggcgtggtgtcccaggagcctgtgctgtttggcaccaccatcagcaacaacatcaagtatggaagagatgatgtgacagatgaggagatggagagagctgcccgggaggccaatgcctatgacttcatcatggagttccccaacaagttcaacaccctggtgggggagaagggggcccagatgtctgggggccagaagcagagaattgccatcgcccgggccctggtgaggaaccccaagatcctgatcctggatgaggccaccagcgccctggacagcgagagcaagtctgctgtgcaggccgccctggagaaggccagcaagggccgcaccaccatcgtggtggcccaccggctgagcaccatccgctctgctgacctgattgtgaccctgaaggatggcatgctggccgagaagggggcccatgctgagctgatggccaagaggggcctgtactacagcctggtgatgagccaggacatcaagaaggcagatgagcagatggagagcatgacctacagcacagagaggaagaccaacagcctgcccctgcacagcgtgaagagcatcaagagtgacttcatcgacaaggccgaggagagcacccagagcaaggagatcagcctgcctgaggtgtccctgctgaagatcctgaagctgaacaagccagagtggccctttgtggtgctgggcaccctggcctctgtgctgaatggcaccgtgcaccctgtgttcagcatcatctttgccaagatcatcaccatgtttggaaataatgacaagaccaccctgaagcatgatgctgagatctacagcatgatctttgtgatcctgggcgtcatctgctttgtgtcctacttcatgcagggcctcttctacggccgggccggggagatcctgaccatgaggctgcggcacctggccttcaaggccatgctgtaccaggacatcgcctggtttgatgagaaggagaacagcactggaggcctgaccaccatcctggccatcgacatcgcccagatccagggcgccaccggcagcagaattggagtgctgacccagaatgccaccaacatgggcctgagcgtcatcatctccttcatctacggctgggagatgaccttcctgatcctgagcatcgcccctgtgctggccgtgacaggcatgattgaaacagctgccatgacaggctttgccaacaaggacaagcaggagctgaagcatgctgggaagatcgccacagaggccctggagaacatccgcaccatcgtgtccctgacccgggagaaggcctttgagcagatgtatgaggagatgctgcagacccagcacaggaacaccagcaagaaggcccagatcatcggcagctgctacgccttcagccacgccttcatctactttgcctatgctgctggcttccgctttggagcctacctgatccaggccggccgcatgaccccagagggcatgttcatcgtgttcaccgccatcgcctatggagccatggccatcggggagaccctggtgctggcccctgagtacagcaaggccaagtctggagctgcccacctgtttgccctgctggagaagaagcccaacatcgacagccgcagccaggagggcaagaagccagacacctgtgagggcaacctggagttccgggaggtgtccttcttctacccctgcaggccagatgtgttcatcctgcggggcctgagcctgagcattgaaagaggcaagacagtggcctttgtgggcagcagcggctgtgggaagagcacctctgtgcagctgctgcagaggctgtatgaccctgtgcagggccaggtgctgtttgatggagtggatgccaaggagctgaatgtgcagtggctgcggagccagatcgccatcgtgccccaggagcctgtgctcttcaactgcagcattgctgaaaatattgcctatggagacaacagccgggtggtgcccctggatgagatcaaggaggccgccaatgctgccaacatccacagcttcatcgagggcctgcctgagaagtacaacacccaggtgggcctgaagggggcccagctgagcggcggccagaagcagaggctggccatcgcccgggccctgctgcagaagcccaagatcctgctgctggatgaggccaccagcgccctggacaatgacagcgagaaggtggtgcagcacgccctggacaaggccaggactggaagaacctgcctggtggtgacccaccggctgagcgccatccagaatgctgacctgattgtggtgctgcacaacgggaagatcaaggagcagggcacccaccaggagctgctgaggaacagagacatctacttcaagctggtgaatgcccagagcgtgcagtag

SEQ ID NO: 32548 - DNA, 396 bp, Artificial Sequence
  Description of Artificial Sequence: Synthetic coding sequence
atggtggatgaaaatgacatccgggccctgaatgtgcgccactacagagaccacatcggcgtggtgtcccaggagcctgtgctgtttggcaccaccatcagcaacaacatcaagtatggaagagatgatgtgacagatgaggagatggagcgggccgcccgggaggccaatgcctatgacttcatcatggagttccccaacaagttcaacaccctggtgggggagaagggggcccagatgtctgggggccagaagcagagaattgccatcgcccgggccctggtgaggaaccccaagatcctgatcctggatgaggccaccagcgccctggacagcgagagcaagtctgctgtgcaggccgccctggagaaggacaccccccgctacagcttctag

SEQ ID NO: 32549 - DNA, 4749 bp, Artificial Sequence
  Description of Artificial Sequence: Synthetic coding sequence
atgcccctggccttctgtggcagcgagaaccacagcgctgcctacagagtggaccagggcgtgctgaacaacggctgctttgtggatgccctgaatgtggtgccccacgtgttcctgctcttcatcaccttccccatcctcttcatcggctggggcagccagagcagcaaggtgcacatccaccacagcacctggctgcacttccctggccacaacctgcgctggatcctgaccttcatgctgctgtttgtgctggtgtgtgaaattgctgagggcatcctgagtgatggagtgacagagagccaccacctgcacctgtacatgcctgctggcatggccttcatggctgctgtgacctctgtggtgtactaccacaacatcgagaccagcaacttccccaagctgctgattgccctgctggtgtactggaccctggccttcatcaccaagaccatcaagtttgtgaagttcctggaccacgccatcggcttcagccagctgcgcttctgcctgaccggcctgctggtgatcctgtatggcatgctgctgctggtggaggtgaatgtcatccgggtgcggcgctacatcttcttcaagaccccccgggaggtgaagcccccagaggacctgcaggacctgggcgtgcgcttcctgcagccctttgtgaacctgctgagcaagggcacctactggtggatgaatgccttcatcaagacagcccacaagaagcccatcgacctgcgggccatcggcaagctgcccatcgccatgagggccctgaccaactaccagaggctgtgtgaggcctttgatgcccaggtgaggaaggacatccagggcacccagggcgcccgggccatctggcaggccctgagccacgcctttggaagaaggctggtgctgagcagcaccttccgcatcctggccgacctgctgggctttgctggccccctgtgcatctttggaattgtggaccacctgggcaaggaaaatgatgtgttccagcccaagacccagttcctgggcgtgtactttgtgagcagccaggagttcctggccaatgcctacgtgctggccgtgctgctcttcctggccctgctgctgcagaggaccttcctgcaggccagctactacgtggccattgaaacaggcatcaacctgcggggggccatccagaccaagatctacaacaagatcatgcacctgagcaccagcaacctgtccatgggagagatgacagctggccagatctgcaacctggtggccatcgacaccaaccagctgatgtggttcttcttcctgtgccccaacctgtgggccatgcctgtgcagatcatcgtgggcgtcatcctgctgtactacatcctgggcgtgtctgccctgattggagctgctgtgatcatcctgctggcccctgtgcagtactttgtggccaccaagctgagccaggcccagaggagcaccctggagtacagcaatgaaaggctgaagcagaccaatgagatgctgcggggcatcaagctgctgaagctgtatgcctgggagaacatcttccgcaccagggtggagaccaccaggaggaaggagatgaccagcctgcgggcctttgccatctacaccagcatcagcatcttcatgaacacagccatccccatcgctgctgtgctgatcacctttgtgggccacgtgtccttcttcaaggaggccgacttcagccccagcgtggcctttgccagcctgagcctcttccacatcctggtgacccccctcttcctgctgagctctgtggtgcgcagcacagtgaaggccctggtgtctgtgcagaagctgtctgagttcctgagcagcgctgagatccgggaggagcagtgtgcccctcatgagcccaccccccagggccctgccagcaagtaccaggccgtgcccctgcgggtggtgaacaggaagaggcctgcccgggaggactgccggggcctgaccggccccctgcagagcctggtgcccagcgcagatggagatgctgacaactgctgcgtgcagatcatgggcggctacttcacctggaccccagatggcatccccaccctgagcaacatcaccatccgcatcccccggggccagctgaccatgattgtgggccaggtgggctgcggcaagagcagcctgctgctggccgccctgggggagatgcagaaggtgtctggagctgtgttctggagcagcagcctgcctgacagcgagatcggggaggaccccagccctgagcgggagacagccacagacctggacatcaggaagaggggccctgtggcctatgccagccagaagccctggctgctgaatgccaccgtggaggagaacatcatctttgagagccccttcaacaagcagcgctacaagatggtgattgaggcctgcagcctgcagcctgacatcgacatcctgccccatggagaccagacccagattggagagcggggcatcaacctgagcggcggccagaggcagaggatctctgtggcccgggccctgtaccagcacgccaacgtggtgttcctggatgaccccttcagcgccctggacatccacctgagtgaccacctgatgcaggccggcatcctggagctgctgagagatgacaagaggacagtggtgctggtgacccacaagctgcagtacctgccccatgctgactggatcatcgccatgaaggatggcaccatccagcgggagggcaccctgaaggacttccagaggtctgagtgccagctgtttgagcactggaagaccctgatgaaccggcaggaccaggagctggagaaggagaccgtgacagagaggaaggccacagagcccccccagggcctgagccgggccatgagcagcagagatggcctgctgcaggatgaggaggaggaggaggaggaggccgctgagagcgaggaggatgacaacctgagctccatgctgcaccagagagctgagatcccctggagggcctgtgccaagtacctgagcagcgctggcatcctgctgctgagcctgctggtgttcagccagctgctgaagcacatggtgctggtggccatcgactactggctggccaagtggacagacagcgccctgaccctgaccccagctgccaggaactgcagcctgagccaggagtgcaccctggaccagacagtgtatgccatggtgttcaccgtgctgtgcagcctgggcatcgtgctgtgcctggtgacctctgtgacagtggagtggacaggcctgaaggtggccaagaggctgcacaggagcctgctgaaccgcatcatcctggcccccatgaggttctttgagaccacccccctgggcagcatcctgaaccgcttcagcagtgactgcaacaccatcgaccagcacatccccagcaccctggagtgcctgagccgcagcaccctgctgtgtgtgtctgccctggccgtcatctcctatgtgacccctgtgttcctggtggccctgctgcccctggccatcgtgtgctacttcatccagaagtacttccgggtggccagccgggacctgcagcagctggatgacaccacccagctgcccctgctgagccactttgctgagaccgtggagggcctgaccaccatccgggccttccgctatgaggcccgcttccagcagaagctgctggagtacacagacagcaacaacatcgccagcctcttcctgacagctgccaaccgctggctggaggtgaggatggagtacatcggggcctgtgtggtgctgattgctgctgtgaccagcatcagcaacagcctgcaccgggagctgtctgctggcctggtgggcctgggcctgacctacgccctgatggtgagcaactacctgaactggatggtgaggaacctggccgacatggagctgcagctgggcgctgtgaagaggatccacggcctgctgaagacagaagctgagagctatgagggcctgctggcccccagcctcatccccaagaactggccagaccagggcaagatccagatccagaacctgtctgtgcgctatgacagcagcctgaagcctgtgctgaagcacgtgaatgccctgattgcccctggccagaagattggcatctgtggccgcactggaagtggcaagagcagcttcagcctggccttcttcaggatggtggacacctttgagggccacatcatcattgatggcatcgacatcgccaagctgcccctgcacaccctgcggagccggctgagcatcatcctgcaggaccctgtgctcttcagcggcaccatccgcttcaacctggaccctgagaggaaatgtagtgacagcaccctgtgggaggccctggagatcgcccagctgaagctggtggtgaaggccctgcccggcggcctggatgccatcatcacagagggcggggagaacttcagccagggccagaggcagctgttctgcctggcccgggcctttgtgaggaagaccagcatcttcatcatggatgaggccacagccagcattgacatggccacagagaacatcctgcagaaggtggtgatgacagcctttgctgacagaacagtggtgaccatcgcccaccgggtgcacaccatcctgtctgctgacctggtgattgtgctgaagagaggagccatcctggagtttgacaagccagagaagctgctgagcaggaaggacagcgtgtttgccagctttgtgcgggctgacaagtag

SEQ ID NO: 32550 - DNA, 3036 bp, Artificial Sequence
  Description of Artificial Sequence: Synthetic coding sequence
cgcagccagctgagccccagccctgcccgggcccgggccgccatgcccctggccttctgtggcagcgagaaccacagcgctgcctacagagtggaccagggcgtgctgaacaacggctgctttgtggatgccctgaatgtggtgccccacgtgttcctgctcttcatcaccttccccatcctcttcatcggctggggcagccagagcagcaaggtgcacatccaccacagcacctggctgcacttccctggccacaacctgcgctggatcctgaccttcatgctgctgtttgtgctggtgtgtgaaattgctgagggcatcctgagtgatggagtgacagagagccaccacctgcacctgtacatgcctgctggcatggccttcatggctgctgtgacctctgtggtgtactaccacaacatcgagaccagcaacttccccaagctgctgattgccctgctggtgtactggaccctggccttcatcaccaagaccatcaagtttgtgaagttcctggaccacgccatcggcttcagccagctgcgcttctgcctgaccggcctgctggtgatcctgtatggcatgctgctgctggtggaggtgaatgtcatccgggtgcggcgctacatcttcttcaagaccccccgggaggtgaagcccccagaggacctgcaggacctgggcgtgcgcttcctgcagccctttgtgaacctgctgagcaagggcacctactggtggatgaatgccttcatcaagacagcccacaagaagcccatcgacctgcgggccatcggcaagctgcccatcgccatgagggccctgaccaactaccagaggctgtgtgaggcctttgatgcccaggtgaggaaggacatccagggcacccagggcgcccgggccatctggcaggccctgagccacgcctttggaagaaggctggtgctgagcagcaccttccgcatcctggccgacctgctgggctttgctggccccctgtgcatctttggaattgtggaccacctgggcaaggaaaatgatgtgttccagcccaagacccagttcctgggcgtgtactttgtgagcagccaggagttcctggccaatgcctacgtgctggccgtgctgctcttcctggccctgctgctgcagaggaccttcctgcaggccagctactacgtggccattgaaacaggcatcaacctgcggggggccatccagaccaagatctacaacaagatcatgcacctgagcaccagcaacctgtccatgggagagatgacagctggccagatctgcaacctggtggccatcgacaccaaccagctgatgtggttcttcttcctgtgccccaacctgtgggccatgcctgtgcagatcatcgtgggcgtcatcctgctgtactacatcctgggcgtgtctgccctgattggagctgctgtgatcatcctgctggcccctgtgcagtactttgtggccaccaagctgagccaggcccagaggagcaccctggagtacagcaatgaaaggctgaagcagaccaatgagatgctgcggggcatcaagctgctgaagctgtatgcctgggagaacatcttccgcaccagggtggagaccaccaggaggaaggagatgaccagcctgcgggcctttgccatctacaccagcatcagcatcttcatgaacacagccatccccatcgctgctgtgctgatcacctttgtgggccacgtgtccttcttcaaggaggccgacttcagccccagcgtggcctttgccagcctgagcctcttccacatcctggtgacccccctcttcctgctgagctctgtggtgcgcagcacagtgaaggccctggtgtctgctgagatccgggaggagcagtgtgcccctcatgagcccaccccccagggccctgccagcaagtaccaggccgtgcccctgcgggtggtgaacaggaagaggcctgcccgggaggactgccggggcctgaccggccccctgcagagcctggtgcccagcgcagatggagatgctgacaactgctgcgtgcagatcatgggcggctacttcacctggaccccagatggcatccccaccctgagcaacatcaccatccgcatcccccggggccagctgaccatgattgtgggccaggtgggctgcggcaagagcagcctgctgctggccgccctgggggagatgcagaaggtgtctggagctgtgttctggagcagcctgcctgattctgaaattggagaggaccccagccctgagcgggagacagccacagacctggacatcaggaagaggggccctgtggcctatgccagccagaagccctggctgctgaatgccaccgtggaggagaacatcatctttgagagccccttcaacaagcagcgctacaagatggtgattgaggcctgcagcctgcagcctgacatcgacatcctgccccacggggaccagacccagatcggggagcggggcatcaacctgagcggcggccagaggcagaggatctctgtggcccgggccctgtaccagcacgccaacgtggtgttcctggatgaccccttcagcgccctggacatccacctgagtgaccacctgatgcaggccggcatcctggagctgctgagagatgacaagaggacagtggtgctggtgacccacaagctgcagtacctgccccacgccgactggatcatcgccatgaaggatggcaccatccagcgggagggcaccctgaaggacttccagaggtctgagtgccagctgtttgagcactggaagaccctgatgaaccggcaggaccaggagctggagaagaggcggcagctgcgggcccggaggatgaccacctgccggccctgctgcacctctgtgctgcggagccatggagagcccgcccccagcacctgccccccaccagccagctgcagctgccgctgctggagcagccacagctgcagcagcacctggagctggtggcccagcaccaccggctggcccagcggccccacagccccctag

SEQ ID NO: 32551 - DNA, 4746 bp, Artificial Sequence
  Description of Artificial Sequence: Synthetic coding sequence
atgcccctggccttctgtggcagcgagaaccacagcgctgcctacagagtggaccagggcgtgctgaacaacggctgctttgtggatgccctgaatgtggtgccccacgtgttcctgctcttcatcaccttccccatcctcttcatcggctggggcagccagagcagcaaggtgcacatccaccacagcacctggctgcacttccctggccacaacctgcgctggatcctgaccttcatgctgctgtttgtgctggtgtgtgaaattgctgagggcatcctgagtgatggagtgacagagagccaccacctgcacctgtacatgcctgctggcatggccttcatggctgctgtgacctctgtggtgtactaccacaacatcgagaccagcaacttccccaagctgctgattgccctgctggtgtactggaccctggccttcatcaccaagaccatcaagtttgtgaagttcctggaccacgccatcggcttcagccagctgcgcttctgcctgaccggcctgctggtgatcctgtatggcatgctgctgctggtggaggtgaatgtcatccgggtgcggcgctacatcttcttcaagaccccccgggaggtgaagcccccagaggacctgcaggacctgggcgtgcgcttcctgcagccctttgtgaacctgctgagcaagggcacctactggtggatgaatgccttcatcaagacagcccacaagaagcccatcgacctgcgggccatcggcaagctgcccatcgccatgagggccctgaccaactaccagaggctgtgtgaggcctttgatgcccaggtgaggaaggacatccagggcacccagggcgcccgggccatctggcaggccctgagccacgcctttggaagaaggctggtgctgagcagcaccttccgcatcctggccgacctgctgggctttgctggccccctgtgcatctttggaattgtggaccacctgggcaaggaaaatgatgtgttccagcccaagacccagttcctgggcgtgtactttgtgagcagccaggagttcctggccaatgcctacgtgctggccgtgctgctcttcctggccctgctgctgcagaggaccttcctgcaggccagctactacgtggccattgaaacaggcatcaacctgcggggggccatccagaccaagatctacaacaagatcatgcacctgagcaccagcaacctgtccatgggagagatgacagctggccagatctgcaacctggtggccatcgacaccaaccagctgatgtggttcttcttcctgtgccccaacctgtgggccatgcctgtgcagatcatcgtgggcgtcatcctgctgtactacatcctgggcgtgtctgccctgattggagctgctgtgatcatcctgctggcccctgtgcagtactttgtggccaccaagctgagccaggcccagaggagcaccctggagtacagcaatgaaaggctgaagcagaccaatgagatgctgcggggcatcaagctgctgaagctgtatgcctgggagaacatcttccgcaccagggtggagaccaccaggaggaaggagatgaccagcctgcgggcctttgccatctacaccagcatcagcatcttcatgaacacagccatccccatcgctgctgtgctgatcacctttgtgggccacgtgtccttcttcaaggaggccgacttcagccccagcgtggcctttgccagcctgagcctcttccacatcctggtgacccccctcttcctgctgagctctgtggtgcgcagcacagtgaaggccctggtgtctgtgcagaagctgtctgagttcctgagcagcgctgagatccgggaggagcagtgtgcccctcatgagcccaccccccagggccctgccagcaagtaccaggccgtgcccctgcgggtggtgaacaggaagaggcctgcccgggaggactgccggggcctgaccggccccctgcagagcctggtgcccagcgcagatggagatgctgacaactgctgcgtgcagatcatgggcggctacttcacctggaccccagatggcatccccaccctgagcaacatcaccatccgcatcccccggggccagctgaccatgattgtgggccaggtgggctgcggcaagagcagcctgctgctggccgccctgggggagatgcagaaggtgtctggagctgtgttctggagcagcctgcctgattctgaaattggagaggaccccagccctgagcgggagacagccacagacctggacatcaggaagaggggccctgtggcctatgccagccagaagccctggctgctgaatgccaccgtggaggagaacatcatctttgagagccccttcaacaagcagcgctacaagatggtgattgaggcctgcagcctgcagcctgacatcgacatcctgccccacggggaccagacccagatcggggagcggggcatcaacctgagcggcggccagaggcagaggatctctgtggcccgggccctgtaccagcacgccaacgtggtgttcctggatgaccccttcagcgccctggacatccacctgagtgaccacctgatgcaggccggcatcctggagctgctgagagatgacaagaggacagtggtgctggtgacccacaagctgcagtacctgccccacgccgactggatcatcgccatgaaggatggcaccatccagcgggagggcaccctgaaggacttccagaggtctgagtgccagctgtttgagcactggaagaccctgatgaaccggcaggaccaggagctggagaaggagaccgtgacagagaggaaggccacagagcccccccagggcctgagccgggccatgagcagcagagatggcctgctgcaggatgaggaggaggaggaggaggaggccgctgagagtgaagaagatgacaacctgagctccatgctgcaccagagagctgagatcccctggagggcctgtgccaagtacctgagcagcgctggcatcctgctgctgagcctgctggtgttcagccagctgctgaagcacatggtgctggtggccatcgactactggctggccaagtggacagattctgccctgaccctgaccccagctgccaggaactgcagcctgagccaggagtgcaccctggaccagacagtgtatgccatggtgttcaccgtgctgtgcagcctgggcatcgtgctgtgcctggtgacctctgtgacagtggagtggacaggcctgaaggtggccaagaggctgcacaggagcctgctgaaccgcatcatcctggcccccatgaggttctttgagaccacccccctgggcagcatcctgaaccgcttcagcagtgactgcaacaccatcgaccagcacatccccagcaccctggagtgcctgagccgcagcaccctgctgtgtgtgtctgccctggccgtcatctcctatgtgacccctgtgttcctggtggccctgctgcccctggccatcgtgtgctacttcatccagaagtacttccgggtggccagccgggacctgcagcagctggatgacaccacccagctgcccctgctgagccactttgctgagaccgtggagggcctgaccaccatccgggccttccgctatgaggcccgcttccagcagaagctgctggagtacacagacagcaacaacatcgccagcctcttcctgacagctgccaaccgctggctggaggtgaggatggagtacatcggggcctgtgtggtgctgattgctgctgtgaccagcatcagcaacagcctgcaccgggagctgtctgctggcctggtgggcctgggcctgacctacgccctgatggtgagcaactacctgaactggatggtgaggaacctggccgacatggagctgcagctgggcgctgtgaagagaattcatggcctgctgaagacagaggccgagagctatgagggcctgctggcccccagcctcatccccaagaactggccagaccagggcaagatccagatccagaacctgtctgtgcgctatgacagcagcctgaagcctgtgctgaagcacgtgaatgccctgattgcccctggccagaagattggcatctgtggccgcacaggcagcggcaagagcagcttcagcctggccttcttcaggatggtggacacctttgagggccacatcatcattgatggcattgatattgccaagctgcccctgcacaccctgcggagccggctgagcatcatcctgcaggaccctgtgctcttcagcggcaccatccgcttcaacctggaccctgagaggaagtgcagcgacagcaccctgtgggaggccctggagatcgcccagctgaagctggtggtgaaggccctgcccggcggcctggatgccatcatcacagaaggaggagagaacttcagccagggccagaggcagctgttctgcctggcccgggcctttgtgaggaagaccagcatcttcatcatggatgaggccacagccagcattgacatggccacagagaacatcctgcagaaggtggtgatgacagcctttgctgacagaacagtggtgaccatcgcccaccgggtgcacaccatcctgtctgctgacctggtgattgtgctgaagagaggagccatcctggagtttgacaagccagagaagctgctgagcaggaaggacagcgtgtttgccagctttgtgcgggctgacaagtag

SEQ ID NO: 32552 - DNA, 2994 bp, Artificial Sequence
  Description of Artificial Sequence: Synthetic coding sequence
atgcccctggccttctgtggcagcgagaaccacagcgctgcctacagagtggaccagggcgtgctgaacaacggctgctttgtggatgccctgaatgtggtgccccacgtgttcctgctcttcatcaccttccccatcctcttcatcggctggggcagccagagcagcaaggtgcacatccaccacagcacctggctgcacttccctggccacaacctgcgctggatcctgaccttcatgctgctgtttgtgctggtgtgtgaaattgctgagggcatcctgagtgatggagtgacagagagccaccacctgcacctgtacatgcctgctggcatggccttcatggctgctgtgacctctgtggtgtactaccacaacatcgagaccagcaacttccccaagctgctgattgccctgctggtgtactggaccctggccttcatcaccaagaccatcaagtttgtgaagttcctggaccacgccatcggcttcagccagctgcgcttctgcctgaccggcctgctggtgatcctgtatggcatgctgctgctggtggaggtgaatgtcatccgggtgcggcgctacatcttcttcaagaccccccgggaggtgaagcccccagaggacctgcaggacctgggcgtgcgcttcctgcagccctttgtgaacctgctgagcaagggcacctactggtggatgaatgccttcatcaagacagcccacaagaagcccatcgacctgcgggccatcggcaagctgcccatcgccatgagggccctgaccaactaccagaggctgtgtgaggcctttgatgcccaggtgaggaaggacatccagggcacccagggcgcccgggccatctggcaggccctgagccacgcctttggaagaaggctggtgctgagcagcaccttccgcatcctggccgacctgctgggctttgctggccccctgtgcatctttggaattgtggaccacctgggcaaggaaaatgatgtgttccagcccaagacccagttcctgggcgtgtactttgtgagcagccaggagttcctggccaatgcctacgtgctggccgtgctgctcttcctggccctgctgctgcagaggaccttcctgcaggccagctactacgtggccattgaaacaggcatcaacctgcggggggccatccagaccaagatctacaacaagatcatgcacctgagcaccagcaacctgtccatgggagagatgacagctggccagatctgcaacctggtggccatcgacaccaaccagctgatgtggttcttcttcctgtgccccaacctgtgggccatgcctgtgcagatcatcgtgggcgtcatcctgctgtactacatcctgggcgtgtctgccctgattggagctgctgtgatcatcctgctggcccctgtgcagtactttgtggccaccaagctgagccaggcccagaggagcaccctggagtacagcaatgaaaggctgaagcagaccaatgagatgctgcggggcatcaagctgctgaagctgtatgcctgggagaacatcttccgcaccagggtggagaccaccaggaggaaggagatgaccagcctgcgggcctttgccatctacaccagcatcagcatcttcatgaacacagccatccccatcgctgctgtgctgatcacctttgtgggccacgtgtccttcttcaaggaggccgacttcagccccagcgtggcctttgccagcctgagcctcttccacatcctggtgacccccctcttcctgctgagctctgtggtgcgcagcacagtgaaggccctggtgtctgctgagatccgggaggagcagtgtgcccctcatgagcccaccccccagggccctgccagcaagtaccaggccgtgcccctgcgggtggtgaacaggaagaggcctgcccgggaggactgccggggcctgaccggccccctgcagagcctggtgcccagcgcagatggagatgctgacaactgctgcgtgcagatcatgggcggctacttcacctggaccccagatggcatccccaccctgagcaacatcaccatccgcatcccccggggccagctgaccatgattgtgggccaggtgggctgcggcaagagcagcctgctgctggccgccctgggggagatgcagaaggtgtctggagctgtgttctggagcagcctgcctgattctgaaattggagaggaccccagccctgagcgggagacagccacagacctggacatcaggaagaggggccctgtggcctatgccagccagaagccctggctgctgaatgccaccgtggaggagaacatcatctttgagagccccttcaacaagcagcgctacaagatggtgattgaggcctgcagcctgcagcctgacatcgacatcctgccccacggggaccagacccagatcggggagcggggcatcaacctgagcggcggccagaggcagaggatctctgtggcccgggccctgtaccagcacgccaacgtggtgttcctggatgaccccttcagcgccctggacatccacctgagtgaccacctgatgcaggccggcatcctggagctgctgagagatgacaagaggacagtggtgctggtgacccacaagctgcagtacctgccccacgccgactggatcatcgccatgaaggatggcaccatccagcgggagggcaccctgaaggacttccagaggtctgagtgccagctgtttgagcactggaagaccctgatgaaccggcaggaccaggagctggagaagaggcggcagctgcgggcccggaggatgaccacctgccggccctgctgcacctctgtgctgcggagccatggagagcccgcccccagcacctgccccccaccagccagctgcagctgccgctgctggagcagccacagctgcagcagcacctggagctggtggcccagcaccaccggctggcccagcggccccacagccccctag

SEQ ID NO: 32553 - DNA, 792 bp, Artificial Sequence
  Description of Artificial Sequence: Synthetic coding sequence
atgagctttgctgtgttcctgatccacaccaagaggaagaagggcgtgcagagcagtggagtgctgtttggctactggctgctgtgctttgtgctgcctgccaccaatgctgcccagcaggccagcggggccggcttccagagcgaccctgtgcgccacctgagcacctacctgtgcctgagcctggtggtggcccagtttgtgctgagctgcctggccgaccagccccccttcttccctgaggacccccagcagagcaacccctgcccagagaccggggccgccttccccagcaaggccaccttctggtgggtgtctggcctggtgtggaggggctaccgccggcccctgcggcccaaggacctgtggagcctgggccgggagaacagcagcgaggagctggtgtcccggctggagaaggagtggatgaggaacagatctgctgcccggggccacaacaaggccatcgccttcaagaggaaaggaggcagcggcatggaggcccctgagacagagcccttcctgcggcaggagggcagccagtggaggcccctgctgaaggccatctggcaggtgttccacagcaccttcctgctgggcaccctgagcctggtgatcagtgatgtgttccgcttcaccgtgcccaagctgctgagcctcttcctggagttcatcggggaccccaagcccccagcctggaagggctacctgctggccgtgctgatgttcctgagcgcctgcctgcagaccctgtttgagcagcagaacatgtaccgcctgaaggtgctgtag

SEQ ID NO: 32554 - DNA, 600 bp, Artificial Sequence
  Description of Artificial Sequence: Synthetic coding sequence
atgctgctgggccgcctgaccagccagctgctgcgggctgtgccctgggccggcggccggcccccctggcctgtgtctggagtgctgggcagccgggtgtgtggccccctgtacagcaccagccctgctggccctggccgggccgccagcctgcccaggaagggggcccagctggagctggaggagatgctggtgcccaggaagatgtctgtgagccccctggagagctggctgacagcccgctgcttcctgccccggctggacacaggaacagctggcaccgtggccccaccccagagctaccagtgcccccccagccagatcggggagggcgctgagcagggagatgagggcgtggctgatgccccccagatccagtgcaagaatgtgctgaagatcagaagaaggaagatgaaccaccacaagtacaggaagctggtgaagaagacccgcttcctgcggaggaaggtgcaggagggccgcctgcggaggaagcagatcaagtttgagaaggacctgcggcgcatctggctgaaggccggcctgaaggaggcccctgagggctggcagacccccaagatctacctgcggggcaagtag

SEQ ID NO: 32555 - DNA, 600 bp, Artificial Sequence; identical to SEQ ID NO: 32554
  Description of Artificial Sequence: Synthetic coding sequence

SEQ ID NO: 32556 - DNA, 600 bp, Artificial Sequence; identical to SEQ ID NO: 32554
  Description of Artificial Sequence: Synthetic coding sequence

SEQ ID NO: 32557 - DNA, 600 bp, Artificial Sequence; identical to SEQ ID NO: 32554
  Description of Artificial Sequence: Synthetic coding sequence

SEQ ID NO: 32558 - DNA, 870 bp, Artificial Sequence
  Description of Artificial Sequence: Synthetic coding sequence
atgaagaccctgcctgccatgctgggcaccgggaagctgttctgggtgttcttcctgatcccctacctggacatctggaacatccacggcaaggagagctgtgatgtgcagctgtacatcaagaggcagagcgagcacagcatcctggccggggacccctttgagctggagtgccctgtgaagtactgtgccaaccggccccacgtgacctggtgcaagctgaatggcaccacctgtgtgaagctggaggaccggcagacctcctggaaggaggagaagaacatctccttcttcatcctgcactttgagcctgtgctgcccaatgacaatggcagctaccgctgcagcgccaacttccagagcaacctgattgagagccacagcaccaccctgtatgtgacagatgtgaagagcgccagcgagcggcccagcaaggatgagatggccagccggccctggctgctgtaccgcctgctgcccctgggcggcctgcccctgctgatcaccacctgcttctgcctcttctgctgcctgcggcggcaccagggcaagcagaatgagctgagtgacacagctggccgggagatcaacctggtggatgcccacctgaagtctgagcagacagaggccagcacccggcagaacagccaggtgctgctgtctgaaacaggcatctatgacaatgaccctgacctgtgcttcaggatgcaggagggcagcgaggtgtacagcaacccctgcctggaggagaacaagccaggcatcgtgtatgccagcctgaaccacagcgtgattggccccaacagccggctggccagaaatgtgaaggaggcccccacagaatatgccagcatctgtgtgcgctcctag

SEQ ID NO: 32559 - DNA, 726 bp, Artificial Sequence
  Description of Artificial Sequence: Synthetic coding sequence
atgaagaccctgcctgccatgctgggcaccgggaagctgttctgggtgttcttcctgatcccctacctggacatctggaacatccacggcaaggagagctgtgatgtgcagctgtacatcaagaggcagagcgagcacagcatcctggccggggacccctttgagctggagtgccctgtgaagtactgtgccaaccggccccacgtgacctggtgcaagctgaatggcaccacctgtgtgaagctggaggaccggcagacctcctggaaggaggagaagaacatctccttcttcatcctgcactttgagcctgtgctgcccaatgacaatggcagctaccgctgcagcgccaacttccagagcaacctgattgagagccacagcaccaccctgtatgtgacaggcaagcagaatgagctgagtgacacagctggccgggagatcaacctggtggatgcccacctgaagtctgagcagacagaggccagcacccggcagaacagccaggtgctgctgtctgaaacaggcatctatgacaatgaccctgacctgtgcttcaggatgcaggagggcagcgaggtgtacagcaacccctgcctggaggagaacaagccaggcatcgtgtatgccagcctgaaccacagcgtgattggccccaacagccggctggccagaaatgtgaaggaggcccccacagaatatgccagcatctgtgtgcgctcctag

SEQ ID NO: 32560 - DNA, 1365 bp, Artificial Sequence
  Description of Artificial Sequence: Synthetic coding sequence
atgacctggagggctgctgccagcacctgtgccgccctgctgatcctgctgtgggccctgaccacagaaggagacctgaaggtggagatgatggccggcggcacccagatcacccccctgaatgacaacgtgaccatcttctgcaacatcttctacagccagcccctgaacatcacctccatgggcatcacctggttctggaagagcctgacctttgacaaggaggtgaaggtgtttgagttcttcggggaccaccaggaggccttccggcctggggccatcgtgagcccctggaggctgaagtctggagatgccagcctgcggctgcccggcatccagctggaggaggccggggagtaccgctgtgaggtggtggtgacccccctgaaggcccagggcaccgtgcagctggaggtggtggccagccctgccagccggctgctgctggaccaggtgggcatgaaggaaaatgaagacaagtacatgtgtgagagcagcggcttctacccagaggccatcaacatcacctgggagaagcagacccagaagttcccccaccccatcgagatcagtgaagatgtgatcaccggccccaccatcaagaacatggatggcaccttcaacgtgaccagctgcctgaagctgaacagcagccaggaggaccccggcaccgtgtaccagtgtgtggtgagacatgccagcctgcacacccccctgcggagcaacttcaccctgacagctgcccggcacagcctgtctgaaacagagaagacagacaacttcagcatccactggtggcccatctccttcatcggcgtgggcctggtgctgctgattgtgctgatcccctggaagaagatctgcaacaagagcagcagcgcctacacccccctgaagtgcatcctgaagcactggaacagctttgacacccagaccctgaagaaggagcacctgatcttcttctgcacccgggcctggcccagctaccagctgcaggatggagaggcctggcccccagagggctctgtgaacatcaacaccatccagcagctggatgtgttctgccggcaggagggcaagtggagcgaggtgccctacgtgcaggccttctttgccctgcgggacaacccagacctgtgccagtgctgcagaattgatcctgccctgctgactgtgaccagcggcaagagcattgatgacaacagcaccaagtctgagaagcagaccccccgggagcacagtgatgctgtgcctgatgcccccatcctgcctgtgagccccatctgggagcccccaccagccaccaccagcaccacccctgtgctgagcagccagccccccaccctgctgctgcccctgcagtag

SEQ ID NO: 32561 - DNA, 1365 bp, Artificial Sequence; identical to SEQ ID NO: 32560
  Description of Artificial Sequence: Synthetic coding sequence

SEQ ID NO: 32562 - DNA, 660 bp, Artificial Sequence
  Description of Artificial Sequence: Synthetic coding sequence
atggcccctgagatggaccagttctaccgcagcaccatggccatctacaagagcatcatggagcagttcaacccagccctggagaacctggtgtacctgggcaacaactacctgcgggccttccacgccctgtctgaggccgctgaggtgtacttcagcgccatccagaagatcggggagcgggccctgcagagccccaccagccagatcctgggggagatcctggtgcagatgtctgacacccagaggcacctgaacagcgacctggaggtggtggtgcagaccttccatggaggcctgctgcagcacatggagaagaacaccaagctggacatgcagttcatcaaggacagccggcagcactatgagctggagtaccgccaccgggccgccaacctggagaagtgcatgtctgagctgtggaggatggagaggaagagggacaagaatgtgcgggagatgaaggagagcgtgaaccggctgcacgcccagatgcaggcctttgtgtctgagagccagagagctgctgagctggaggagaagaggcgctaccgcttcctggccgagaagcacctgctgctgagcaacaccttcctgcagttcttcggccgcatgctggctgatggccgcctggtggtgtccaccctgtggctgtcctag

SEQ ID NO: 32563 - DNA, 1590 bp, Artificial Sequence
  Description of Artificial Sequence: Synthetic coding sequence
atggcccctgagatggaccagttctaccgcagcaccatggccatctacaagagcatcatggagcagttcaacccagccctggagaacctggtgtacctgggcaacaactacctgcgggccttccacgccctgtctgaggccgctgaggtgtacttcagcgccatccagaagatcggggagcgggccctgcagagccccaccagccagatcctgggggagatcctggtgcagatgtctgacacccagaggcacctgaacagcgacctggaggtggtggtgcagaccttccatggaggcctgctgcagcacatggagaagaacaccaagctggacatgcagttcatcaaggacagccggcagcactatgagctggagtaccgccaccgggccgccaacctggagaagtgcatgtctgagctgtggaggatggagaggaagagggacaagaatgtgcgggagatgaaggagagcgtgaaccggctgcacgcccagatgcaggcctttgtgtctgagagccagagagctgctgagctggaggagaagaggcgctaccgcttcctggccgagaagcacctgctgctgagcaacaccttcctgcagttcttcggccgggcccggggcatgctgcagaacagagtgctgctgtggaaggagcagagcgaggccagccgcagccccagccgggcccacagccctggcctgctgggccctgccctgggccccccctaccccagcggccgcctgacccccacctgcctggacatgccaccccggcccctgggggagttcagcagccccaggagccgccacggcagcggcagctatggaacagagccagatgcccggcctgccagccagctggagccagacagaagaagcctgcccaggaccccatctgccagcagcctgtacagcggcagcgcccagagcagccgcagcaacagctttggagagaggcctgggggcggcggcggggccaggagagtgcgggccctggtgagccacagcgagggcgccaaccacaccctgctgcgcttctctgctggagatgtggtggaggtgctggtgcctgaggcccagaatggctggctgtatggcaagctggagggcagcagcgccagcggctggttccctgaggcctacgtgaaggccctggaggagggccctgtgaaccccatgacccctgtgacccccatgacctccatgacctccatgagccccatgacccccatgaaccctggaaatgagctgcccagccgcagctaccccctgcggggcagccacagcctggatgacctgctggacaggcctggcaacagcatcgcccccagcgagtactgggatggccagagccgcagcaggacccccagccgggtgcccagccgggcccccagccctgcccccccacccctgcccagcagcagaagaagctccatgggcagcacagctgtggccacagatgtgaagaagctgatgagcagcgagcagtacccaccccaggagctgttcccccggggcaccaacccctttgccaccgtgaagctgcggcccaccatcaccaatgacagaagtgcccccctcatcagatag

SEQ ID NO: 32564 - DNA, 1548 bp, Artificial Sequence
  Description of Artificial Sequence: Synthetic coding sequence
atggcccctgagatggaccagttctaccgcagcaccatggccatctacaagagcatcatggagcagttcaacccagccctggagaacctggtgtacctgggcaacaactacctgcgggccttccacgccctgtctgaggccgctgaggtgtacttcagcgccatccagaagatcggggagcgggccctgcagagccccaccagccagatcctgggggagatcctggtgcagatgtctgacacccagaggcacctgaacagcgacctggaggtggtggtgcagaccttccatggaggcctgctgcagcacatggagaagaacaccaagctggacatgcagttcatcaaggacagccggcagcactatgagctggagtaccgccaccgggccgccaacctggagaagtgcatgtctgagctgtggaggatggagaggaagagggacaagaatgtgcgggagatgaaggagagcgtgaaccggctgcacgcccagatgcaggcctttgtgtctgagagccagagagctgctgagctggaggagaagaggcgctaccgcttcctggccgagaagcacctgctgctgagcaacaccttcctgcagttcttcggccgggcccggggcatgctgcagaacagagtgctgctgtggaaggagcagagcgaggccagccgcagccccagccgggcccacagccctggcctgctgggccctgccctgggccccccctaccccagcggccgcctgacccccacctgcctggacatgccaccccggcccctgggggagttcagcagccccaggagccgccacggcagcggcagctatggaacagagccagatgcccggcctgccagccagctggagccagacagaagaagcctgcccaggaccccatctgccagcagcctgtacagcggcagcgcccagagcagccgcagcaacagctttggagagaggcctgggggcggcggcggggccaggagagtgcgggccctggtgagccacagcgagggcgccaaccacaccctgctgcgcttctctgctggagatgtggtggaggtgctggtgcctgaggcccagaatggctggctgtatggcaagctggagggcagcagcgccagcggctggttccctgaggcctacgtgaaggccctggaggagggccctgtgaaccccatgacccctgtgacccccatgacctccatgacctccatgagccccatgacccccatgaaccctggaaatgagctgcccagccgcagctaccccctgcggggcagccacagcctggatgacctgctggacaggcctggcaacagcacccccagccgggtgcccagccgggcccccagccctgcccccccacccctgcccagcagcagaagaagctccatgggcagcacagctgtggccacagatgtgaagaagctgatgagcagcgagcagtacccaccccaggagctgttcccccggggcaccaacccctttgccaccgtgaagctgcggcccaccatcaccaatgacagaagtgcccccctcatcagatag

SEQ ID NO: 32565 - DNA, 726 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctggatgctgtgcgggaggtgaggaagtacagctctgtgcacaccatcgagaagagcagcaccagcaggccagatgcctatgagcacacccagatgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcaggaccggctggagcggggcaacaagaagaggctgtag

SEQ ID NO: 32566 - DNA, 726 bp, Artificial Sequence; identical to SEQ ID NO: 32565
  Description of Artificial Sequence: Synthetic coding sequence

SEQ ID NO: 32567 - DNA, 1047 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctggatgctgtgcgggaggtgaggaagtacagctctgtgcacaccatcgagaagagcagcaccagcaggccagatgcctatgagcacacccagatgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcagcacagcagctttggagagttcctgagcaagaggagccacaagaatggcagcatcggcaagcagacaggcagcaggaagggcagcttcaggaagaggcagcaggagaagacagtgaacttcatcaaggacacctgcaacatcctgtgccagaatgacaactttgtgatgctggccagcaggaagttcaagttcaggaagatgcactatgaccgcttcgtcatcttcctgatgccccacatcggctgcatcgtgatggccctgagcaagtacctgatgatgttccagatctactgcaaggtgtgcatcccagccctgaagaagaacatctccatgctgaacaccatcttcacctactag

SEQ ID NO: 32568 - DNA, 468 bp, Artificial Sequence
  Description of Artificial Sequence: Synthetic coding sequence
atgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcagaagagccacagccagcccggggctgctgccttcctggtgaaggaggtggagagcttctag

SEQ ID NO: 32569 - DNA, 402 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctggatgctgtgcgggaggtgaggaagtacagctctgtgcacaccatcgagaagagcagcaccagcaggccagatgcctatgagcacacccagatgaagctgttccgcagccagaggaacctgtacatcagcggcttcagcctcttcttctggctggtgctgcggcggctggtgaccctcatcacccagctggccaaggagctgagcaactag

SEQ ID NO: 32570 - DNA, 492 bp, Artificial Sequence
  Description of Artificial Sequence: Synthetic coding sequence
tgagatgcctatgagcacacccagatgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcagaagagccacagccagcccggggctgctgccttcctggtgaaggaggtggagagcttctag

SEQ ID NO: 32571 - DNA, 1047 bp, Artificial Sequence; identical to SEQ ID NO: 32567
  Description of Artificial Sequence: Synthetic coding sequence

SEQ ID NO: 32572 - DNA, 693 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctggatgctgtgcgggaggtgaggaagtacagctctgtgcacaccatcgagaagagcagcaccagcaggccagatgcctatgagcacacccagatgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcagtag

SEQ ID NO: 32573 - DNA, 444 bp, Artificial Sequence
  Description of Artificial Sequence: Synthetic coding sequence
atgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgatgccctgagcaaggcccagaatgatgtgatggagatgaagatgcagagcgagcggctgagcaaggagtatgaccagctgctgaaggagcacagcgagctgcaggaccggctggagcggggcaacaagaagaggctgtag

SEQ ID NO: 32574 - DNA, 195 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctgtag

SEQ ID NO: 32575 - DNA, 591 bp, Artificial Sequence
  Description of Artificial Sequence: Synthetic coding sequence
atgaccctgcagtgggccgctgtggccaccttcctgtatgcagagatcggcctcatcctgatcttctgcctgcccttcatccccccccagcgctggcagaagatcttctccttcaacgtgtggggcaagatcgccaccttctggaacaaggccttcctgaccatcatcatcctgctgattgtgctcttcctggatgctgtgcgggaggtgaggaagtacagctctgtgcacaccatcgagaagagcagcaccagcaggccagatgcctatgagcacacccagatgaagctgttccgcagccagaggaacctgtacatcagcggcttcagcctcttcttctggctggtgctgcggcggctggtgaccctcatcacccagctggccaaggagctgagcaacaagggcgtgctgaagacccaggccgagaacaccaacaaggccgccaagaagttcatggaggagaatgagaagctgaagaggatcctgaagagccacggcaaggatgaggagtgtgtgctggaggccgagaacaagaagctggtggaggaccaggagaagctgaagacagagctgaggaagaccagtgactag

SEQ ID NO: 32576 - DNA, 741 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagaagcctgaaggctgacctgcagaagctgaaggatgagctggccagcaccaagcagaagctggagaaggccgagaaccaggtgctggccatgaggaagcagagcgagggcctgaccaaggagtatgaccggctgctggaggagcacgccaagctgcaggccgctgtggatggccccatggacaagaaggaggagtag

SEQ ID NO: 32577 - DNA, 549 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagatag

SEQ ID NO: 32578 - DNA, 537 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggagtag

SEQ ID NO: 32579 - DNA, 942 bp, Artificial Sequence
  Description of Artificial Sequence: Synthetic coding sequence
atgggcgctgaggccagcagctcctggtgccctggaacagccctgcctgaggagcggctgtctgtgaagagggccagcgagatcagcggcttcctgggccagggcagcagtggagaggccgccctggatgtgctgacccacgtgctggagggcgccggcaacaagctgaccagcagctgtgggaagcccagcagcaacaggatgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagaagcctgaaggctgacctgcagaagctgaaggatgagctggccagcaccaagcagaagctggagaaggccgagaaccaggtgctggccatgaggaagcagagcgagggcctgaccaaggagtatgaccggctgctggaggagcacgccaagctgcaggccgctgtggatggccccatggacaagaaggaggagtag

SEQ ID NO: 32580 - DNA, 564 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagaagcctgaaggctgactag

SEQ ID NO: 32581 - DNA, 417 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagtag

SEQ ID NO: 32582 - DNA, 741 bp, Artificial Sequence; identical to SEQ ID NO: 32576
  Description of Artificial Sequence: Synthetic coding sequence

SEQ ID NO: 32583 - DNA, 567 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagaagcctgaaggctgacctgtag

SEQ ID NO: 32584 - DNA, 942 bp, Artificial Sequence; identical to SEQ ID NO: 32579
  Description of Artificial Sequence: Synthetic coding sequence

SEQ ID NO: 32585 - DNA, 798 bp, Artificial Sequence
  Description of Artificial Sequence: Synthetic coding sequence
atgtatgtgggctacgtgctggacaaggacagccctgtgtacccaggccctgcccggcctgccagcctgggcctgggcccccaggcctacggccccccagcccctcctccagccccaccccagtacccagacttcagcagctacagccacgtggagcccgccccagccccacccacagcctggggcgcccccttccctgcccccaaggatgactgggccgccgcctacggccctggccctgctgccccagctgccagccctgccagcctggccttcggccccccaccagacttcagccctgtgcctgcccctcctggccctggccctggcctgctggcccagcccctgggcggccctggcacccccagcagccctggggcccagaggcccaccccctatgagtggatgagaagatctgtggccgccggcggcggcggcggcagcggcaagaccaggaccaaggacaagtacagagtggtgtacacagaccaccagaggctggagctggagaaggagttccactacagccgctacatcaccatccggaggaagtctgagctggccgccaacctgggcctgacagagcggcaggtgaagatctggttccagaacagaagagccaaggagaggaaggtgaacaagaagaagcagcagcagcagcagcccccccagccccccatggcccatgacatcacagccaccccagctggccccagcctgggcggcctgtgccccagcaacaccagcctgctggccaccagcagccccatgcctgtgaaggaggagttcctgccctag

SEQ ID NO: 32586 - DNA, 687 bp, Artificial Sequence
  Description of Artificial Sequence: Synthetic coding sequence
atggccgccccccaggatgtgcacgtgcgcatctgcaaccaggagatcgtgaagtttgacctggaggtgaaggccctgatccaggacatccgggactgcagcggccccctgagcgccctgacagagctgaacaccaaggtgaaggagaagttccagcagctgcggcaccgcatccaggacctggagcagctggccaaggagcaggacaaggagagcgagaagcagctgctgctgcaggaggtggagaaccacaagaagcagatgctgagcaaccaggcctcctggaggaaggccaacctgacctgcaagatcgccatcgacaacctggagaaggccgagctgctgcagggcggggacctgctgcggcagaggaagaccaccaaggagagcctggcccagaccagcagcaccatcacagagagcctgatgggcatcagcaggatgatggcccagcaggtgcagcagagcgaggaggccatgcagagcctggtgaccagcagcaggaccatcctggatgccaatgaggagttcaagtccatgagcggcaccatccagctgggcaggaagctgatcaccaagtacaacagaagagagctgacagacaagctgctgatcttcctggccctggccctcttcctggccaccgtgctgtacatcgtgaagaagaggctcttccccttcctgtag

SEQ ID NO: 32587 - DNA, 714 bp, Artificial Sequence
  Description of Artificial Sequence: Synthetic coding sequence
atggccgccccccaggatgtgcacgtgcgcatctgcaaccaggagatcgtgaagtttgacctggaggtgaaggccctgatccaggacatccgggactgcagcggccccctgagcgccctgacagagctgaacaccaaggtgaaggagaagttccagcagctgcggcaccgcatccagcctgtgctgtaccagagggccttcatctggacagccagcaccttcttcttcaagctgacctacagcctgacagacttcagcagcacccagcacgacttcaacagccccaccacccctgtgaccttcagtgacctggagcagctggccaaggagcaggacaaggagagcgagaagcagctgctgctgcaggaggtggagaaccacaagaagcagatgctgaggaagaccaccaaggagagcctggcccagaccagcagcaccatcacagagagcctgatgggcatcagcaggatgatggcccagcaggtgcagcagagcgaggaggccatgcagagcctggtgaccagcagcaggaccatcctggatgccaatgaggagttcaagtccatgagcggcaccatccagctgggcaggaagctgatcaccaagtacaacagaagagagctgacagacaagctgctgatcttcctggccctggccctcttcctggccaccgtgctgtacatcgtgaagaagaggctcttccccttcctgtag

SEQ ID NO: 32588 - DNA, 585 bp, Artificial Sequence
  Description of Artificial Sequence: Synthetic coding sequence
atggccgccccccaggatgtgcacgtgcgcatctgcaaccaggagatcgtgaagtttgacctggaggtgaaggccctgatccaggacatccgggactgcagcggccccctgagcgccctgacagagctgaacaccaaggtgaaggagaagttccagcagctgcggcaccgcatccaggacctggagcagctggccaaggagcaggacaaggagagcgagaagcagctgctgctgcaggaggtggagaaccacaagaagcagatgctgaggaagaccaccaaggagagcctggcccagaccagcagcaccatcacagagagcctgatgggcatcagcaggatgatggcccagcaggtgcagcagagcgaggaggccatgcagagcctggtgaccagcagcaggaccatcctggatgccaatgaggagttcaagtccatgagcggcaccatccagctgggcaggaagctgatcaccaagtacaacagaagagagctgacagacaagctgctgatcttcctggccctggccctcttcctggccaccgtgctgtacatcgtgaagaagaggctcttccccttcctgtag

SEQ ID NO: 32589 - DNA, 1458 bp, Artificial Sequence
  Description of Artificial Sequence: Synthetic coding sequence
atggccagcagcagcacagtgcccctgggcttccactatgagaccaagtatgtggtgctgagctacctgggcctgctgagccaggagaagctgcaggagcagcacctgagcagcccccagggcgtgcagctggacatcgccagccagagcctggaccaggagatcctgctgaaggtgaagacagaaattgaggaggagctgaagagcctggacaaggagatcagcgaggccttcaccagcactggatttgacagacacaccagccctgtgttctccccagccaaccctgagagctccatggaggactgcctggcccacctgggggagaaggtgtcccaggagctgaaggagcccctgcacaaggccctgcagatgctgctgagccagcctgtgacctaccaggccttccgggagtgcaccctggagaccaccgtgcacgccagcggctggaacaagatcctggtgcccctggtgctgctgcggcagatgctgctggagctgacccggcggggccaggagcccctgagcgccctgctgcagtttggagtgacctacctggaggactacagcgctgagtacatcatccagcagggcggctggggcaccgtcttcagcctggagagcgaggaggaggagtacccaggcatcacagctgaggacagcaatgacatctacatcctgcccagcgacaacagcggccaggtgtccccacctgagagccccaccgtgaccacctcctggcagagcgagagcctgcctgtgtccctgagcgccagccagagctggcacacagagagcctgcctgtgtccctgggccctgagagctggcagcagatcgccatggaccctgaggaggtgaagagcctggacagcaatggagctggggagaagtctgagaacaacagcagcaacagcgacatcgtgcacgtggagaaggaggaggtgcctgagggcatggaggaggccgctgtggcctctgtggtgctgcctgcccgggagctgcaggaggccctgcctgaggccccagcccccctgctgccccacatcacagccaccagcctgctgggcacccgggagccagacacagaggtgatcaccgtggagaagagcagccctgccaccagcctgtttgtggagctggatgaggaggaggtgaaggccgccaccacagagcccacagaggtggaggaggtggtgcctgccctggagcccacagagaccctgctgtctgagaaggagatcaatgcccgggaggagagcctggtggaggagctgagccctgccagcgagaagaagcctgtgcccccatctgagggcaagagccggctgagccctgctggggagatgaagcccatgcccctgtctgagggcaagagcatcctgctgtttggaggagctgctgctgtggccatcctggccgtggccatcggcgtggccctggccctgaggaagaagtag

SEQ ID NO: 32590 - DNA, 972 bp, Artificial Sequence
  Description of Artificial Sequence: Synthetic coding sequence
atgctgctggagctgacccggcggggccaggagcccctgagcgccctgctgcagtttggagtgacctacctggaggactacagcgctgagtacatcatccagcagggcggctggggcaccgtcttcagcctggagagcgaggaggaggagtacccaggcatcacagctgaggacagcaatgacatctacatcctgcccagcgacaacagcggccaggtgtccccacctgagagccccaccgtgaccacctcctggcagagcgagagcctgcctgtgtccctgagcgccagccagagctggcacacagagagcctgcctgtgtccctgggccctgagagctggcagcagatcgccatggaccctgaggaggtgaagagcctggacagcaatggagctggggagaagtctgagaacaacagcagcaacagcgacatcgtgcacgtggagaaggaggaggtgcctgagggcatggaggaggccgctgtggcctctgtggtgctgcctgcccgggagctgcaggaggccctgcctgaggccccagcccccctgctgccccacatcacagccaccagcctgctgggcacccgggagccagacacagaggtgatcaccgtggagaagagcagccctgccaccagcctgtttgtggagctggatgaggaggaggtgaaggccgccaccacagagcccacagaggtggaggaggtggtgcctgccctggagcccacagagaccctgctgtctgagaaggagatcaatgcccgggaggagagcctggtggaggagctgagccctgccagcgagaagaagcctgtgcccccatctgagggcaagagccggctgagccctgctggggagatgaagcccatgcccctgtctgagggcaagagcatcctgctgtttggaggagctgctgctgtggccatcctggccgtggccatcggcgtggccctggccctgaggaagaagtag

SEQ ID NO: 32591 - DNA, 606 bp, Artificial Sequence
  Description of Artificial Sequence: Synthetic coding sequence
atggccagcagcagcacagtgcccctgggcttccactatgagaccaagtatgtggtgctgagctacctgggcctgctgagccaggagaagctgcaggagcagcacctgagcagcccccagggcgtgcagctggacatcgccagccagagcctggaccaggagatcctgctgaaggtgaagacagaaattgaggaggagctgaagagcctggacaaggagatcagcgaggccttcaccagcactggatttgacagacacaccagccctgtgttctccccagccaaccctgagagctccatggaggactgcctggcccacctgggggagaaggtgtcccaggagctgaaggagcccctgcacaaggccctgcagatgctgctgagccagcctgtgacctaccaggccttccgggagtgcaccctggagaccaccgtgcacgccagcggctggaacaagatcctggtgcccctggtgctgctgcggcagatgctgctggagctgacccggcggggccaggagcccctgagcgccctgctgcagtttggagtgacctacctggaggactacagcgctgagtacatcatccagcagggcggctgggtgtag

SEQ ID NO: 32592 - DNA, 315 bp, Artificial Sequence
  Description of Artificial Sequence: Synthetic coding sequence
atggccagcagcagcacagtgcccctgggcttccactatgagaccaagtatgtggtgctgagctacctgggcctgctgagccaggagaagctgcaggagcagcacctgagcagcccccagggcgtgcagctggacatcgccagccagagcctggaccaggagatcctgctgaaggtgaagacagaaattgaggaggagctgaagagcctggacaaggagatcagcgagggctggagcgctgtggcccccagccggcccaccaccaccagcatcagccaggtgcagatgatcctgctgagccagcccccagagtag

SEQ ID NO: 32593 - DNA, 606 bp, Artificial Sequence; identical to SEQ ID NO: 32591
  Description of Artificial Sequence: Synthetic coding sequence

SEQ ID NO: 32594 - DNA, 1086 bp, Artificial Sequence
  Description of Artificial Sequence: Synthetic coding sequence
atgaagcagagcatgctgttcagcgccacctgggacagcagcctgaagaggagctgcaagagcaacatcttcccccaccccaagatcctggtgcccctggtgctgctgcggcagatgctgctggagctgacccggcggggccaggagcccctgagcgccctgctgcagtttggagtgacctacctggaggactacagcgctgagtacatcatccagcagggcggctggggcaccgtcttcagcctggagagcgaggaggaggagtacccaggcatcacagctgaggacagcaatgacatctacatcctgcccagcgacaacagcggccaggtgtccccacctgagagccccaccgtgaccacctcctggcagagcgagagcctgcctgtgtccctgagcgccagccagagctggcacacagagagcctgcctgtgtccctgggccctgagagctggcagcagatcgccatggaccctgaggaggtgaagagcctggacagcaatggagctggggagaagtctgagaacaacagcagcaacagcgacatcgtgcacgtggagaaggaggaggtgcctgagggcatggaggaggccgctgtggcctctgtggtgctgcctgcccgggagctgcaggaggccctgcctgaggccccagcccccctgctgccccacatcacagccaccagcctgctgggcacccgggagccagacacagaggtgatcaccgtggagaagagcagccctgccaccagcctgtttgtggagctggatgaggaggaggtgaaggccgccaccacagagcccacagaggtggaggaggtggtgcctgccctggagcccacagagaccctgctgtctgagaaggagatcaatgcccgggaggagagcctggtggaggagctgagccctgccagcgagaagaagcctgtgcccccatctgagggcaagagccggctgagccctgctggggagatgaagcccatgcccctgtctgagggcaagagcatcctgctgtttggaggagctgctgctgtggccatcctggccgtggccatcggcgtggccctggccctgaggaagaagtag

SEQ ID NO: 32595 - DNA, 972 bp, Artificial Sequence; identical to SEQ ID NO: 32590
  Description of Artificial Sequence: Synthetic coding sequence

SEQ ID NO: 32596 - DNA, 516 bp, Artificial Sequence
  Description of Artificial Sequence: Synthetic coding sequence
atggccagcagcagcacagtgcccctgggcttccactatgagaccaagtatgtggtgctgagctacctgggcctgctgagccaggagaagctgcaggagcagcacctgagcagcccccagggcgtgcagctggacatcgccagccagagcctggaccaggagatcctgctgaaggtgaagacagaaattgaggaggagctgaagagcctggacaaggagatcagcgaggccttcaccagcactggatttgacagacacaccagccctgtgttctccccagccaaccctgagagctccatggaggactgcctggcccacctgggggagaaggtgtcccaggagctgaaggagcccctgcacaaggccctgcagatgctgctgagccaggccctgtgcctggtgctgagccagaggagaagaaacaccctggagagcctgcagaagatcgccatgaccttcaccagctgcccagccaccaccctggacaagtctgtgccccagagcctgcagctgtag

SEQ ID NO: 32597 - DNA, 402 bp, Artificial Sequence
  Description of Artificial Sequence: Synthetic coding sequence
atggacaagtacatcctggacaacgggaaggtgcacctgggcagcggcatctgggtggatgaggagaagtggcaccagctgcaggtgacccagggcgacagcaagtacaccaagaacctggccgtgatgatctggggcacagatgtgctgaagaacagatctgtgactggagtggccaccaagaagaagaaggatgctgtgcccaagccacccctgagcccccacaagctgagcatcgtgcgggagtgcctgtatgaccgcatcgcccaggagaccgtggatgaaacagagatcgcccagaggctgagcaaggtgaacaagtacatctgtgagaagatcatggacatcaacaagagctgcaagaatgaggagcggcgggaggccaagtacaacctgcagtag

SEQ ID NO: 32598 - DNA, 1266 bp, Artificial Sequence
  Description of Artificial Sequence: Synthetic coding sequence
atgtatgcctttgtgcgcttcctggaggacaacgtgtgctacgccctgcctgtgtcctgtgtgcgggacttcagccccaggagccggctggactttgacaaccagaaggtgtatgctgtgtaccggggccctgaggagctgggcgccggccctgagagccccccccgggccccccgggactggggcgccctgctgctgcacaaggcccagatcctggccctggccgaggacaagagtgacctggagaacagcgtgatgcagaagaagatcaagatccccaagctgagcctgaaccacgtggaggaggatggagaggtgaaggactatggagaggaggacctgcagctgcggcacatcaagaggcctgagggcaggaagcccagcgaggtggcccacaagagcattgaagctgtggtggcccggctggagaagcagaatggcctgagcctgggccacagcacctgcccagaggaggtgtttgtggaggccagccctggaacagaggacatggacagcctggaggatgctgtggtgccccgggccctgtatgaggagctgctgaggaactaccagcagcagcaggaggagatgaggcacctgcagcaggagctggagaggacccggcggcagctggtgcagcaggccaagaagctgaaggagtatggagccctggtgtctgagatgaaggagctgcgggacctgaacagaaggctgcaggatgtgctgctgctgcggctgggcagcggccctgccatcgacctggagaaggtgaagtctgagtgcctggagcctgagcctgagctgcggagcaccttcagcgaggaggccaacaccagcagctactacccagccccagcccctgtgatggacaagtacatcctggacaacgggaaggtgcacctgggcagcggcatctgggtggatgaggagaagtggcaccagctgcaggtgacccagggcgacagcaagtacaccaagaacctggccgtgatgatctggggcacagatgtgctgaagaacagatctgtgactggagtggccaccaagaagaagaaggatgctgtgcccaagccacccctgagcccccacaagctgagcatcgtgcgggagtgcctgtatgaccgcatcgcccaggagaccgtggatgaaacagagatcgcccagaggctgagcaaggtgaacaagtacatctgtgagaagatcatggacatcaacaagagctgcaagaatgaggagcggcgggaggccaagtacaacctgcagtag

SEQ ID NO: 32599 - DNA, 399 bp, Artificial Sequence
  Description of Artificial Sequence: Synthetic coding sequence
atggccgaggagggcattgctgctgggggcgtgatggatgtgaacacagccctgcaggaggtgctgaagacagccctgattcatgatggcctggcccggggcatccgggaggccgccaaggccctggacaagaggcaggcccacctgtgtgtgctggccagcaactgtgatgagcccatgtatgtgaagctggtggaggccctgtgtgccgagcaccagatcaacctgatcaaggtggatgacaacaagaagctgggggagtgggtgggcctgtgcaagattgaccgggagggcaagcccaggaaggtggtgggctgcagctgtgtggtggtgaaggactatggcaaggagagccaggccaaggatgtgattgaggagtacttcaagtgcaagaagtag

SEQ ID NO: 32600 - DNA, 996 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgaatatgagcccatctaccggcaggacttccacttcaccctgcgggagcacagcaactgcagccaccagaaccccttcctggtgatcctggtgaccagccaccccagtgatgtgaaggcccggcaggccatccgggtgacctggggcgagaagaagtcctggtggggctatgaggtgctgaccttcttcctgctgggccaggaggccgagaaggaggacaagatgctggccctgagcctggaggatgagcacctgctgtatggagacatcatccggcaggacttcctggacacctacaacaacctgaccctgaagaccatcatggccttccgctgggtgacagagttctgccccaatgccaagtatgtgatgaagacagacacagatgtgttcatcaacacaggcaacctggtgaagtacctgctgaacctgaaccacagcgagaagttcttcaccggctaccccctgattgacaactacagctaccggggcttctaccagaagacccacatctcctaccaggagtaccccttcaaggtgtttcctccctactgcagcggcctgggctacatcatgagccgggacctggtgccccgcatctatgagatgatgggccacgtgaagcccatcaagtttgaagatgtgtatgtgggcatctgcctgaacctgctgaaggtgaacatccacatccctgaggacaccaacctcttcttcctgtaccgcatccacctggatgtgtgccagctgcggcgggtgattgctgcccacggcttcagcagcaaggagatcatcaccttctggcaggtgatgctgaggaacaccacctgccactactag

SEQ ID NO: 32601 - DNA, 996 bp, Artificial Sequence; identical to SEQ ID NO: 32600
  Description of Artificial Sequence: Synthetic coding sequence

SEQ ID NO: 32602 - DNA, 996 bp, Artificial Sequence; identical to SEQ ID NO: 32600
  Description of Artificial Sequence: Synthetic coding sequence

SEQ ID NO: 32603 - DNA, 996 bp, Artificial Sequence; identical to SEQ ID NO: 32600
  Description of Artificial Sequence: Synthetic coding sequence

SEQ ID NO: 32604 - DNA, 276 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgagatccacctggatgtgtgccagctgcggcgggtgattgctgcccacggcttcagcagcaaggagatcatcaccttctggcaggtgatgctgaggaacaccacctgccactactag

SEQ ID NO: 32605 - DNA, 336 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgaatatgagcccatctaccggcaggacttccacttcaccctgcgggagcacagcaactgcagccaccagaaccccttcctggtgatcctggtgaccagccaccccagtgatgtgaaggcccggcaggccatccgggtgacctggggcgagaagaagtcctggtggggctatgaatag

SEQ ID NO: 32606 - DNA, 177 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgaatatgagcccatctag

SEQ ID NO: 32607 - DNA, 996 bp, Artificial Sequence; identical to SEQ ID NO: 32600
  Description of Artificial Sequence: Synthetic coding sequence

SEQ ID NO: 32608 - DNA, 126 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactactag

SEQ ID NO: 32609 - DNA, 996 bp, Artificial Sequence; identical to SEQ ID NO: 32600
  Description of Artificial Sequence: Synthetic coding sequence

SEQ ID NO: 32610 - DNA, 198 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgaatatgagcccatctaccggcaggacttccacttctag

SEQ ID NO: 32611 - DNA, 90 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtcctag

SEQ ID NO: 32612 - DNA, 165 bp, Artificial Sequence
  Description of Artificial Sequence: Synthetic coding sequence
atggccagcgccctgtggacagtgctgcccagcaggatgagcctgcggagcctgaagtggagcctgctgctgctgagcctgctgtccttctttgtgatgtggtacctgagcctgccccactacaacgtcatcgagcgggtgaactggatgtacttctatgaatag

SEQ ID NO: 32613 - DNA, 981 bp, Artificial Sequence
  Description of Artificial Sequence: Synthetic coding sequence
atgaggaactggctggtgctgctgtgcccctgtgtgctgggcgccgccctgcacctgtggctgcggctgcggagccccccaccagcctgtgccagcggggccggccctgctggaggagtgtccctgctgctgccccggctggagtgcaatggagctgtgtctgcccaccccaacctgcacctgcccggcagccgggacagccctgccagcgccagccaggtggccggcatcacagaccagctggccctcttcccccagtggaagagcacccactatgatgtggtggtgggcgtgctgagcgccaggaacaaccacgagctgagaaatgtcatccgcagcacctggatgaggcacctgctgcagcaccccaccctgagccagagggtgctggtgaagttcatcattggagcccacggctgtgaggtgcctgtggaggaccgggaggacccctacagctgcaagctgctgaacatcaccaaccctgtgctgaaccaggagattgaggccttcagcctgtctgaggacaccagcagcggcctgcctgaggacagagtggtgtctgtgtccttccgggtgctgtaccccatcgtcatcaccagcctgggcgtcttctatgatgccaatgatgtgggcttccagaggaacatcaccgtgaagctgtaccaggccgagcaggaggaggccctcttcatcgcccgcttcagcccccccagctgtggggtgcaggtgaacaagctgtggtacaagcctgtggagcagttcatcctgcctgagagctttgagggcaccatcgtgtgggagagccaggacctgcacggcctggtgtccaggaacctgcacaaggtgacagtgaatgatggcggcggcgtgctgcgggtcatcacagctggggagggcgccctgccccatgagttcctggagggcgtggagggcgtggccggcggcttcatctacaccatccagggcaagtttgccagctag

SEQ ID NO: 32614 - DNA, 966 bp, Artificial Sequence
  Description of Artificial Sequence: Synthetic coding sequence
atgaggaactggctggtgctgctgtgcccctgtgtgctgggcgccgccctgcacctgtggctgcggctgcggagccccccaccagcctgtgccagcggggccggccctgctggaggagtgtccctgctgctgccccggctggagtgcaatggagctgtgtctgcccaccccaacctgcacctgcccggcagccgggacagccctgccagcgccagccaggtggccggcatcacagaccagctggccctcttcccccagtggaagagcacccactatgatgtggtggtgggcgtgctgagcgccaggaacaaccacgagctgagaaatgtcatccgcagcacctggatgaggcacctgctgcagcaccccaccctgagccagagggtgctggtgaagttcatcattggagcccacggctgtgaggtgcctgtggaggaccgggaggacccctacagctgcaagctgctgaacatcaccaaccctgtgctgaaccaggagattgaggccttcagcctgtctgaggacaccagcagcggcctgcctgaggacagagtggtgtctgtgtccttccgggtgctgtaccccatcgtcatcaccagcctgggcgtcttctatgatgccaatgatgtgggcttccagaggaacatcaccgtgaagctgtaccaggccgagcaggaggaggccctcttcatcgcccgcttcagcccccccagctgtggggtgcaggtgaacaagctgtggtacaagcctgtggagcagttcatcctgcctgagagctttgagggcaccatcgtgtgggagagccaggacctgcacggcctggtgtccaggaacctgcacaaggtgacagtgaatgatggcggcggcgtgctgcgggtcatcacagctggggagggcgccctgccccatgagttcctggagggcgtggagggcgtggccggcggcttcatctacaccatccagtag

SEQ ID NO: 32615 - DNA, 1503 bp, Artificial Sequence
  Description of Artificial Sequence: Synthetic coding sequence
atgaggaactggctggtgctgctgtgcccctgtgtgctgggcgccgccctgcacctgtggctgcggctgcggagccccccaccagcctgtgccagcggggccggccctgctgaccagctggccctcttcccccagtggaagagcacccactatgatgtggtggtgggcgtgctgagcgccaggaacaaccacgagctgagaaatgtcatccgcagcacctggatgaggcacctgctgcagcaccccaccctgagccagagggtgctggtgaagttcatcatcggggcccacggctgtgaggtgcctgtggaggaccgggaggacccctacagctgcaagctgctgaacatcaccaaccctgtgctgaaccaggagattgaggccttcagcctgtctgaggacaccagcagcggcctgcctgaagatagagtggtgtctgtgtccttccgggtgctgtaccccatcgtcatcaccagcctgggcgtcttctatgatgccaatgatgtgggcttccagaggaacatcaccgtgaagctgtaccaggccgagcaggaggaggccctcttcatcgcccgcttcagcccccccagctgtggggtgcaggtgaacaagctgtggtacaagcctgtggagcagttcatcctgcctgagagctttgagggcaccatcgtgtgggagagccaggacctgcacggcctggtgtccaggaacctgcacaaggtgacagtgaatgatggcggcggcgtgctgcgggtcatcacagctggggagggcgccctgccccatgagttcctggagggcgtggagggcgtggccggcggcttcatctacaccatccaggagggagatgccctgctgcacaacctgcacagccggccccagaggctgattgaccacatccggaacctgcacgaggaggatgccctgctgaaggaggagagcagcatctatgatgacatcgtgtttgtggatgtggtggacacctacagaaatgtgcctgccaagctgctgaacttctaccgctggacagtggagaccaccagcttcaacctgctgctgaagacagatgatgactgctacatcgacctggaggccgtgttcaaccgcatcgtgcagaagaacctggatggccccaacttctggtggggcaacttccggctgaactgggccgtggacagaacaggcaagtggcaggagctggagtaccccagccctgcctacccagcctttgcctgtggcagcggctacgtgatcagcaaggacatcgtgaagtggctggccagcaacagcggccgcctgaagacctaccagggagaagatgtgtccatgggcatctggatggccgccatcggccccaagcgctaccaggacagcctgtggctgtgtgagaagacctgtgagaccggcatgctgagcagcccccagtacagcccctgggagctgacagagctgtggaagctgaaggagcgctgtggggacccctgccgctgccaggccaggtag

SEQ ID NO: 32616 - DNA, 1602 bp, Artificial Sequence
  Description of Artificial Sequence: Synthetic coding sequence
atgtggctgggcagaagagccctgtgtgccctggtgctgctgctggcctgtgccagcctgggcctgctgtatgccagcaccagagatgcccctggcctgcggctgcccctggccccctgggccccaccccagagccccaggaggcctgagctgcctgacctggcccctgagcccaggtatgcccacatccctgtgcgcatcaaggagcaggtggtgggcctgctggcctggaacaactgcagctgtgagagcagcggcggcggcctgcccctgcccttccagaagcaggtgcgggccatcgacctgaccaaggcctttgatcctgctgagctgcgggccgccagcgccacccgggagcaggagttccaggccttcctgagccgcagccagagccctgctgaccagctgctgattgccccagccaacagccccctgcagtaccccctgcagggcgtggaggtgcagcccctgcggagcatcctggtgcccggcctgagcctgcaggccgccagcggccaggaggtgtaccaggtgaacctgacagccagcctgggcacctgggatgtggccggggaggtgactggagtgaccctgactggagagggccaggccgacctgaccctggtgtccccaggcctggaccagctgaaccggcagctgcagctggtgacctacagcagccgcagctaccagaccaacacagctgacacagtgcgcttcagcacagagggccatgaagctgccttcaccatccgcatccgccacccccccaacccccggctgtacccacctggcagcctgccccagggcgcccagtacaacatcagcgccctggtgaccatcgccaccaagaccttcctgcgctatgaccggctgcgggccctgatcaccagcatccgccgcttctaccccaccgtgacagtggtgattgctgatgacagcgacaagccagagcgggtgtctggcccctacgtggagcactacctgatgccctttgggaagggctggtttgctggcaggaacctggccgtgtcccaggtgaccaccaagtatgtgctgtgggtggatgatgactttgtgttcaccgcccggacccggctggagcggctggtggatgtgctggagaggacccccctggacctggtgggcggcgctgtgcgggagatcagcggctttgccaccacctaccggcagctgctgtctgtggagcccggggcccctggcctgggcaactgcctgcggcagaggcggggcttccaccacgagctggtgggcttccctggctgtgtggtgacagatggagtggtgaacttcttcctggccaggacagacaaggtgcgggaggtgggctttgacccccggctgagccgggtggcccacctggagttcttcctggatggcctgggcagcctgcgggtgggcagctgcagtgatgtggtggtggaccacgccagcaagctgaagctgccctggaccagcagagatgctggagctgagacctacgcccgctaccgctacccaggcagcctggatgagagccagatggccaagcaccggctgctcttcttcaagcaccggctgcagtgcatgaccagccagtag

SEQ ID NO: 32617 - DNA, 714 bp, Artificial Sequence
  Description of Artificial Sequence: Synthetic coding sequence
atgtggctgggcagaagagccctgtgtgccctggtgctgctgctggcctgtgccagcctgggcctgctgtatgccagcaccagagatgcccctggcctgcggctgcccctggccccctgggccccaccccagagccccaggaggcctgagctgcctgacctggcccctgagcccaggtatgcccacatccctgtgcgcatcaaggagcaggtggtgggcctgctggcctggaacaactgcagctgtgagagcagcggcggcggcctgcccctgcccttccagaagcaggtgcgggccatcgacctgaccaaggcctttgatcctgctgagctgcgggccgccagcgccacccgggagcaggagttccaggccttcctgagccgcagccagagccctgctgaccagctgctgattgccccagccaacagccccctgcagtaccccctgcagggcgtggaggtgcagcccctgcggagcatcctggtgcccggcctgagcctgcaggccgccagcggccaggaggtgtaccaggtgaacctgacagccagcctgggcacctgggatgtggccggggaggtgactggagtgaccctgactggagagggccaggccgacctgaccctggtgtccccaggcctggaccagctgaaccggcagctgcagctggtgacctacagcagccgcagctaccagaccaacacagctgacacctag

SEQ ID NO: 32618 - DNA, 363 bp, Artificial Sequence
  Description of Artificial Sequence: Synthetic coding sequence
atgtggctgggcagaagagccctgtgtgccctggtgctgctgctggcctgtgccagcctgggcctgctgtatgccagcaccagagatgcccctggcctgcggctgcccctggccccctgggccccaccccagagccccaggaggcctgagctgcctgacctggcccctgagcccaggtatgcccacatccctgtgcgcatcaaggagcaggtggtgggcctgctggcctggaacaactgcagctgtgagagcagcggcggcggcctgcccctgcccttccagaagcaggtgcgggccatcgacctgaccaaggcctttgatcctgctgagctgcgggccgccagcgccacccgggagcagtag

SEQ ID NO: 32619 - DNA, 1701 bp, Artificial Sequence
  Description of Artificial Sequence: Synthetic coding sequence
atgggcagcgctggcttctctgtgggcaagttccacgtggaggtggccagccggggcagagaatgtgtgtctggcaccccagaatgtggcaaccggctgggcagcgctggctttggagccctgtgcctggagctgcggggagctgaccctgcctggggcccctttgctgcccacggccgcagccggcggcagggcagccgcttcctgtggctgctgaagatcctggtgatcatcctggtgctgggcatcgtgggcttcatgtttggctccatgttcctgcaggccgtgttcagcagccccaagccagagctgcccagccctgcccctggggtgcagaagctgaagctgctgcctgaggagcggctgaggaacctcttctcctatgatggcatctggctgttccccaagaaccagtgcaagtgtgaggccaacaaggagcagggcggctacaacttccaggatgcctacggccagagcgacctgcctgctgtgaaggcccggcggcaggccgagtttgagcacttccagaggcgggagggcctgccccggcccctgcccctgctggtgcagcccaacctgcccttcggctaccctgtgcacggcgtggaggtgatgcccctgcacacagtgcccatccctggcctgcagtttgagggcccagatgcccctgtgtatgaggtgaccctgacagccagcctgggcaccctgaacaccctggctgatgtgcctgattctgtggtgcagggccggggccagaagcagctgatcatcagcaccagtgacaggaagctgctgaagttcatcctgcagcacgtgacctacaccagcacaggctaccagcaccagaaggtggacatcgtgtccctggagagccgcagctctgtggccaagtttcctgtgaccatccgccaccctgtgatccccaagctgtatgaccccggccctgagaggaagctgaggaacctggtgaccatcgccaccaagaccttcctgcggccccacaagctgatgatcatgctgcggagcatccgggagtactacccagacctgactgtgattgtggctgatgacagccagaagcccctggagatcaaggacaaccacgtggagtactacaccatgccctttgggaagggctggtttgctggcaggaacctggccatcagccaggtgaccaccaagtatgtgctgtgggtggatgatgacttcctgttcaatgaggagaccaagattgaggtgctggtggatgtgctggagaagacagagctggatgtggtgggcggctctgtgctgggcaatgtgttccagttcaagctgctgctggagcagagtgaaaatggagcctgcctgcacaagaggatgggcttcttccagcccctggatggcttccccagctgtgtggtgaccagcggcgtggtgaacttcttcctggcccacacagagcggctgcagagggtgggctttgacccccggctgcagagggtggcccacagcgagttcttcattgatggcctgggcaccctgctggtgggcagctgcccagaggtgatcatcggccaccagagccgcagccctgtggtggacagcgagctggccgccctggagaagacctacaacacctaccgcagcaacaccctgaccagggtgcagttcaagctggccctgcactacttcaagaaccacctgcagtgtgccgcctag

SEQ ID NO: 32620 - DNA, 1521 bp, Artificial Sequence
  Description of Artificial Sequence: Synthetic coding sequence
atgaccagcggcggcagccgcttcctgtggctgctgaagatcctggtgatcatcctggtgctgggcatcgtgggcttcatgtttggctccatgttcctgcaggccgtgttcagcagccccaagccagagctgcccagccctgcccctggggtgcagaagctgaagctgctgcctgaggagcggctgaggaacctcttctcctatgatggcatctggctgttccccaagaaccagtgcaagtgtgaggccaacaaggagcagggcggctacaacttccaggatgcctacggccagagcgacctgcctgctgtgaaggcccggcggcaggccgagtttgagcacttccagaggcgggagggcctgccccggcccctgcccctgctggtgcagcccaacctgcccttcggctaccctgtgcacggcgtggaggtgatgcccctgcacacagtgcccatccctggcctgcagtttgagggcccagatgcccctgtgtatgaggtgaccctgacagccagcctgggcaccctgaacaccctggctgatgtgcctgattctgtggtgcagggccggggccagaagcagctgatcatcagcaccagtgacaggaagctgctgaagttcatcctgcagcacgtgacctacaccagcacaggctaccagcaccagaaggtggacatcgtgtccctggagagccgcagctctgtggccaagtttcctgtgaccatccgccaccctgtgatccccaagctgtatgaccccggccctgagaggaagctgaggaacctggtgaccatcgccaccaagaccttcctgcggccccacaagctgatgatcatgctgcggagcatccgggagtactacccagacctgactgtgattgtggctgatgacagccagaagcccctggagatcaaggacaaccacgtggagtactacaccatgccctttgggaagggctggtttgctggcaggaacctggccatcagccaggtgaccaccaagtatgtgctgtgggtggatgatgacttcctgttcaatgaggagaccaagattgaggtgctggtggatgtgctggagaagacagagctggatgtggtgggcggctctgtgctgggcaatgtgttccagttcaagctgctgctggagcagagtgaaaatggagcctgcctgcacaagaggatgggcttcttccagcccctggatggcttccccagctgtgtggtgaccagcggcgtggtgaacttcttcctggcccacacagagcggctgcagagggtgggctttgacccccggctgcagagggtggcccacagcgagttcttcattgatggcctgggcaccctgctggtgggcagctgcccagaggtgatcatcggccaccagagccgcagccctgtggtggacagcgagctggccgccctggagaagacctacaacacctaccgcagcaacaccctgaccagggtgcagttcaagctggccctgcactacttcaagaaccacctgcagtgtgccgcctag

SEQ ID NO: 32621 - DNA, 1443 bp, Artificial Sequence
  Description of Artificial Sequence: Synthetic coding sequence
atgtttggctccatgttcctgcaggccgtgttcagcagccccaagccagagctgcccagccctgcccctggggtgcagaagctgaagctgctgcctgaggagcggctgaggaacctcttctcctatgatggcatctggctgttccccaagaaccagtgcaagtgtgaggccaacaaggagcagggcggctacaacttccaggatgcctacggccagagcgacctgcctgctgtgaaggcccggcggcaggccgagtttgagcacttccagaggcgggagggcctgccccggcccctgcccctgctggtgcagcccaacctgcccttcggctaccctgtgcacggcgtggaggtgatgcccctgcacacagtgcccatccctggcctgcagtttgagggcccagatgcccctgtgtatgaggtgaccctgacagccagcctgggcaccctgaacaccctggctgatgtgcctgattctgtggtgcagggccggggccagaagcagctgatcatcagcaccagtgacaggaagctgctgaagttcatcctgcagcacgtgacctacaccagcacaggctaccagcaccagaaggtggacatcgtgtccctggagagccgcagctctgtggccaagtttcctgtgaccatccgccaccctgtgatccccaagctgtatgaccccggccctgagaggaagctgaggaacctggtgaccatcgccaccaagaccttcctgcggccccacaagctgatgatcatgctgcggagcatccgggagtactacccagacctgactgtgattgtggctgatgacagccagaagcccctggagatcaaggacaaccacgtggagtactacaccatgccctttgggaagggctggtttgctggcaggaacctggccatcagccaggtgaccaccaagtatgtgctgtgggtggatgatgacttcctgttcaatgaggagaccaagattgaggtgctggtggatgtgctggagaagacagagctggatgtggtgggcggctctgtgctgggcaatgtgttccagttcaagctgctgctggagcagagtgaaaatggagcctgcctgcacaagaggatgggcttcttccagcccctggatggcttccccagctgtgtggtgaccagcggcgtggtgaacttcttcctggcccacacagagcggctgcagagggtgggctttgacccccggctgcagagggtggcccacagcgagttcttcattgatggcctgggcaccctgctggtgggcagctgcccagaggtgatcatcggccaccagagccgcagccctgtggtggacagcgagctggccgccctggagaagacctacaacacctaccgcagcaacaccctgaccagggtgcagttcaagctggccctgcactacttcaagaaccacctgcagtgtgccgcctag

SEQ ID NO: 32622 - DNA, 3120 bp, Artificial Sequence
  Description of Artificial Sequence: Synthetic coding sequence
atgccccggctgcctgtgaagaagatcaggaagcagatgaagctgctgctgctgctgctgctgctgagctgtgccgcctggctgacctacgtgcacctgggcctggtgcggcagggccgggccctgcggcagaggctgggctacggcagagatggagagaagctgaccagcgagacagatggccggggcgtgcacgccgcccccagcacccagagagctgaggacagcagcgagagccgggaggaggagcaggcccctgagggccgggacctggacatgctgtttcctgggggcgccggccgcctgcccctgaacttcacccaccagaccccaccctggagggaggagtacaagggccaggtgaacctgcacgtgtttgaggactggtgtggcggcgctgtgggccacctgcggaggaacctgcacttccccctcttcccccacaccaggaccaccgtgaagaagctggccgtgagccccaagtggaagaactacggcctgcgcatcttcggcttcatccacccagccagagatggagatgtgcagttctctgtggccagtgatgacaacagcgagttctggctgagcctggatgagagccctgctgctgcccagctggtggcctttgtgggcaagacaggcagcgagtggacagcccctggagagttcaccaagttcagcagccaggtgtccaagccccggcggctgatggccagccgccgctactactttgagctgctgcacaagcaggatgaccggggcagtgaccacgtggaggtgggctggagggccttcctgcccggcctgaagtttgaagtcatcagcagcgcccacatcagcctgtacacagatgagagcgccctgaagatggaccacgtggcccacgtgccccagagccctgccagccacgtgggcggccggcccccccaggaggagaccagcgctgacatgctgcggccagacccccgggacaccttcttcctgacccccaggatggagagcagcagcctggagaatgtgctggagccctgtgcctatgcccccacctacgtggtgaaggacttccccatcgcccgctaccagggcctgcagtttgtgtacctgagctttgtgtacccaaatgactacacccggctgacccacatggagacagacaacaagtgcttctaccgggagagccccctgtacctggagcgcttcggcttctacaagtacatgaagatggacaaggaggagggagatgaagatgaggaggatgaggtgcagaggcgggccttcctgttcctgaacccagatgacttcctggatgatgaagatgaaggagagctgctggacagcctggagcccacagaggccgccccacccaggagcggcccccagagccctgccccagctgccccagcccagcccggggccaccctggccccacccaccccaccccggcccagagatggcggcacccccaggcacagccgggccctgtcctgggccgcccgggccgcccggcccctgcccctcttcctgggccgggcccccccacccaggcctgctgtggagcagcccccacccaaggtgtatgtgaccagggtgcggcccggccagagggccagcccccgggccccagccccccgggccccctggccacccttccctggggtcttcctgcacccccggcccctgccccgggtgcagctgcgggccccacccaggcctccccggccccatggaagaagaactggaggcccccaggccacccagccccggcccccagcccgggcccaggccacccagggcggccgggagggccaggcccggaccctgggccctgctgcccccaccgtggacagcaacctgagcagcgaggcccggcctgtgaccagcttcctgagcctgagccaggtgtctggcccccagctgcccggggagggggaggaggaggaggagggggaggatgatggagcccctggagatgaagctgccagcgaggacagcgaggaggccgccggccctgccctgggccgctggagagaagatgccatcgactggcagaggaccttctctgtgggcgctgtggactttgagctgctgcggagtgactggaatgacctgcgctgcaatgtgtctggcaacctgcagctgcctgaggccgaggccgtggatgtgacagcccagtacatggagcggctgaatgcccggcatggaggccgctttgccctgctgcgcatcgtgaatgtggagaagaggcgggacagcgcccggggcagccgcttcctgctggagctggagctgcaggagcggggcggcggccgcctgcggctgtctgaatatgtgttcctgcggctgcccggggcccgggtgggagatgctgatggagagagccctgagcccgccccagctgcctctgtgcggccagatggccggcctgagctgtgccggcccctgcggctggcctggaggcaggatgtgatggtgcacttcatcgtgcctgtgaagaaccaggcccgctgggtggcccagttcctggccgacatggccgccctgcacgccaggactggagacagccgcttctctgtggtgctggtggactttgaaagtgaggacatggatgtggagcgggccctgcgggccgcccggctgccccgctaccagtacctgcggaggacaggcaactttgagaggtctgctggcctgcaggccggcgtggatgctgtggaggatgccagcagcatcgtgttcctgtgtgacctgcacatccacttcccccccaacatcctggatggcatcaggaagcactgtgtggagggccgcctggcctttgcccctgtggtgatgaggctgagctgtggcagcagcccccgggacccccacggctactgggaggtgaatggcttcggcctgtttggcatctacaagagtgactttgacagagtgggcggcatgaacacagaggagttccgggaccagtggggcggggaggactgggagctgctggacagagtgctgcaggccggcctggaggtggagcggctgcggctgaggaacttctaccaccactaccacagcaagaggggcatgtggagcgtgcgcagcaggaagggcagcaggactggagccagctag

SEQ ID NO: 32623 - DNA, 708 bp, Artificial Sequence
  Description of Artificial Sequence: Synthetic coding sequence
atggaccctgcccggcccctgggcctgagcatcctgctgctcttcctgacagaagctgccctgggagatgctgcccaggagcccactggaaataatgctgagatctgcctgctgcccctggactatggcccctgccgggccctgctgctgcgctactactatgaccgctacacccagagctgccggcagttcctgtatggaggctgtgagggcaatgccaacaacttctacacctgggaggcctgtgatgatgcctgctggagaattgagaaggtgcccaaggtgtgccgcctgcaggtgtctgtggatgaccagtgtgagggcagcacagagaagtacttcttcaacctgagctccatgacctgtgagaagttcttcagcggcggctgccacaggaacagaattgagaaccgcttcccagatgaggccacctgcatgggcttctgtgcccccaagaagatccccagcttctgctacagccccaaggatgagggcctgtgcagcgccaacgtgacccgctactacttcaacccccgctaccgcacctgtgatgccttcacctacacaggctgcggcggcaatgacaacaactttgtgtcccgggaggactgcaagagggcctgtgccaaggccctgaagaagaagaagaagatgcccaagctgcgctttgccagccgcatcaggaagatcaggaagaagcagttctag

SEQ ID NO: 32624 - DNA, 309 bp, Artificial Sequence
  Description of Artificial Sequence: Synthetic coding sequence
atggctgactgggcccgggcccagagccctggagctgtggaggagatcctggaccgggagaacaagaggatggctgacagcctggccagcaaggtgacccggctgaagagcctggccctggacatcgacagagatgctgaggaccagaaccgctacctggatggcatggtgcgggcccacggcgtgcgggtgtctgtgccctgccccagcaccacctgctgccgggcctgcagcgtgtccttcagcactggagctgggggctggagcaaccaccacttctgtgtgatcctgctgggcttcctgccctag

SEQ ID NO: 32625 - DNA, 336 bp, Artificial Sequence
  Description of Artificial Sequence: Synthetic coding sequence
atggctgactgggcccgggcccagagccctggagctgtggaggagatcctggaccgggagaacaagaggatggctgacagcctggccagcaaggtgacccggctgaagagcctggccctggacatcgacagagatgctgaggaccagaaccgctacctggatggcatggacagcgacttcacctccatgaccagcctgctgaccggctctgtgaagcgcttcagcaccatggcccggagcggccaggacaacaggaagctgctgtgtggcatggctgtgggcctcatcgtggccttcttcatcctgagctacttcctgagccgggcccggacctag

SEQ ID NO: 32626 - DNA, 3348 bp, Artificial Sequence
  Description of Artificial Sequence: Synthetic coding sequence
atgctgcggggcaccatgacagcctggaggggcatgaggcctgaggtgaccctggcctgcctgctgctggccacagctggctgctttgctgacctgaatgaggtgccccaggtgacagtgcagcctgccagcacagtgcagaagccaggcggcaccgtcatcctgggctgtgtggtggagccccccaggatgaatgtgacctggaggctgaatggcaaggagctgaatggaagtgatgatgccctgggcgtgctgatcacccacggcaccctggtgatcacagccctgaacaaccacacagtgggccgctaccagtgtgtggccaggatgcctgctggagctgtggcctctgtgcctgccaccgtgaccctggccaacctgcaggacttcaagctggatgtgcagcacgtgattgaggtggatgagggcaacacagctgtgattgcctgccacctgcctgagagccaccccaaggcccaggtgcgctacagcgtgaagcaggagtggctggaggccagccggggcaactacctgatcatgcccagcggcaacctgcagatcgtgaatgccagccaggaggatgagggcatgtacaagtgtgccgcctacaaccctgtgacccaggaggtgaagaccagcggcagcagtgaccggctgcgggtgcggcgcagcacagctgaggccgcccgcatcatctacccacctgaggcccagaccatcatcgtgaccaagggccagagcctcatcctggagtgtgtggccagcggcatccccccaccccgggtgacctgggccaaggatggcagctctgtgacaggctacaacaagacccgcttcctgctgagcaacctgctgattgacaccaccagcgaggaggacagcggcacctaccgctgcatggctgacaatggagtgggccagcccggggctgctgtgatcctgtacaacgtgcaggtgtttgagcccccagaggtgaccatggagctgagccagctggtgatcccctggggccagagcgccaagctgacctgtgaggtgcggggcaaccccccaccttctgtgctgtggctgagaaatgctgtgcccctcatcagcagccagaggctgcggctgagcagaagagccctgcgggtgctgtccatgggcccagaagatgaaggagtgtaccagtgcatggccgagaatgaggtgggcagcgcccatgctgtggtgcagctgcggaccagccggcccagcatcaccccccggctgtggcaggatgctgagctggccaccggcaccccacctgtgagccccagcaagctgggcaaccctgagcagatgctgcggggccagcctgccctgcccaggcctcccacctctgtgggccctgccagcccccagtgccctggagagaagggccagggcgccccagctgaggcccccatcatcctgagcagccccaggaccagcaagacagacagctatgagctggtgtggaggcccaggcatgagggcagcggccgggcccccatcctgtactacgtggtgaagcacaggaagcaggtgaccaacagcagtgatgactggaccatcagcggcatcccagccaaccagcaccggctgaccctgacccggctggaccccggcagcctgtatgaggtggagatggccgcctacaactgtgccggggagggccagacagccatggtgaccttcagaacaggccggcggcccaagccagagatcatggccagcaaggagcagcagatccagagagatgatcctggggccagcccccagagcagcagccagcctgaccacggccgcctgagccccccagaggccccagaccggcccaccatcagcacagccagcgagacctctgtgtatgtgacctggatccccagaggaaatggaggcttccccatccagagcttccgggtggagtacaagaagctgaagaaggtgggggactggatcctggccaccagcgccatcccccccagccggctgtctgtggagatcaccggcctggagaagggcaccagctacaagttccgggtgcgggccctgaacatgctgggggagagcgagcccagcgcccccagccggccctacgtggtgtctggctacagcggccgggtgtatgaaagacctgtggccggcccctacatcaccttcacagatgctgtgaatgagaccaccatcatgctgaagtggatgtacatcccagccagcaacaacaacacccccatccacggcttctacatctactaccggcccacagacagcgacaatgacagcgactacaagaaggacatggtggagggggacaagtactggcacagcatcagccacctgcagcctgagaccagctatgacatcaagatgcagtgcttcaatgaaggaggagagagcgagttcagcaatgtgatgatctgtgagaccaaggccaggaagagcagcggccagcccggccgcctgcccccacccaccctggccccaccccagccccccctgcctgagaccatcgagaggcctgtgggcaccggggccatggtggcccggagcagtgacctgccctacctgattgtgggcgtggtgctgggcagcatcgtgctgatcatcgtgaccttcatccccttctgcctgtggagggcctggagcaagcagaagcacaccacagacctgggcttccccaggtctgccctgccccccagctgcccctacaccatggtgcccctgggcggcctgcccggccaccaggccagcggccagccctacctgagcggcatcagcggccgggcctgtgccaacggcatccacatgaacagaggctgccccagcgctgctgtgggctacccaggcatgaagccccagcagcactgccctggagagctgcagcagcagagcgacaccagcagcctgctgcggcagacccacctgggcaatggctatgacccccagagccaccagatcacccggggccccaagagcagcccagatgagggcagcttcctgtacaccctgcctgatgacagcacccaccagctgctgcagccccaccacgactgctgccagaggcaggagcagcctgctgctgtgggccagagcggcgtgagaagagccccagacagccctgtgctggaggccgtgtgggacccccccttccacagcggccccccctgctgcctgggcctggtgcctgtggaggaggtggacagcccagacagctgccaggtgtctggaggagactggtgcccccagcaccctgtgggcgcctacgtgggccaggagcccggcatgcagctgagccctggccccctggtgcgggtgtcctttgagaccccacccctgaccatctag

SEQ ID NO: 32627 - DNA, 3345 bp, Artificial Sequence
  Description of Artificial Sequence: Synthetic coding sequence
atgctgcggggcaccatgacagcctggaggggcatgaggcctgaggtgaccctggcctgcctgctgctggccacagctggctgctttgctgacctgaatgaggtgccccaggtgacagtgcagcctgccagcacagtgcagaagccaggcggcaccgtcatcctgggctgtgtggtggagccccccaggatgaatgtgacctggaggctgaatggcaaggagctgaatggaagtgatgatgccctgggcgtgctgatcacccacggcaccctggtgatcacagccctgaacaaccacacagtgggccgctaccagtgtgtggccaggatgcctgctggagctgtggcctctgtgcctgccaccgtgaccctggccaacctgcaggacttcaagctggatgtgcagcacgtgattgaggtggatgagggcaacacagctgtgattgcctgccacctgcctgagagccaccccaaggcccaggtgcgctacagcgtgaagcaggagtggctggaggccagccggggcaactacctgatcatgcccagcggcaacctgcagatcgtgaatgccagccaggaggatgagggcatgtacaagtgtgccgcctacaaccctgtgacccaggaggtgaagaccagcggcagcagtgaccggctgcgggtgcggcgcagcacagctgaggccgcccgcatcatctacccacctgaggcccagaccatcatcgtgaccaagggccagagcctcatcctggagtgtgtggccagcggcatccccccaccccgggtgacctgggccaaggatggcagctctgtgacaggctacaacaagacccgcttcctgctgagcaacctgctgattgacaccaccagcgaggaggacagcggcacctaccgctgcatggctgacaatggagtgggccagcccggggctgctgtgatcctgtacaacgtgcaggtgtttgagcccccagaggtgaccatggagctgagccagctggtgatcccctggggccagagcgccaagctgacctgtgaggtgcggggcaaccccccaccttctgtgctgtggctgagaaatgctgtgcccctcatcagcagccagaggctgcggctgagcagaagagccctgcgggtgctgtccatgggcccagaagatgaaggagtgtaccagtgcatggccgagaatgaggtgggcagcgcccatgctgtggtgcagctgcggaccagccggcccagcatcaccccccggctgtggcaggatgctgagctggccaccggcaccccacctgtgagccccagcaagctgggcaaccctgagcagatgctgcggggccagcctgccctgcccaggcctcccacctctgtgggccctgccagcccccagtgccctggagagaagggccagggcgccccagctgaggcccccatcatcctgagcagccccaggaccagcaagacagacagctatgagctggtgtggaggcccaggcatgagggcagcggccgggcccccatcctgtactacgtggtgaagcacaggaaggtgaccaacagcagtgatgactggaccatcagcggcatcccagccaaccagcaccggctgaccctgacccggctggaccccggcagcctgtatgaggtggagatggccgcctacaactgtgccggggagggccagacagccatggtgaccttcagaactggaagaagacccaagccagagatcatggccagcaaggagcagcagatccagagagatgaccccggggccagcccccagagcagcagccagcctgaccacggccgcctgagccccccagaggccccagaccggcccaccatcagcacagccagcgagacctctgtgtatgtgacctggatccccagaggaaatggaggcttccccatccagagcttccgggtggagtacaagaagctgaagaaggtgggggactggatcctggccaccagcgccatcccccccagccggctgtctgtggagatcaccggcctggagaagggcaccagctacaagttccgggtgcgggccctgaacatgctgggggagagcgagcccagcgcccccagccggccctacgtggtgtctggctacagcggccgggtgtatgaaagacctgtggccggcccctacatcaccttcacagatgctgtgaatgagaccaccatcatgctgaagtggatgtacatcccagccagcaacaacaacacccccatccacggcttctacatctactaccggcccacagacagcgacaatgacagcgactacaagaaggacatggtggagggggacaagtactggcacagcatcagccacctgcagcctgagaccagctatgacatcaagatgcagtgcttcaatgaaggaggagagagcgagttcagcaatgtgatgatctgtgagaccaaggccaggaagagcagcggccagcccggccgcctgcccccacccaccctggccccaccccagccccccctgcctgagaccatcgagaggcctgtgggcactggagccatggtggcccggagcagtgacctgccctacctgattgtgggcgtggtgctgggcagcatcgtgctgatcatcgtgaccttcatccccttctgcctgtggagggcctggagcaagcagaagcacaccacagacctgggcttccccaggtctgccctgccccccagctgcccctacaccatggtgcccctgggcggcctgcccggccaccaggccagcggccagccctacctgagcggcatcagcggccgggcctgtgccaacggcatccacatgaacagaggctgccccagcgctgctgtgggctacccaggcatgaagccccagcagcactgccctggagagctgcagcagcagagcgacaccagcagcctgctgcggcagacccacctgggcaatggctatgacccccagagccaccagatcacccggggccccaagagcagcccagatgagggcagcttcctgtacaccctgcctgatgacagcacccaccagctgctgcagccccaccacgactgctgccagaggcaggagcagcctgctgctgtgggccagagcggcgtgcggcgggccccagacagccctgtgctggaggccgtgtgggacccccccttccacagcggccccccctgctgcctgggcctggtgcctgtggaggaggtggacagcccagacagctgccaggtgtctggaggagactggtgcccccagcaccctgtgggcgcctacgtgggccaggagcccggcatgcagctgagccctggccccctggtgcgggtgtcctttgagaccccacccctgaccatctag

SEQ ID NO: 32628 - DNA, 69 bp, Artificial Sequence
  Description of Artificial Sequence: Synthetic coding sequence
atgctgcggggcaccatgacagcctggaggggcatgaggcctgaggtgaccctggcctgcctgctgtag

SEQ ID NO: 32629 - DNA, 258 bp, Artificial Sequence
  Description of Artificial Sequence: Synthetic coding sequence
atgctgcggggcaccatgacagcctggaggggcatgaggcctgaggtgaccctggcctgcctgctgctggccacagctggctgctttgctgacctgaatgaggtgccccaggtgacagtgcagcctgccagcacagtgcagaagccaggcggcaccgtcatcctgggctgtgtggtggagccccccaggatgaatgtgacctggaggctgaatggcaaggagctgaatggaagtgatgatgccctgggcgtgctgtag

SEQ ID NO: 32630 - DNA, 474 bp, Artificial Sequence
  Description of Artificial Sequence: Synthetic coding sequence
atgctgcggggcaccatgacagcctggaggggcatgaggcctgaggtgaccctggcctgcctgctgctggccacagctggctgctttgctgacctgaatgaggtgccccaggtgacagtgcagcctgccagcacagtgcagaagccaggcggcaccgtcatcctgggctgtgtggtggagccccccaggatgaatgtgacctggaggctgaatggcaaggagctgaatggaagtgatgatgccctgggcgtgctgatcacccacggcaccctggtgatcacagccctgaacaaccacacagtgggccgctaccagtgtgtggccaggatgcctgctggagctgtggcctctgtgcctgccaccgtgaccctggccagcgagagcgcccccctgcccccctgccacggggctgtgcccccccacctgagccaccctgaggcccccaccatccacgccgccagctgctacagctag

SEQ ID NO: 32631 - DNA, 474 bp, Artificial Sequence; identical to SEQ ID NO: 32630
  Description of Artificial Sequence: Synthetic coding sequence

SEQ ID NO: 32632 - DNA, 99 bp, Artificial Sequence
  Description of Artificial Sequence: Synthetic coding sequence
atgctgcggggcaccatgacagcctggaggggcatgaggcctgaggtgaccctggcctgcctgctgctggccacagctggctgctttgctgacctgtag

SEQ ID NO: 32633 - DNA, 3345 bp, Artificial Sequence; identical to SEQ ID NO: 32627
  Description of Artificial Sequence: Synthetic coding sequence

SEQ ID NO: 32634 - DNA, 627 bp, Artificial Sequence
  Description of Artificial Sequence: Synthetic coding sequence
atgagatatgcctgcagcagcagcgaggactggcccccacccctggacatcagcagtgatggagatgtggatgccaccgtgctgcgggagctgtacccagacagccccccaggagtgtccctgagccggctgcgctggagcgccatgatgtacacaggcagcttcacctactgggtgcgctccatgctgagccgccacaagctggatgccatcctgggccgcctgggctacacagccaccctggagagcgagttcagcctggtgcaggccatcagcaaagaaaatgtgaagcagatggtgttcaagatcttcctggtgcgggtgtcctgtgaggccgtgctgaggacagctggcaccaggatgctggagcccggcacagagaagctggcccggacccacagccgccacagcagcgagaagaggctggtgaagccctgcagctgcctggagggcgtgcagcccggccctggcagcggcggcccccagcagggccccagcgagggcgtgggcagcgagacagccctggccgagggcacagctggccagaggagcctgcccatggccctgagccccagcgaggtgtccacagcccccaacagcctgcccagcggcagccctgtgctgtag

SEQ ID NO: 32635 - DNA, 753 bp, Artificial Sequence
  Description of Artificial Sequence: Synthetic coding sequence
gcccgctacaacagaaccagctacttctaccccaccttcagcgagagcagcgagcacagccacctgctggtgtcccctgtgctggtggccagcgctgtgattggagtggtgatcatcctgagctgcatcaccatcatcgtgggcagcatcagaagagaccggcaggcccggctgcagaggcaccgccaccgccaccaccgccaccaccaccaccaccaccaccacagaagaagaagacaccgggagtatgaacatggctacgtgtctgatgagcacacctacagccgcagcagcaggaggatgagatatgcctgcagcagcagcgaggactggcccccacccctggacatcagcagtgatggagatgtggatgccaccgtgctgcgggagctgtacccagacagccccccaggctatgaagaatgtgtgggccctggggccacccagctgtatgtgcccacagatgcccccccaccctacagcctgacagacagctgccccaccctggatggcaccagtgacagcggcagcggccacagccctggccgccaccagcaggagcagaggaccccagcccagggcggcctgcacacagtgtccatggacaccctgcccccctatgaagctgtgtgtggggccggccccccatctggcctgctgcccctgcccggccctgaccccggcccccggggcagccagggcagccccacccccacccgggccccagccagcggccctgagagaattgtgtag

SEQ ID NO: 32636 - DNA, 780 bp, Artificial Sequence
  Description of Artificial Sequence: Synthetic coding sequence
atgtccttcaagaggccctgccccctggcccgctacaacagaaccagctacttctaccccaccttcagcgagagcagcgagcacagccacctgctggtgtcccctgtgctggtggccagcgctgtgattggagtggtgatcatcctgagctgcatcaccatcatcgtgggcagcatccggcgggaccggcaggcccggctgcagaggcaccgccaccgccaccaccgccaccaccaccaccaccaccaccacagaagaagaagacaccgggagtatgagcacggctacgtgtctgatgagcacacctacagccgcagcagcaggaggatgagatatgcctgcagcagcagcgaggactggcccccacccctggacatcagcagtgatggagatgtggatgccaccgtgctgcgggagctgtacccagacagccccccaggctatgaggagtgtgtgggccctggggccacccagctgtatgtgcccacagatgcccccccaccctacagcctgacagacagctgccccaccctggatggcaccagtgacagcggcagcggccacagccctggccgccaccagcaggagcagaggaccccagcccagggcggcctgcacacagtgtccatggacaccctgcccccctatgaggccgtgtgtggggccggcccccccagcggcctgctgcccctgcccggccctgaccccggcccccggggcagccagggcagccccacccccacccgggccccagccagcggccctgagcgcatcgtgtag

SEQ ID NO: 32637 - DNA, 384 bp, Artificial Sequence
  Description of Artificial Sequence: Synthetic coding sequence
atgtctgctgctggggcccggggcctgcgggccacctaccaccggctgctggacaaggtggagctgatgctgcctgagaagctgcggcccctgtacaaccaccctgctggccccaggacagtgttcttctgggcccccatcatgaagtggggcctggtgtgtgccggcctggccgacatggcccggcctgctgagaagctgagcacagcccagagcgctgtgctgatggccaccggcttcatctggagccgctacagcctggtgatcatccccaagaactggagcctgtttgctgtgaacttctttgtgggcgccgccggggccagccagctgttccgcatctggagatacaaccaggagctgaaggccaaggcccacaagtag

SEQ ID NO: 32638 - DNA, 384 bp, Artificial Sequence; identical to SEQ ID NO: 32637
  Description of Artificial Sequence: Synthetic coding sequence

SEQ ID NO: 32639 - DNA, 318 bp, Artificial Sequence
  Description of Artificial Sequence: Synthetic coding sequence
atgtctgctgctggggcccggggcctgcgggccacctaccaccggctgctggacaaggtggagctgatgctgcctgagaagctgcggcccctgtacaaccaccctgctggccccaggacagtgttcttctgggcccccatcatgaagtggggcctggtgtgtgccggcctggccgacatggcccggcctgctgagaagctgagcacagcccagagcgctgtgctgatggccaccggcttcatctggagccgctacagcctggtgatcatccccaagaactggagcctgtttgctgtgaacttctttgtgggcgcctag

SEQ ID NO: 32640 - DNA, 330 bp, Artificial Sequence
  Description of Artificial Sequence: Synthetic coding sequence
atggccggggccctggtgaggaaggctgctgactatgtgcgcagcaaggacttccgggactacctgatgagcaagcacttctggggccctgtggccaactggggcctgcccatcgccgccatcaatgacatgaagaagagccctgagatcatcagcggccgcatgacctttgccctgtgctgctacagcctgaccttcatgagatttgcctacaaggtgcagcccaggaactggctgctgtttgcctgccacgccaccaatgaggtggcccagctgatccagggcggccgcctcatcaagcatgagatgaccaagacagccagcgcctag

SEQ ID NO: 32641 - DNA, 330 bp, Artificial Sequence
  Description of Artificial Sequence: Synthetic coding sequence
atggccggggccctggtgaggaaggctgctgactatgtgcgcagcaaggacttccgggactacctgatgagcacccacttctggggccctgtggccaactggggcctgcccatcgccgccatcaatgacatgaagaagagccctgagatcatcagcggccgcatgacctttgccctgtgctgctacagcctgaccttcatgagatttgcctacaaggtgcagcccaggaactggctgctgtttgcctgccacgccaccaatgaggtggcccagctgatccagggcggccgcctcatcaagcatgagatgaccaagacagccagcgcctag

SEQ ID NO: 32642 - DNA, 201 bp, Artificial Sequence
  Description of Artificial Sequence: Synthetic coding sequence
atgaagaagagccctgagatcatcagcggccgcatgacctttgccctgtgctgctacagcctgaccttcatgagatttgcctacaaggtgcagcccaggaactggctgctgtttgcctgccacgccaccaatgaggtggcccagctgatccagggcggccgcctcatcaagcatgagatgaccaagacagccagcgcctag

SEQ ID NO: 32643 - DNA, 642 bp, Artificial Sequence
  Description of Artificial Sequence: Synthetic coding sequence
atgccagatgagaacatcttcctgtttgtgcccaacctgattggctacgccagaattgtgtttgccatcatctccttctacttcatgccctgctgccccctgacagccagcagcttctacctgctgagcggcctgctggatgcctttgatggccatgctgcccgggccctgaaccagggcaccaggtttggagccatgctggacatgctgacagaccgctgcagcaccatgtgcctgctggtgaacctggccctgctgtacccaggggccaccctcttcttccagatctccatgagcctggatgtggccagccactggctgcacctgcacagctctgtggtgcggggcagcgagagccacaagatgattgacctgagcggcaaccctgtgctgcgcatctactacaccagcaggcctgccctcttcaccctgtgtgctggaaatgagctgttctactgcctgctgtacctgttccacttcagcgagggccccctggtgggctctgtgggcctcttcaggatgggcctgtgggtgacagcccccatcgccctgctgaagagcctcatcagcgtcatccacctgatcacagctgccaggaacatggccgccctggatgctgctgaccgggccaagaagaagtag

SEQ ID NO: 32644 - DNA, 1008 bp, Artificial Sequence
  Description of Artificial Sequence: Synthetic coding sequence
atgatcctggcctctgtgctgcggagcggccctgggggcggcctgcccctgcggcccctgctgggccctgccctggccctgcgggcccggagcaccagcgccacagacacccaccacgtggagatggcccgggagaggagcaagacagtgaccagcttctacaaccagagcgccattgatgctgctgctgagaagcccagcgtgcggctgacccccaccatgatgctgtatgccggccgcagccaggacggcagccacctgctgaagagcgcccgctacctgcagcaggagctgcctgtgcgcatcgcccaccgcatcaagggcttccgctgcctgcccttcatcatcggctgcaaccccaccatcctgcacgtgcatgagctgtacatccgggccttccagaagctgacagacttcccccccatcaaggaccaggctgatgaggcccagtactgccagctggtgcggcagctgctggatgaccacaaggatgtggtgaccctgctggccgagggcctgcgggagagcaggaagcacattgaagatgagaagctggtgcgctacttcctggacaagaccctgaccagccggctgggcatccgcatgctggccacccaccacctggccctgcacgaggacaagccagactttgtgggcatcatctgcacccggctgagccccaagaagatcatcgagaagtgggtggactttgcccggcggctgtgtgagcacaagtatggaaatgccccccgggtgcgcatcaatggacatgtggccgcccgcttccccttcatccccatgcccctggactacatcctgcctgagctgctgaagaatgccatgaggatcagtgacagaggaggcggcatcgcccacaaggacctggacagagtgatggactaccacttcaccacagctgaggccagcacccaggacccccgcatcagccccctgtttggccacctggacatgcacagcggggcccagagcggccccatgcacggctag

SEQ ID NO: 32645 - DNA, 1098 bp, Artificial Sequence
  Description of Artificial Sequence: Synthetic coding sequence
atgatcctggcctctgtgctgcggagcggccctgggggcggcctgcccctgcggcccctgctgggccctgccctggccctgcgggcccggagcaccagcgccacagacacccaccacgtggagatggcccgggagaggagcaagacagtgaccagcttctacaaccagagcgccattgatgctgctgctgagaagcccagcgtgcggctgacccccaccatgatgctgtatgccggccgcagccaggacggcagccacctgctgaagagcgcccgctacctgcagcaggagctgcctgtgcgcatcgcccaccgcatcaagggcttccgctgcctgcccttcatcatcggctgcaaccccaccatcctgcacgtgcatgagctgtacatccgggccttccagaagctgacagacttcccccccatcaaggaccaggctgatgaggcccagtactgccagctggtgcggcagctgctggatgaccacaaggatgtggtgaccctgctggccgagggcctgcgggagagcaggaagcacattgaagatgagaagctggtgcgctacttcctggacaagaccctgaccagccggctgggcatccgcatgctggccacccaccacctggccctgcacgaggacaagccagactttgtgggcatcatctgcacccggctgagccccaagaagatcatcgagaagtgggtggactttgcccggcggctgtgtgagcacaagtatggaaatgccccccgggtgcgcatcaatggacatgtggccgcccgcttccccttcatccccatgcccctggactacatcctgcctgagctgctgaagaatgccatgagggccaccatggagagccacctggacaccccctacaacgtgcctgatgtggtgatcaccatcgccaacaatgatgtggacctgatcatccgcatcagtgacagaggaggcggcatcgcccacaaggacctggacagagtgatggactaccacttcaccacagctgaggccagcacccaggacccccgcatcagccccctgtttggccacctggacatgcacagcggggcccagagcggccccatgcacggctag

SEQ ID NO: 32646 - DNA, 1239 bp, Artificial Sequence
  Description of Artificial Sequence: Synthetic coding sequence
atgatcctggcctctgtgctgcggagcggccctgggggcggcctgcccctgcggcccctgctgggccctgccctggccctgcgggcccggagcaccagcgccacagacacccaccacgtggagatggcccgggagaggagcaagacagtgaccagcttctacaaccagagcgccattgatgctgctgctgagaagcccagcgtgcggctgacccccaccatgatgctgtatgccggccgcagccaggacggcagccacctgctgaagagcgcccgctacctgcagcaggagctgcctgtgcgcatcgcccaccgcatcaagggcttccgctgcctgcccttcatcatcggctgcaaccccaccatcctgcacgtgcatgagctgtacatccgggccttccagaagctgacagacttcccccccatcaaggaccaggctgatgaggcccagtactgccagctggtgcggcagctgctggatgaccacaaggatgtggtgaccctgctggccgagggcctgcgggagagcaggaagcacattgaagatgagaagctggtgcgctacttcctggacaagaccctgaccagccggctgggcatccgcatgctggccacccaccacctggccctgcacgaggacaagccagactttgtgggcatcatctgcacccggctgagccccaagaagatcatcgagaagtgggtggactttgcccggcggctgtgtgagcacaagtatggaaatgccccccgggtgcgcatcaatggacatgtggccgcccgcttccccttcatccccatgcccctggactacatcctgcctgagctgctgaagaatgccatgagggccaccatggagagccacctggacaccccctacaacgtgcctgatgtggtgatcaccatcgccaacaatgatgtggacctgatcatccgcatcagtgacagaggaggcggcatcgcccacaaggacctggacagagtgatggactaccacttcaccacagctgaggccagcacccaggacccccgcatcagccccctgtttggccacctggacatgcacagcggggcccagagcggccccatgcacggcttcggcttcggcctgcccaccagccgggcctatgcagagtacctgggcggcagcctgcagctgcagagcctgcagggcatcggcacagatgtgtacctgcggctgcggcacattgatggccgggaggagagcttccgcatctag

SEQ ID NO: 32647 - DNA, 756 bp, Artificial Sequence
  Description of Artificial Sequence: Synthetic coding sequence
atgggcgcccgggccagcggcggccccctggcccgggccggcctgctgctgctgctgctgctgctgctgctgctgggcctgctggcccctggggcccagggcgcccggggccggggcggcgctgagaagaacagctacagaagaacagtgaacaccttcagccagagcgtgagcagcctgtttggagaagataatgtgcgggccgcccagaagttcctggcccggctgacagaaagatttgtgctgggcgtggacatgtttgtggagaccctgtggaaggtgtggacagagctgctggatgtgctgggcctggatgtgagcaacctgagccagtacttctccccagcctctgtgagcagcagccctgcccgggccctgctgctggtgggcgtggtgctgctggcctactggttcctgagcctgaccctgggcttcaccttctctgtgctgcacgtggtgtttggccgcttcttctggatcgtgcgggtggtgctcttctccatgagctgtgtgtacatcctgcacaagtatgaaggagagccagaaaatgctgtgctgcccctgtgctttgtggtggccgtgtacttcatgacaggccccatgggcttctactggaggagcagccccagcggccccagcaaccccagcaaccccagcgtggaggagaagctggagcacctggagaagcaggtgcggctgctgaacatccggctgaacagagtgctggagagcctggacaggagcaaggacaagtag

SEQ ID NO: 32648 - DNA, 1236 bp, Artificial Sequence
  Description of Artificial Sequence: Synthetic coding sequence
atgacccactggttccacaggaaccccctgaaggccacagcccctgtgtccttcaactactatggagtggtgacaggccccagcgccagcaagatctgcaatgacctgcggagcagccgggcccggctgctggagctgttcacagacctgagctgcaaccctgagatgatgaagaatgctgctgacagctacttcagcctgctgcagggcttcatcaacagcctggatgagagcacccaggagagcaagctgcgctacatccagaacttcaagtggacagacaccctgcagggccaggtgcccagcgcccagcaggatgctgtgtttgagctgatctccatgggcttcaacgtggccctgtggtacaccaagtatgccagccggctggccggcaaggagaacatcacagaagatgaggccaaggaggtgcacaggagcctgaagattgctgctggcatcttcaagcacctgaaggagagccacctgcccaagctgatcaccccagctgagaagggccgggacctggagagccgcctcatcgaggcctacgtgatccagtgccaggccgaggcccaggaggtgaccatcgcccgggccatcgagctgaagcacgcccctggcctgattgctgccctggcctatgaaacagccaacttctaccagaaggctgaccacaccctgagcagcctggagcccgcctacagcgccaagtggaggaagtacctgcacctgaagatgtgcttctacacagcctatgcctactgctaccatggagagaccctgctggccagtgacaagtgtggggaggccatccgcagcctgcaggaggccgagaagctgtatgccaaggccgaggccctgtgcaaggagtatggagagaccaagggccctggccccaccgtgaagcccagcggccacctgttcttcaggaagctgggcaacctggtgaagaacaccctggagaagtgccagcgggagaatggcttcatctacttccagaagatccccacagaggccccccagctggagctgaaggccaactacggcctggtggagcccatcccctttgagttcccccccacctctgtgcagtggaccccagagaccctggccgcctttgacctgaccaagaggcccaaggatgacagcaccaagcccaagccagaggaggaggtgaagcctgtgaaggagccagacatcaagccccagaaggacaccggctgctacatctcctag

SEQ ID NO: 32649 - DNA, 648 bp, Artificial Sequence
  Description of Artificial Sequence: Synthetic coding sequence
atgacccactggttccacaggaaccccctgaaggccacagcccctgtgtccttcaactactatggagtggtgacaggccccagcgccagcaagatctgcaatgacctgcggagcagccgggcccggctgctggagctgttcacagacctgagctgcaaccctgagatgatgaagaatgctgctgacagctacttcagcctgctgcagggcttcatcaacagcctggatgagagcacccaggagagcaagctgcgctacatccagaacttcaagtggacagacaccctgcagggccaggtgcccagcgcccagcaggatgctgtgtttgagctgatctccatgggcttcaacgtggccctgtggtacaccaagtatgccagccggctggccggcaaggagaacatcacagaagatgaggccaaggaggtgcacaggagcctgaagattgctgctggcatcttcaagcacctgaaggagagccacctgcccaagctgatcaccccagctgagaagggccgggacctggagagccgcctcatcgaggcctacgtgatccagtgccaggccgaggcccaggaggtgaccatcgcccgggccatcgagctgaagcacgcccctggcctgattgctgccctggcctatgaatag

SEQ ID NO: 32650 - DNA, 1017 bp, Artificial Sequence
  Description of Artificial Sequence: Synthetic coding sequence
atgacccactggttccacaggaaccccctgaaggccacagcccctgtgtccttcaactactatggagtggtgacaggccccagcgccagcaagatctgcaatgacctgcggagcagccgggcccggctgctggagctgttcacagacctgagctgcaaccctgagatgatgaagaatgctgctgacagctacttcagcctgctgcagggcttcatcaacagcctggatgagagcacccaggagagcaagctgcgctacatccagaacttcaagtggacagacaccctgcagggccaggtgcccagcgcccagcaggatgctgtgtttgagctgatctccatgggcttcaacgtggccctgtggtacaccaagtatgccagccggctggccggcaaggagaacatcacagaagatgaggccaaggaggtgcacaggagcctgaagattgctgctggcatcttcaagcacctgaaggagagccacctgcccaagctgatcaccccagctgagaagggccgggacctggagagccgcctcatcgaggcctacgtgatccagtgccaggccgaggcccaggaggtgaccatcgcccgggccatcgagctgaagcacgcccctggcctgattgctgccctggcctatgaaacagccaacttctaccagaaggctgaccacaccctgagcagcctggagcccgcctacagcgccaagtggaggaagtacctgcacctgaagatgtgcttctacacagcctatgcctactgctaccatggagagaccctgctggccagtgacaagtgtggggaggccatccgcagcctgcaggaggccgagaagctgtatgccaaggccgaggccctgtgcaaggagtatggagagaccaagggccctggccccaccgtgaagcccagcggccacctgttcttcaggaagctgggcaacctggtgaagaacaccctggagaagtgccagcgggagaatggcttcatcctgaaccccaaccagaagaagaagtag

SEQ ID NO: 32651 - DNA, 1140 bp, Artificial Sequence
  Description of Artificial Sequence: Synthetic coding sequence
atgacccactggttccacaggaaccccctgaaggccacagcccctgtgtccttcaactactatggagtggtgacaggccccagcgccagcaagatctgcaatgacctgcggagcagccgggcccggctgctggagctgttcacagacctgagctgcaaccctgagatgatgaagaatgctgctgacagctacttcagcctgctgcagggcttcatcaacagcctggatgagagcacccaggagagcaagctgcgctacatccagaacttcaagtggacagacaccctgcagggccaggtgcccagcatcacagaagatgaggccaaggaggtgcacaggagcctgaagattgctgctggcatcttcaagcacctgaaggagagccacctgcccaagctgatcaccccagctgagaagggccgggacctggagagccgcctcatcgaggcctacgtgatccagtgccaggccgaggcccaggaggtgaccatcgcccgggccatcgagctgaagcacgcccctggcctgattgctgccctggcctatgaaacagccaacttctaccagaaggctgaccacaccctgagcagcctggagcccgcctacagcgccaagtggaggaagtacctgcacctgaagatgtgcttctacacagcctatgcctactgctaccatggagagaccctgctggccagtgacaagtgtggggaggccatccgcagcctgcaggaggccgagaagctgtatgccaaggccgaggccctgtgcaaggagtatggagagaccaagggccctggccccaccgtgaagcccagcggccacctgttcttcaggaagctgggcaacctggtgaagaacaccctggagaagtgccagcgggagaatggcttcatctacttccagaagatccccacagaggccccccagctggagctgaaggccaactacggcctggtggagcccatcccctttgagttcccccccacctctgtgcagtggaccccagagaccctggccgcctttgacctgaccaagaggcccaaggatgacagcaccaagcccaagccagaggaggaggtgaagcctgtgaaggagccagacatcaagccccagaaggacaccggctgctacatctcctag

SEQ ID NO: 32652 - DNA, 309 bp, Artificial Sequence
  Description of Artificial Sequence: Synthetic coding sequence
atgagcagccccccagagggcaagctggagaccaaggccggccaccccccagctgtgaaggccggcggcatgagaattgtgcagaagcacccccacactggagacaccaaggaggagaaggacaaggatgaccaggagtgggagagccccagcccccccaagcccaccgtcttcatcagcggcgtgattgcccggggggacaaggacttccccccagctgctgcccaggtggcccaccagaagccccacgcctccatggacaagcaccccagccccaggacccagcacatccagcagcccaggaagtag

SEQ ID NO: 32653 - DNA, 2274 bp, Artificial Sequence
  Description of Artificial Sequence: Synthetic coding sequence
ctggccaagaagatcaccctgaagaagaagctggaggaggaggaggccgaggtgaagaggaaggccacagatgctgcctaccaggcccggcaggccgtgaagaccccaccccggcggctgcccaccgtgatggtgcgcagccccattgattctgccagccctggaggagactaccccctgggggacctgacccccaccaccatggaggaggccaccagcggcgtgaccccaggcaccctgcccagcacccctgtgaccagcttccctggcatcccagacaccctgcccccaggcagcgcccccctggaggcccccatgacccctgtgacagatgacagcccccagaagaagatgctgggccagaaggccaccccaccacccagccccctgctgtctgagctgctgaagaagggcagcctgctgcccaccagcccccggctggtgaatgaaagtgagatggctgtggccagcggccacctgaacagcactggagtgctgctggaggtgggcggcgtgctgcccatgattcatggaggagagatccagcagacccccaacacagtggccgccagccctgctgccagcgagagcgtgtcccaggccaccatcgtgatgatgcctgccctgcctgcccccagcagcgccccagctgtgtccaccacagaatctgtggcccctgtgtcccagcctgacaactgtgtgcccatggaggccgtgggggacccccacacagtgacagtgtccatggacagcagcgagatctccatgatcatcaacagcatcaaggaggagtgcttccgcagcggcgtggccgaggcccctgtgggcagcaaggcccccagcattgatggcaaggaggagctggacctggccgagaagatggacattgctgtgtcctacacaggagaggagctggactttgaaacagtgggggacatcatcgccatcatcgaggacaaggtggatgaccaccctgaggtgctggatgtggccgctgtggaggccgccctgtccttctgtgaggagaatgatgacccccagagcctgcccggcccctgggagcaccccatccagcaggagcgggacaagcctgtgcccctgcctgcccctgagatgacagtgaagcaggagcggctggactttgaggagacagaaaataaaggcatccacgagctggtggacatccgggagcccagcgctgagatcaaggtggagcctgctgagcctgagcctgtgatcagcggggctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgagccccctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggatggcggcacccggggcagaagatgtgccattgaagctgacatgaagatgaagaagtag

SEQ ID NO: 32654 - DNA, 3708 bp, Artificial Sequence
  Description of Artificial Sequence: Synthetic coding sequence
atggccactggaacaggcaagcacaagctgctgagcacaggccccacagagccctggagcatccgggagaagctgtgcctggccagctctgtgatgaggtctggggaccagaactgggtgtctgtgtcccgggccatcaagccctttgctgagcccggccggcccccagactggttcagccagaagcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctaccgccgcctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccattgattctgccagccctggaggagactaccccctgggggacctgacccccaccaccatggaggaggccaccagcggcgtgaatgaaagtgagatggctgtggccagcggccacctgaacagcactggagtgctgctggaggtgggcggcgtgctgcccatgatccacggcggggagatccagcagacccccaacacagtggccgccagccctgctgccagcggggcccccaccctgagccggctgctggaggccggccccacccagttcaccacccccctggccagcttcaccaccgtggccagcgagccccctgtgaagctggtgcccccacctgtggagagcgtgtcccaggccaccatcgtgatgatgcctgccctgcctgcccccagcagcgccccagctgtgtccaccacagaatctgtggcccctgtgtcccagcctgacaactgtgtgcccatggaggccgtgggggacccccacacagtgacagtgtccatggacagcagcgagatctccatgatcatcaacagcatcaaggaggagtgcttccgcagcggcgtggccgaggcccctgtgggcagcaaggcccccagcattgatggcaaggaggagctggacctggccgagaagatggacattgctgtgtcctacacaggagaggagctggactttgaaacagtgggggacatcatcgccatcatcgaggacaaggtggatgaccaccctgaggtgctggatgtggccgctgtggaggccgccctgtccttctgtgaggagaatgatgacccccagagcctgcccggcccctgggagcaccccatccagcaggagcgggacaagcctgtgcccctgcctgcccctgagatgacagtgaagcaggagcggctggactttgaggagacagaaaataaaggcatccacgagctggtggacatccgggagcccagcgctgagatcaaggtggagcctgctgagcctgagcctgtgatcagcggggctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgagccccctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggacagcgtgcccatgggcagccctgccttcctgctgagcctcttcatgggccacgagtgggtgtggctggacagcgagcaggaccaccccaatgattctgagctgagcaatgactgccgcagcctcttcagctcctgggacagcagcctggacctggatgtgggcaactggagggagacagaagatcctgaggccgaggagctggaggagagcagccctgagcgggagcccagcgagctgctggtgggagatggcggcagcgaggagagccaggaggccgccaggaaggccagccaccagaacctgctgcacttcctgtctgaggtggcctacctgatggagcccctgtgcatcagcagcaatgaaagcagcgagggctgctgccccccatctggcacccggcaggagggccgggagatcaaggccagcgagggggagcgggagctgtgccgggagacagaggagctgagcgccaagggggaccccctggtggccgagaagcccctgggagaaaatggcaagccagaggtggccagcgcccccagcgtcatctgcaccgtgcagggcctgctgacagagagcgaggagggggaggcccagcaggagagcaagggggaggaccagggcgaggtgtatgtgtctgagatggaggaccagccccccagcggggagtgtgatgatgccttcaacatcaaggagacccccctggtggacaccctcttcagccacgccaccagcagcaagctgacagacctgagccaggatgatcctgtgcaggaccacctgctcttcaagaagaccctgctgcctgtgtggaagatgattgccagccaccgcttcagcagccccttcctgaagcctgtgtctgagcggcaggcccctggctacaaggatgtggtgaagaggcccatggacctgaccagcctgaagaggaacctgagcaagggccgcatccgcaccatggcccagttcctgcgggacctgatgctgatgttccagaatgctgtgatgtacaatgacagcgaccaccacgtgtaccacatggctgtggagatgaggcaggaggtgctggagcagatccaggtgctgaacatctggctggacaagaggaagggcagcagcagcctggagggggagcccgccaaccctgtggatgatggcaagcctgtgttctag

SEQ ID NO: 32655 - DNA, 2601 bp, Artificial Sequence
  Description of Artificial Sequence: Synthetic coding sequence
atggccactggaacaggcaagcacaagctgctgagcacaggccccacagagccctggagcatccgggagaagctgtgcctggccagctctgtgatgaggtctggggaccagaactgggtgtctgtgtcccgggccatcaagccctttgctgagcccggccggcccccagactggttcagccagaagcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctaccgccgcctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccattgattctgccagccctggaggagactaccccctgggggacctgacccccaccaccatggaggaggccaccagcggcgtgaccccaggcaccctgcccagcacccctgtgaccagcttccctggcatcccagacaccctgcccccaggcagcgcccccctggaggcccccatgacccctgtgacagatgacagcccccagaagaagatgctgggccagaaggccaccccaccacccagccccctgctgtctgagctgctgaagaagggcagcctgctgcccaccagcccccggctggtgaatgaaagtgagatggctgtggccagcggccacctgaacagcactggagtgctgctggaggtgggcggcgtgctgcccatgattcatggaggagagatccagcagacccccaacacagtggccgccagccctgctgcctctgtgtcccagcctgacaactgtgtgcccatggaggccgtgggggacccccacacagtgacagtgtccatggacagcagcgagatctccatgatcatcaacagcatcaaggaggagtgcttccgctctggagtggccgaggcccctgtgggcagcaaggcccccagcattgatggcaaggaggagctggacctggccgagaagatggacattgctgtgtcctacaccggggaggagctggactttgagaccgtgggggacatcatcgccatcatcgaggacaaggtggatgaccaccctgaggtgctggatgtggccgctgtggaggccgccctgtccttctgtgaagaaaatgatgacccccagagcctgcccggcccctgggagcaccccatccagcaggagcgggacaagcctgtgcccctgcctgcccctgagatgacagtgaagcaggagcggctggactttgaggagacagagaacaagggcatccacgagctggtggacatccgggagcccagcgctgagatcaaggtggagcctgctgagcctgagcccgtcatctctggagctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgaacctcctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggatggcggcacccggggccgccgctgtgccatcgaggccgacatgaagatgaagaagtag

SEQ ID NO: 32656 - DNA, 2586 bp, Artificial Sequence
  Description of Artificial Sequence: Synthetic coding sequence
gggaagcacaagctgctgagcacaggccccacagagccctggagcatccgggagaagctgtgcctggccagctctgtgatgaggtctggggaccagaactgggtgtctgtgtcccgggccatcaagccctttgctgagcccggccggcccccagactggttcagccagaagcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctacagaaggctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccatcgacagcgccagccctggaggagactaccccctgggggacctgacccccaccaccatggaggaggccaccagcggcgtgaccccaggcaccctgcccagcacccctgtgaccagcttccctggcatcccagacaccctgcccccaggcagcgcccccctggaggcccccatgacccctgtgacagatgacagcccccagaagaagatgctgggccagaaggccaccccaccacccagccccctgctgtctgagctgctgaagaagggcagcctgctgcccaccagcccccggctggtgaatgaaagtgagatggctgtggccagcggccacctgaacagcactggagtgctgctggaggtgggcggcgtgctgcccatgatccacggcggggagatccagcagacccccaacacagtggccgccagccctgctgcctctgtgtcccagcctgacaactgtgtgcccatggaggccgtgggggacccccacacagtgacagtgtccatggacagcagcgagatctccatgatcatcaacagcatcaaggaggagtgcttccgcagcggcgtggccgaggcccctgtgggcagcaaggcccccagcattgatggcaaggaggagctggacctggccgagaagatggacattgctgtgtcctacacaggagaggagctggactttgaaacagtgggggacatcatcgccatcatcgaggacaaggtggatgaccaccctgaggtgctggatgtggccgctgtggaggccgccctgtccttctgtgaggagaatgatgacccccagagcctgcccggcccctgggagcaccccatccagcaggagcgggacaagcctgtgcccctgcctgcccctgagatgacagtgaagcaggagcggctggactttgaggagacagaaaataaaggcatccacgagctggtggacatccgggagcccagcgctgagatcaaggtggagcctgctgagcctgagcctgtgatcagcggggctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgagccccctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggatggcggcacccggggcagaagatgtgccattgaagctgacatgaagatgaagaagtag

SEQ ID NO: 32657 - DNA, 2679 bp, Artificial Sequence
  Description of Artificial Sequence: Synthetic coding sequence
gggaagcacaagctgctgagcacaggccccacagagccctggagcatccgggagaagctgtgcctggccagctctgtgatgaggtctggggaccagaactgggtgtctgtgtcccgggccatcaagccctttgctgagcccggccggcccccagactggttcagccagaagcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctacagaaggctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccatcgacagcgccagccctggaggagactaccccctgggggacctgacccccaccaccatggaggaggccaccagcggcgtgaccccaggcaccctgcccagcacccctgtgaccagcttccctggcatcccagacaccctgcccccaggcagcgcccccctggaggcccccatgacccctgtgacagatgacagcccccagaagaagatgctgggccagaaggccaccccaccacccagccccctgctgtctgagctgctgaagaagggcagcctgctgcccaccagcccccggctggtgaatgaaagtgagatggctgtggccagcggccacctgaacagcactggagtgctgctggaggtgggcggcgtgctgcccatgatccacggcggggagatccagcagacccccaacacagtggccgccagccctgctgccagcgagagcgtgtcccaggccaccatcgtgatgatgcctgccctgcctgcccccagcagcgccccagctgtgtccaccacagagagcgtggcccctgtgtcccagcctgacaactgtgtgcccatggaggccgtgggggacccccacacagtgacagtgtccatggacagcagcgagatctccatgatcatcaacagcatcaaggaggagtgcttccgctctggagtggccgaggcccctgtgggcagcaaggcccccagcattgatggcaaggaggagctggacctggccgagaagatggacattgctgtgtcctacaccggggaggagctggactttgagaccgtgggggacatcatcgccatcatcgaggacaaggtggatgaccaccctgaggtgctggatgtggccgctgtggaggccgccctgtccttctgtgaagaaaatgatgacccccagagcctgcccggcccctgggagcaccccatccagcaggagcgggacaagcctgtgcccctgcctgcccctgagatgacagtgaagcaggagcggctggactttgaggagacagagaacaagggcatccacgagctggtggacatccgggagcccagcgctgagatcaaggtggagcctgctgagcctgagcccgtcatctctggagctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgaacctcctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggatggcggcacccggggccgccgctgtgccatcgaggccgacatgaagatgaagaagtag

SEQ ID NO: 32658 - DNA, 2514 bp, Artificial Sequence
  Description of Artificial Sequence: Synthetic coding sequence
atggtgcacccccgggaggccatgttcagcatcttctgccacgagaagtggaggagcaagctgcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctacagaaggctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccatcgacagcgccagccctggaggagactaccccctgggggacctgacccccaccaccatggaggaggccaccagcggcgtgaatgaaagtgagatggctgtggccagcggccacctgaacagcactggagtgctgctggaggtgggcggcgtgctgcccatgattcatggaggagagatccagcagacccccaacacagtggccgccagccctgctgccagcggggcccccaccctgagccggctgctggaggccggccccacccagttcaccacccccctggccagcttcaccaccgtggccagcgagccccctgtgaagctggtgcccccacctgtggagagcgtgtcccaggccaccatcgtgatgatgcctgccctgcctgcccccagcagcgccccagctgtgtccaccacagagagcgtggcccctgtgtcccagcctgacaactgtgtgcccatggaggccgtgggggacccccacacagtgacagtgtccatggacagcagcgagatctccatgatcatcaacagcatcaaggaggagtgcttccgctctggagtggccgaggcccctgtgggcagcaaggcccccagcattgatggcaaggaggagctggacctggccgagaagatggacattgctgtgtcctacaccggggaggagctggactttgagaccgtgggggacatcatcgccatcatcgaggacaaggtggatgaccaccctgaggtgctggatgtggccgctgtggaggccgccctgtccttctgtgaagaaaatgatgacccccagagcctgcccggcccctgggagcaccccatccagcaggagcgggacaagcctgtgcccctgcctgcccctgagatgacagtgaagcaggagcggctggactttgaggagacagagaacaagggcatccacgagctggtggacatccgggagcccagcgctgagatcaaggtggagcctgctgagcctgagcccgtcatctctggagctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgaacctcctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggacagcgtgcccatgggcagccctgccttcctgctgagcctgtttgatggcggcacccggggcagaagatgtgccattgaagctgacatgaagatgaagaagtag

SEQ ID NO: 32659 - DNA, 3315 bp, Artificial Sequence
  Description of Artificial Sequence: Synthetic coding sequence
atggcccggcggggcaagaagcctgtggtgaggaccctggaggacctgaccctggacagcggctacggcggcgctgctgacagcgtgcgcagcagcaacctgagcctgtgctgcagcgacagccacccagccagcccctatggaggcagctgctggccacccctggccgacagcatgcacagccgccacaacagctttgacacagtgaacacagccctggtggaggacagcgagggcctggactgtgccggccagcactgcagccggctgctgcctgacctggatgaggtgccctggaccctgcaggagctggaggccctgctgctgcggagccgggacccccgggccggccctgctgtgcctgggggcctgcccaaggatgccctggccaagctgagcaccctggtgtcccgggccctggtgagaattgccaaggaggcccagaggctgagcctgcgctttgccaagtgcaccaagtatgagatccagagcgccatggagatcgtgctgtcctggggcctggccgcccactgcacagctgctgccctggccgccctgagcctgtacaacatgagcagcgctggaggagaccggctgggccggggcaagagcgcccgctgtggcctgaccttctctgtgggccgggtgtaccgctggatggtggacagccgggtggccctgcgcatccacgagcacgccgccatctacctgacagcctgcatggagagcctcttccgggacatctacagccgggtggtggccagcggcgtgcccaggagctgcagcggccctggcagcggcagcggcagcggccctggccccagcagcggccctggggccgccccagctgctgacaaggagcgggaggcccctgggggcggggccgccagcggcggggcctgcagcgctgccagcagcgccagcggcggcagcagctgctgtgcccccccagctgctgctgctgctgctgtgcccccagctgctgctgccaaccaccaccaccaccaccaccacgccctgcacgaggcccccaagttcaccgtggagaccctggagcacacagtgaacaatgattctgagatctggggcctgctgcagccctaccagcacctgatctgtgggaagaatgccagcggcgtgctgtgcctgcctgacagcctgaacctgcaccgggacccccagaggagcaacaagccaggagagctgcccatgttcagccagagcgagctgcggaccatcgagcagagcctgctggccaccagggtgggcagcattgctgagctgagtgacctggtgtcccgggccatgcaccacctgcagcccctgaatgccaagcaccacggcaatggcacccccctgcaccacaagcagggcgccctgtactgggagcctgaggccctgtacaccctgtgctacttcatgcactgcccccagatggagtgggagaaccccaacgtggagcccagcaaggtgaacctgcaggtggagcggcccttcctggtgctgccccccctgatggagtggatccgggtggccgtggcccacgccggccacagaagaagcttctccatggacagtgatgatgtgcggcaggccgcccggctgctgctgcccggggtggactgtgagccccggcagctgcgggcagatgactgcttctgtgccagcaggaagctggatgctgtggccatcgaggccaagttcaagcaggacctgggcttcaggatgctgaactgtggccgcacagacctggtgaagcaggccgtgtccctgctgggcccagatggcatcaacaccatgtctgagcagggcatgacccccctgatgtatgcctgtgtgagaggagatgaggccatggtgcagatgctgctggatgctggagctgacctgaatgtggaggtggtgtccaccccccacaagtaccccagcgtgcaccctgagaccaggcactggacagccctgacctttgctgtgctgcacggccacatccctgtggtgcagctgctgctggatgctggggccaaggtggagggctctgtggagcacggggaggagaactacagcgagacccccctgcagctggccgctgctgtgggcaactttgagctggtgtccctgctgctggagagaggagctgaccccctcatcggcaccatgtacagaaatggcatcagcaccaccccccagggcgacatgaacagcttcagccaggccgccgcccacggccacagaaatgtgttcaggaagctgctggcccagcctgagaaggagaagagtgacatcctgagcctggaggagatcctggccgagggcacagacctggccgagacagcccccccacccctgtgtgccagcaggaacagcaaggccaagctgcgggccctgcgggaggccatgtaccacagcgctgagcacggctacgtggatgtgaccatcgacatccgcagcattggagtgccctggaccctgcacacctggctggagagcctgcgcatcgccttccagcagcaccggcggcccctcatccagtgcctgctgaaggagttcaagaccatccaggaggaggagtacacagaggagctggtgacccagggcctgcccctgatgtttgagatcctgaaggccagcaagaatgaggtgatcagccagcagctgtgtgtgatcttcacccactgctacggcccctaccccatccccaagctgacagagatcaagaggaagcagaccagccggctggacccccacttcctgaacaacaaggagatgtctgatgtgaccttcctggtggagggccggcccttctacgcccacaaggtgctgctcttcaccgccagcccccgcttcaaggccctgctgagcagcaagcccaccaatgatggcacctgcattgaaattggctacgtgaagtacagcatcttccagctggtgatgcagtacctgtactacggcggccctgagagcctgctgatcaagaacaatgagatcatggagctgctgtctgctgccaagttcttccagctggaggccctgcagaggcactgtgagatcatctgtgccaagagcatcaacacagacaactgtgtggacatctacaaccacgccaagttcctgggcgtgacagagctgagcgcctactgtgagggctacttcctgaagaacatgatggtgctgattgaaaatgaggccttcaagcagctgctgtatgacaagaatggagagggcaccggccaggatgtgctgcaggacctgcagaggaccctggccatccgcatccagagcatccacctgagcagcagcaagggctctgtggtgtag

SEQ ID NO: 32660 - DNA, 1926 bp, Artificial Sequence
  Description of Artificial Sequence: Synthetic coding sequence
atgaggaagctgcggcccaaggacagccgggagcccgcccctggcagccctgtgcgcagcggctgcctgcagaggctgagccactacagcggcatccagaggcccttcctggtgctgccccccctgatggagtggatccgggtggccgtggcccatgctggccaccggcgctccttctccatggacagtgatgatgtgcggcaggccgcccggctgctgctgcccggggtggactgtgagccccggcagctgcgggcagatgactgcttctgtgccagcaggaagctggatgctgtggccatcgaggccaagttcaagcaggacctgggcttcaggatgctgaactgtggccgcacagacctggtgaagcaggccgtgtccctgctgggcccagatggcatcaacaccatgtctgagcagggcatgacccccctgatgtatgcctgtgtgagaggagatgaggccatggtgcagatgctgctggatgctggagctgacctgaatgtggaggtggtgtccaccccccacaagtaccccagcgtgcaccctgagaccaggcactggacagccctgacctttgctgtgctgcacggccacatccctgtggtgcagctgctgctggatgctggggccaaggtggagggctctgtggagcacggggaggagaactacagcgagacccccctgcagctggccgctgctgtgggcaactttgagctggtgtccctgctgctggagagaggagctgaccccctgattggcaccatgtacagaaatggcatcagcaccaccccccagggcgacatgaacagcttcagccaggccgccgcccacggccacagaaatgtgttcaggaagctgctggcccagcctgagaaggagaagagtgacatcctgagcctggaggagatcctggccgagggcacagacctggccgagacagcccccccacccctgtgtgccagcaggaacagcaaggccaagctgcgggccctgcgggaggccatgtaccacagcgctgagcacggctacgtggatgtgaccatcgacatccgcagcattggagtgccctggaccctgcacacctggctggagagcctgagaattgccttccagcagcacagaagacccctcatccagtgcctgctgaaggagttcaagaccatccaggaggaggagtacacagaggagctggtgacccagggcctgcccctgatgtttgagatcctgaaggccagcaagaatgaagtcatcagccagcagctgtgtgtgatcttcacccactgctacggcccctaccccatccccaagctgacagagatcaagaggaagcagaccagccggctggacccccacttcctgaacaacaaggagatgtctgatgtgaccttcctggtggagggccggcccttctacgcccacaaggtgctgctcttcaccgccagcccccgcttcaaggccctgctgagcagcaagcccaccaatgatggcacctgcatcgagatcggctacgtgaagtacagcatcttccagctggtgatgcagtacctgtactatggaggccctgagagcctgctgatcaagaacaatgagatcatggagctgctgtctgctgccaagttcttccagctggaggccctgcagaggcactgtgagatcatctgtgccaagagcatcaacacagacaactgtgtggacatctacaaccacgccaagttcctgggcgtgacagagctgagcgcctactgtgagggctacttcctgaagaacatgatggtgctgattgaaaatgaggccttcaagcagctgctgtatgacaagaatggagagggcaccggccaggatgtgctgcaggacctgcagaggaccctggccatccgcatccagagcatccacctgagcagcagcaaaggatctgtggtgtag

SEQ ID NO: 32661 - DNA, 2958 bp, Artificial Sequence
  Description of Artificial Sequence: Synthetic coding sequence
atggcccggcggggcaagaagcctgtggtgaggaccctggaggacctgaccctggacagcggctacggcggcgctgctgacagcgtgcgcagcagcaacctgagcctgtgctgcagcgacagccacccagccagcccctatggaggcagctgctggccacccctggccgacagcatgcacagccgccacaacagctttgacacagtgaacacagccctggtggaggacagcgagggcctggactgtgccggccagcactgcagccggctgctgcctgacctggatgaggtgccctggaccctgcaggagctggaggccctgctgctgcggagccgggacccccgggccggccctgctgtgcctgggggcctgcccaaggatgccctggccaagctgagcaccctggtgtcccgggccctggtgagaattgccaaggaggcccagaggctgagcctgcgctttgccaagtgcaccaagtatgagatccagagcgccatggagatcgtgctgtcctggggcctggccgcccactgcacagctgctgccctggccgccctgagcctgtacaacatgagcagcgctggaggagaccggctgggccggggcaagagcgcccgctgtggcctgaccttctctgtgggccgggtgtaccgctggatggtggacagccgggtggccctgcgcatccacgagcacgccgccatctacctgacagcctgcatggagagcctcttccgggacatctacagccgggtggtggccagcggcgtgcccaggagctgcagcggccctggcagcggcagcggcagcggccctggccccagcagcggccctggggccgccccagctgctgacaaggagcgggaggcccctgggggcggggccgccagcggcggggcctgcagcgctgccagcagcgccagcggcggcagcagctgctgtgcccccccagctgctgctgctgctgctgtgcccccagctgctgctgccaaccaccaccaccaccaccaccacgccctgcacgaggcccccaagttcaccgtggagaccctggagcacacagtgaacaatgattctgagatctggggcctgctgcagccctaccagcacctgatctgtgggaagaatgccagcggcgtgctgtgcctgcctgacagcctgaacctgcaccgggacccccagaggagcaacaagccaggagagctgcccatgttcagccagagcgagctgcggaccatcgagcagagcctgctggccaccagggtgggcagcattgctgagctgagtgacctggtgtcccgggccatgcaccacctgcagcccctgaatgccaagcaccacggcaatggcacccccctgcaccacaagcagggcgccctgtactgggagcctgaggccctgtacaccctgtgctacttcatgcactgcccccagatggagtgggagaaccccaacgtggagcccagcaaggtgaacctgcaggtggagcggcccttcctggtgctgccccccctgatggagtggatccgggtggccgtggcccacgccggccacagaagaagcttctccatggacagtgatgatgtgcggcaggccgcccggctgctgctgcccggggtggactgtgagccccggcagctgcgggcagatgactgcttctgtgccagcaggaagctggatgctgtggccatcgaggccaagttcaagcaggacctgggcttcaggatgctgaactgtggccgcacagacctggtgaagcaggccgtgtccctgctgggcccagatggcatcaacaccatgtctgagcagggcatgacccccctgatgtatgcctgtgtgagaggagatgaggccatggtgcagatgctgctggatgctggagctgacctgaatgtggaggtggtgtccaccccccacaagtaccccagcgtgcaccctgagaccaggcactggacagccctgacctttgctgtgctgcacggccacatccctgtggtgcagctgctgctggatgctggggccaaggtggagggctctgtggagcacggggaggagaactacagcgagacccccctgcagctggccgctgctgtgggcgtgccctggaccctgcacacctggctggagagcctgagaattgccttccagcagcacagaagacccctcatccagtgcctgctgaaggagttcaagaccatccaggaggaggagtacacagaggagctggtgacccagggcctgcccctgatgtttgagatcctgaaggccagcaagaatgaagtcatcagccagcagctgtgtgtgatcttcacccactgctacggcccctaccccatccccaagctgacagagatcaagaggaagcagaccagccggctggacccccacttcctgaacaacaaggagatgtctgatgtgaccttcctggtggagggccggcccttctacgcccacaaggtgctgctcttcaccgccagcccccgcttcaaggccctgctgagcagcaagcccaccaatgatggcacctgcatcgagatcggctacgtgaagtacagcatcttccagctggtgatgcagtacctgtactatggaggccctgagagcctgctgatcaagaacaatgagatcatggagctgctgtctgctgccaagttcttccagctggaggccctgcagaggcactgtgagatcatctgtgccaagagcatcaacacagacaactgtgtggacatctacaaccacgccaagttcctgggcgtgacagagctgagcgcctactgtgagggctacttcctgaagaacatgatggtgctgattgaaaatgaggccttcaagcagctgctgtatgacaagaatggagagggcaccggccaggatgtgctgcaggacctgcagaggaccctggccatccgcatccagagcatccacctgagcagcagcaaaggatctgtggtgtag

SEQ ID NO: 32662 - DNA, 3024 bp, Artificial Sequence
  Description of Artificial Sequence: Synthetic coding sequence
atggcccggcggggcaagaagcctgtggtgaggaccctggaggacctgaccctggacagcggctacggcggcgctgctgacagcgtgcgcagcagcaacctgagcctgtgctgcagcgacagccacccagccagcccctatggaggcagctgctggccacccctggccgacagcatgcacagccgccacaacagctttgacacagtgaacacagccctggtggaggacagcgagggcctggactgtgccggccagcactgcagccggctgctgcctgacctggatgaggtgccctggaccctgcaggagctggaggccctgctgctgcggagccgggacccccgggccggccctgctgtgcctgggggcctgcccaaggatgccctggccaagctgagcaccctggtgtcccgggccctggtgagaattgccaaggaggcccagaggctgagcctgcgctttgccaagtgcaccaagtatgagatccagagcgccatggagatcgtgctgtcctggggcctggccgcccactgcacagctgctgccctggccgccctgagcctgtacaacatgagcagcgctggaggagaccggctgggccggggcaagagcgcccgctgtggcctgaccttctctgtgggccgggtgtaccgctggatggtggacagccgggtggccctgcgcatccacgagcacgccgccatctacctgacagcctgcatggagagcctcttccgggacatctacagccgggtggtggccagcggcgtgcccaggagctgcagcggccctggcagcggcagcggcagcggccctggccccagcagcggccctggggccgccccagctgctgacaaggagcgggaggcccctgggggcggggccgccagcggcggggcctgcagcgctgccagcagcgccagcggcggcagcagctgctgtgcccccccagctgctgctgctgctgctgtgcccccagctgctgctgccaaccaccaccaccaccaccaccacgccctgcacgaggcccccaagttcaccgtggagaccctggagcacacagtgaacaatgattctgagatctggggcctgctgcagccctaccagcacctgatctgtgggaagaatgccagcggcgtgctgtgcctgcctgacagcctgaacctgcaccgggacccccagaggagcaacaagccaggagagctgcccatgttcagccagagcgagctgcggaccatcgagcagagcctgctggccaccagggtgggcagcattgctgagctgagtgacctggtgtcccgggccatgcaccacctgcagcccctgaatgccaagcaccacggcaatggcacccccctgcaccacaagcagggcgccctgtactgggagcctgaggccctgtacaccctgtgctacttcatgcactgcccccagatggagtgggagaaccccaacgtggagcccagcaaggtgaacctgcaggtggagcggcccttcctggtgctgccccccctgatggagtggatccgggtggccgtggcccacgccggccacagaagaagcttctccatggacagtgatgatgtgcggcaggccgcccggctgctgctgcccggggtggactgtgagccccggcagctgcgggcagatgactgcttctgtgccagcaggaagctggatgctgtggccatcgaggccaagttcaagcaggacctgggcttcaggatgctgaactgtggccgcacagacctggtgaagcaggccgtgtccctgctgggcccagatggcatcaacaccatgtctgagcagggcatgacccccctgatgtatgcctgtgtgagaggagatgaggccatggtgcagatgctgctggatgctggagctgacctgaatgtggaggtggtgtccaccccccacaagtaccccagcgtgcaccctgagaccaggcactggacagccctgacctttgctgtgctgcacggccacatccctgtggtgcagctgctgctggatgctggggccaaggtggagggctctgtggagcacggggaggagaactacagcgagacccccctgcagctggccgctgctgtgggcaactttgagctggtgtccctgctgctggagagaggagctgaccccctcatcggcaccatgtacagaaatggcatcagcaccaccccccagggcgacatgaacagcttcagccaggccgccgcccacggccacagaaatgtgttcaggaagctgctggcccagcctgagaaggagaagagtgacatcctgagcctggaggagatcctggccgagggcacagacctggccgagacagcccccccacccctgtgtgccagcaggaacagcaaggccaagctgcgggccctgcgggaggccatgtaccacagcgctgagcacggctacgtggatgtgaccatcgacatccgcagcattggagtgccctggaccctgcacacctggctggagagcctgcgcatcgccttccagcagcaccggcggcccctcatccagtgcctgctgaaggagttcaagaccatccaggaggaggagtacacagaggagctggtgacccagggcctgcccctgatgtttgagatcctgaaggccagcaagaatgaggtgatcagccagcagctgtgtgtgatcttcacccactgctacggcccctaccccatccccaagctgacagagatcaagaggaagcagaccagccggctggacccccacttcctgaacaacaaggagatgtctgatgtgaccttcctggtggagggccggcccttctacgcccacaaggtgctgctcttcaccgccagcccccgcttcaaggccctgctgagcagcaagcccaccaatgatggcacctgcattgaaattggctacgtgaagtacagcatcttccagctggtgatgcagtacctgtactacggcggccctgagagcctgctgatcaagaacaatgagatcatggaggtgcgggaccccctgtggtgctggctgtcctag

SEQ ID NO: 32663 - DNA, 552 bp, Artificial Sequence
  Description of Artificial Sequence: Synthetic coding sequence
atgtctgatgtgaccttcctggtggagggccggcccttctacgcccacaaggtgctgctcttcaccgccagcccccgcttcaaggccctgctgagcagcaagcccaccaatgatggcacctgcatcgagatcggctacgtgaagtacagcatcttccagctggtgatgcagtacctgtactatggaggccctgagagcctgctgatcaagaacaatgagatcatggagctgctgtctgctgccaagttcttccagctggaggccctgcagaggcactgtgagatcatctgtgccaagagcatcaacacagacaactgtgtggacatctacaaccacgccaagttcctgggcgtgacagagctgagcgcctactgtgagggctacttcctgaagaacatgatggtgctgattgaaaatgaggccttcaagcagctgctgtatgacaagaatggagagggcaccggccaggatgtgctgcaggacctgcagaggaccctggccatccgcatccagagcatccacctgagcagcagcaaaggatctgtggtgtag

SEQ ID NO: 32664 - DNA, 987 bp, Artificial Sequence
  Description of Artificial Sequence: Synthetic coding sequence
atgtgccaccagcagctggtgatctcctggttcagcctggtgttcctggccagccccctggtggccatctgggagctgaagaaggatgtgtatgtggtggagctggactggtacccagatgcccctggagagatggtggtgctgacctgtgacaccccagaagaagatggcatcacctggaccctggaccagagcagcgaggtgctgggcagcggcaagaccctgaccatccaggtgaaggagtttggagatgctggccagtacacctgccacaagggcggggaggtgctgagccacagcctgctgctgctgcacaagaaggaggatggcatctggagcacagacatcctgaaggaccagaaggagcccaagaacaagaccttcctgcgctgtgaggccaagaactacagcggccgcttcacctgctggtggctgaccaccatcagcacagacctgaccttctctgtgaagagcagccggggcagcagtgacccccagggcgtgacctgtggggccgccaccctgtctgctgagcgggtgcggggggacaacaaggagtatgagtacagcgtggagtgccaggaggacagcgcctgcccagctgctgaggagagcctgcccatcgaggtgatggtggatgctgtgcacaagctgaagtatgagaactacaccagcagcttcttcatccgggacatcatcaagccagacccccccaagaacctgcagctgaagcccctgaagaacagccggcaggtggaggtgtcctgggagtacccagacacctggagcaccccccacagctacttcagcctgaccttctgtgtgcaggtgcagggcaagagcaagcgggagaagaaggacagagtcttcacagacaagaccagcgccaccgtcatctgcaggaagaatgccagcatctctgtgcgggcccaggaccgctactacagcagctcctggagcgagtgggcctctgtgccctgcagctag

SEQ ID NO: 32665 - DNA, 1503 bp, Artificial Sequence
  Description of Artificial Sequence: Synthetic coding sequence
atggccctgatgctgagcctggtgctgagcctgctgaagctgggcagcggccagtggcaggtgtttggaccagacaagcctgtgcaggccctggtgggggaggatgctgccttcagctgcttcctgagccccaagaccaatgctgaggccatggaggtgcgcttcttccggggccagttcagctctgtggtgcacctgtacagagatggcaaggaccagcccttcatgcagatgccccagtaccagggccgcaccaagctggtgaaggacagcattgctgagggccgcatcagcctgcggctggagaacatcaccgtgctggatgctggcctgtatggctgccgcatcagcagccagagctactaccagaaggccatctgggagctgcaggtgtctgccctgggctctgtgcccctcatcagcatcaccggctacgtggaccgggacatccagctgctgtgccagagcagcggctggttcccccggcccacagccaagtggaagggcccccagggccaggacctgagcacagacagcaggaccaacagagacatgcacggcctgtttgatgtggagatcagcctgactgtgcaggagaatgccggcagcatcagctgcagcatgagacatgcccacctgagccgggaggtggagagccgggtgcagattggagacaccttctttgagcccatctcctggcacctggccaccaaggtgctgggcatcctgtgctgcggcctcttctttggaattgtgggcctgaagatcttcttcagcaagttccagtggaagatccaggccgagctggactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagagcttccaggccggcaagcactactgggaggtggatggcggccacaacaagcgctggagggtgggcgtgtgcagagatgatgtggacaggaggaaggagtatgtgaccctgagcccagaccacggctactgggtgctgcggctgaatggagagcacctgtacttcaccctgaacccccgcttcatctctgtgttccccaggaccccacccaccaagattggagtcttcctggactatgaatgtggcaccatctccttcttcaacatcaatgaccagagcctcatctacaccctgacctgccgctttgagggcctgctgcggccctacatcgagtaccccagctacaatgagcagaatggcacccccatcgtcatctgccctgtgacccaggagagcgagaaggaggcctcctggcagagggccagcgccatccctgagaccagcaacagcgagagcagcagccaggccaccacccccttcctgcccagaggagagatgtag

SEQ ID NO: 32666 - DNA, 951 bp, Artificial Sequence
  Description of Artificial Sequence: Synthetic coding sequence
atgcacggcctgtttgatgtggagatcagcctgactgtgcaggagaatgccggcagcatcagctgcagcatgagacatgcccacctgagccgggaggtggagagccgggtgcagattggagacaccttctttgagcccatctcctggcacctggccaccaaggtgctgggcatcctgtgctgcggcctcttctttggaattgtgggcctgaagatcttcttcagcaagttccagtggaagatccaggccgagctggactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagagcttccaggccggcaagcactactgggaggtggatggcggccacaacaagcgctggagggtgggcgtgtgcagagatgatgtggacaggaggaaggagtatgtgaccctgagcccagaccacggctactgggtgctgcggctgaatggagagcacctgtacttcaccctgaacccccgcttcatctctgtgttccccaggaccccacccaccaagattggagtcttcctggactatgaatgtggcaccatctccttcttcaacatcaatgaccagagcctcatctacaccctgacctgccgctttgagggcctgctgcggccctacatcgagtaccccagctacaatgagcagaatggcacccccatcgtcatctgccctgtgacccaggagagcgagaaggaggcctcctggcagagggccagcgccatccctgagaccagcaacagcgagagcagcagccaggccaccacccccttcctgcccagaggagagatgtag

SEQ ID NO: 32667 - DNA, 1128 bp, Artificial Sequence
  Description of Artificial Sequence: Synthetic coding sequence
atgtggacctggtttgtgaagagcctgggctctgtgcccctcatcagcatcaccggctacgtggaccgggacatccagctgctgtgccagagcagcggctggttcccccggcccacagccaagtggaagggcccccagggccaggacctgagcacagacagcaggaccaacagagacatgcacggcctgtttgatgtggagatcagcctgactgtgcaggagaatgccggcagcatcagctgcagcatgagacatgcccacctgagccgggaggtggagagccgggtgcagatcggggacaccttctttgagcccatctcctggcacctggccaccaaggtgctgggcatcctgtgctgcggcctcttcttcggcatcgtgggcctgaagatcttcttcagcaagttccagtggaagatccaggccgagctggactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagagcttccaggccggcaagcactactgggaggtggatggcggccacaacaagcgctggagggtgggcgtgtgcagagatgatgtggacaggaggaaggagtatgtgaccctgagcccagaccacggctactgggtgctgcggctgaatggagagcacctgtacttcaccctgaacccccgcttcatcagcgtcttccccaggaccccacccaccaagattggagtcttcctggactatgaatgtggcaccatctccttcttcaacatcaatgaccagagcctcatctacaccctgacctgccgctttgagggcctgctgcggccctacatcgagtaccccagctacaatgagcagaatggcacccccatcgtcatctgccctgtgacccaggagagcgagaaggaggcctcctggcagagggccagcgccatccctgagaccagcaacagcgagagcagcagccaggccaccacccccttcctgcccagaggagagatgtag

SEQ ID NO: 32668 - DNA, 1023 bp, Artificial Sequence
  Description of Artificial Sequence: Synthetic coding sequence
atggccctgatgctgagcctggtgctgagcctgctgaagctgggcagcggccagtggcaggtgtttggaccagacaagcctgtgcaggccctggtgggggaggatgctgccttcagctgcttcctgagccccaagaccaatgctgaggccatggaggtgcgcttcttccggggccagttcagctctgtggtgcacctgtacagagatggcaaggaccagcccttcatgcagatgccccagtaccagggccgcaccaagctggtgaaggacagcattgctgagggccgcatcagcctgcggctggagaacatcaccgtgctggatgctggcctgtatggctgccgcatcagcagccagagctactaccagaaggccatctgggagctgcaggtgtctgccctgggctctgtgcccctcatcagcatcaccggctacgtggaccgggacatccagctgctgtgccagagcagcggctggttcccccggcccacagccaagtggaagggcccccagggccaggacctgagcacagacagcaggaccaacagagacatgcacggcctgtttgatgtggagatcagcctgactgtgcaggagaatgccggcagcatcagctgcagcatgagacatgcccacctgagccgggaggtggagagccgggtgcagattggagacaccttctttgagcccatctcctggcacctggccaccaaggtgctgggcatcctgtgctgcggcctcttctttggaattgtgggcctgaagatcttcttcagcaagttccagtgcaagcgggagcgggaggcctgggccggggccctcttcatggtgcctgctggcactggaagtgagatgctgccccaccctgctgccagcctgctgctggtgctggccagccggggccctggccccaagaagctggagaagaaggccaggacaggccgcatcgagcggcggcctgagaccaggtctggaggagacagcggcagcagagatggcagccctgaggccctgcgcttctag

SEQ ID NO: 32669 - DNA, 1155 bp, Artificial Sequence
  Description of Artificial Sequence: Synthetic coding sequence
atggccctgatgctgagcctggtgctgagcctgctgaagctgggcagcgccctgggctctgtgcccctcatcagcatcaccggctacgtggaccgggacatccagctgctgtgccagagcagcggctggttcccccggcccacagccaagtggaagggcccccagggccaggacctgagcacagacagcaggaccaacagagacatgcacggcctgtttgatgtggagatcagcctgactgtgcaggagaatgccggcagcatcagctgcagcatgagacatgcccacctgagccgggaggtggagagccgggtgcagattggagacaccttctttgagcccatctcctggcacctggccaccaaggtgctgggcatcctgtgctgcggcctcttctttggaattgtgggcctgaagatcttcttcagcaagttccagtggaagatccaggccgagctggactggaggaggaagcacggccaggccgagctgagagatgccaggaagcatgctgtggaggtgaccctggaccctgagacagcccaccccaagctgtgtgtgtctgacctgaagacagtgacccacaggaaggccccccaggaggtgccccacagcgagaagcgcttcaccaggaagtctgtggtggccagccagagcttccaggccggcaagcactactgggaggtggatggcggccacaacaagcgctggagggtgggcgtgtgcagagatgatgtggacaggaggaaggagtatgtgaccctgagcccagaccacggctactgggtgctgcggctgaatggagagcacctgtacttcaccctgaacccccgcttcatctctgtgttccccaggaccccacccaccaagattggagtcttcctggactatgaatgtggcaccatctccttcttcaacatcaatgaccagagcctcatctacaccctgacctgccgctttgagggcctgctgcggccctacatcgagtaccccagctacaatgagcagaatggcacccccatcgtcatctgccctgtgacccaggagagcgagaaggaggcctcctggcagagggccagcgccatccctgagaccagcaacagcgagagcagcagccaggccaccacccccttcctgcccagaggagagatgtag

SEQ ID NO: 32670 - DNA, 1608 bp, Artificial Sequence
  Description of Artificial Sequence: Synthetic coding sequence
atggtggacctgtctgtgtccccagacagcctgaagcctgtgtccctgaccagcagcctggtgttcctgatgcacctgctgctgctgcagcctggagagcccagcagcgaggtgaaggtgctgggccctgagtaccccatcctggccctggtgggggaggaggtggagttcccctgccacctgtggccccagctggatgcccagcagatggagatccgctggttccgcagccagaccttcaacgtggtgcacctgtaccaggagcagcaggagctgcccggccggcagatgcctgccttcaggaacagaaccaagctggtgaaggatgacatcgcctacggctctgtggtgctgcagctgcacagcatcatccccagcgacaagggcacctacggctgccgcttccacagcgacaacttctctggagaggccctgtgggagctggaggtggccggcctgggcagtgacccccacctgagcctggagggcttcaaggagggcggcatccagctgcggctgcggagcagcggctggtaccccaagcccaaggtgcagtggagggaccaccagggccagtgcctgcccccagagtttgaggccatcgtgtgggatgcccaggacctcttcagcctggagacctctgtggtggtgcgggccggggccctgagcaatgtgtctgtgtccatccagaacctgctgctgagccagaagaaggagctggtggtgcagattgctgatgtgtttgtgcctggggccagcgcctggaagagcgcctttgtggccaccctgcccctgctgctggtgctggccgccctggccctgggcgtgctgaggaagcagaggaggagccgggagaagctgaggaagcaggccgagaagaggcaggagaagctgacagctgagctggagaagctgcagacagagctggactggaggagagctgagggccaggccgagtggagggctgcccagaagtatgctgtggatgtgaccctggaccctgccagcgcccaccccagcctggaggtgtctgaagatggcaagtctgtgagcagcagaggagcccctcctggccctgcccctggccacccccagcgcttcagcgagcagacctgtgccctgagcctggagcgcttctctgctggccgccactactgggaggtgcacgtgggccgccgcagccgctggttcctgggcgcctgcctggccgctgtgccccgggccggccctgcccggctgagccctgctgctggctactgggtgctgggcctgtggaatggctgtgagtactttgtgctggccccccaccgggtggccctgaccctgcgggtgcccccccggcggctgggcgtcttcctggactatgaagctggggagctgtccttcttcaacgtgtctgatggcagccacatcttcaccttccatgacaccttcagcggggccctgtgtgcctacttccggccccgggcccatgatggaggagagcacccagaccccctgaccatctgccccctgcctgtgcggggcaccggggtgcctgaagaaaatgacagcgacacctggctgcagccctatgagcctgctgaccctgccctggactggtggtag

SEQ ID NO: 32671 - DNA, 1035 bp, Artificial Sequence
  Description of Artificial Sequence: Synthetic coding sequence
atggtggacctgtctgtgtccccagacagcctgaagcctgtgtccctgaccagcagcctggtgttcctgatgcacctgctgctgctgcagcctggagagcccagcagcgaggtgaaggtgctgggccctgagtaccccatcctggccctggtgggggaggaggtggagttcccctgccacctgtggccccagctggatgcccagcagatggagatccgctggttccgcagccagaccttcaacgtggtgcacctgtaccaggagcagcaggagctgcccggccggcagatgcctgccttcaggaacagaaccaagctggtgaaggatgacatcgcctacggctctgtggtgctgcagctgcacagcatcatccccagcgacaagggcacctacggctgccgcttccacagcgacaacttctctggagaggccctgtgggagctggaggtggccggcctgggcagtgacccccacctgagcctggagggcttcaaggagggcggcatccagctgcggctgcggagcagcggctggtaccccaagcccaaggtgcagtggagggaccaccagggccagtgcctgcccccagagtttgaggccatcgtgtgggatgcccaggacctcttcagcctggagacctctgtggtggtgcgggccggggccctgagcaatgtgtctgtgtccatccagaacctgctgctgagccagaagaaggagctggtggtgcagattgctgatgtgtttgtgcctggggccagcgcctggaagagcgcctttgtggccaccctgcccctgctgctggtgctggccgccctggccctgggcgtgctgaggaagcagaggaggagccgggagaagctgaggaagcaggccgagaagaggcaggagaagctgacagctgagctggagaagctgcagacagagctggactggaggagagctgagggccaggctgaatgttttgtgctggccagccaccccccaggagagggcatccaggccgccagcaacagcaccaccaccctgaatgcctag

SEQ ID NO: 32672 - DNA, 1611 bp, Artificial Sequence
  Description of Artificial Sequence: Synthetic coding sequence
atggtggacctgtctgtgtccccagacagcctgaagcctgtgtccctgaccagcagcctggtgttcctgatgcacctgctgctgctgcagcctggagagcccagcagcgaggtgaaggtgctgggccctgagtaccccatcctggccctggtgggggaggaggtggagttcccctgccacctgtggccccagctggatgcccagcagatggagatccgctggttccgcagccagaccttcaacgtggtgcacctgtaccaggagcagcaggagctgcccggccggcagatgcctgccttcaggaacagaaccaagctggtgaaggatgacatcgcctacggctctgtggtgctgcagctgcacagcatcatccccagcgacaagggcacctacggctgccgcttccacagcgacaacttctctggagaggccctgtgggagctggaggtggccggcctgggcagtgacccccacctgagcctggagggcttcaaggagggcggcatccagctgcggctgcggagcagcggctggtaccccaagcccaaggtgcagtggagggaccaccagggccagtgcctgcccccagagtttgaggccatcgtgtgggatgcccaggacctcttcagcctggagacctctgtggtggtgcgggccggggccctgagcaatgtgtctgtgtccatccagaacctgctgctgagccagaagaaggagctggtggtgcagattgctgatgtgtttgtgcctggggccagcgcctggaagagcgcctttgtggccaccctgcccctgctgctggtgctggccgccctggccctgggcgtgctgaggaagcagaggaggagccgggagaagctgaggaagcaggccgagaagaggcagggcacagagaagacagcccagctgccccccaaccaggtggccagtgactggaggagagctgagggccaggccgagtggagggctgcccagaagtatgctgtggatgtgaccctggaccctgccagcgcccaccccagcctggaggtgtctgaagatggcaagtctgtgagcagcagaggagcccctcctggccctgcccctggccacccccagcgcttcagcgagcagacctgtgccctgagcctggagcgcttctctgctggccgccactactgggaggtgcacgtgggcagaagaagccgctggttcctgggcgcctgcctggccgctgtgcccagggctggccctgcccggctgagccctgctgctggctactgggtgctgggcctgtggaatggctgtgagtactttgtgctggccccccaccgggtggccctgaccctgcgggtgcccccccggcggctgggcgtcttcctggactatgaggccggggagctgtccttcttcaacgtgtctgatggcagccacatcttcaccttccatgacaccttcagcggggccctgtgtgcctacttccggccccgggcccatgatggaggagagcacccagaccccctgaccatctgccccctgcctgtgcggggcactggagtgcctgaggagaatgacagcgacacctggctgcagccctatgagcctgctgaccctgccctggactggtggtag

SEQ ID NO: 32673 - DNA, 1035 bp, Artificial Sequence
  Description of Artificial Sequence: Synthetic coding sequence
atggtggacctgtctgtgtccccagacagcctgaagcctgtgtccctgaccagcagcctggtgttcctgatgcacctgctgctgctgcagcctggagagcccagcagcgaggtgaaggtgctgggccctgagtaccccatcctggccctggtgggggaggaggtggagttcccctgccacctgtggccccagctggatgcccagcagatggagatccgctggttccgcagccagaccttcaacgtggtgcacctgtaccaggagcagcaggagctgcccggccggcagatgcctgccttcaggaacagaaccaagctggtgaaggatgacatcgcctacggctctgtggtgctgcagctgcacagcatcatccccagcgacaagggcacctacggctgccgcttccacagcgacaacttctctggagaggccctgtgggagctggaggtggccggcctgggcagtgacccccacctgagcctggagggcttcaaggagggcggcatccagctgcggctgcggagcagcggctggtaccccaagcccaaggtgcagtggagggaccaccagggccagtgcctgcccccagagtttgaggccatcgtgtgggatgcccaggacctcttcagcctggagacctctgtggtggtgcgggccggggccctgagcaatgtgtctgtgtccatccagaacctgctgctgagccagaagaaggagctggtggtgcagattgctgatgtgtttgtgcctggggccagcgcctggaagagcgcctttgtggccaccctgcccctgctgctggtgctggccgccctggccctgggcgtgctgaggaagcagaggaggagccgggagaagctgaggaagcaggccgagaagaggcaggcccgctatgatgcccaggccggccccctgctggtggccagtgactggaggagagctgagggccaggctgaatgttttgtgctggccagccaccccccaggagagggcatccaggccgccagcaacagcaccaccaccctgaatgcctag

SEQ ID NO: 32674 - DNA, 3672 bp, Artificial Sequence
  Description of Artificial Sequence: Synthetic coding sequence
atgaggcggctggccgctgaggagctgggcgtggtgaccatgcagaggatcttcaacagctttgtgtacacagagaagatcagcaatggagagagcgaggtgcagcagctggccaagaagatccgggagaagttcaaccgctacctggatgtggtgaacagaaacaagcaggtggtggaggccagctacacagcccacctgaccagccccctgacagccatccaggactgctgcaccatccccccatccatgatggagtttgatggcaacttcaacaccaacgtgtccaggaccatcagctgtgaccggctgagcaccaccgtgaacagccgggccttcaaccctggccgggacctgaacagcgtgctggccgacaacctgaagagcaaccctggcatcaagtggcagtacttcagcagcgaggagggcatcttcaccgtcttccctgcccacaagttccgctgcaagggcagctatgagcacaggagccggcccatctacgtgtccacagtgcggccccagagcaagcacatcgtggtgatcctggaccacggggcctctgtgacagacacccagctgcagatcgccaaggatgctgcccaggtgatcctgagcgccattgatgaacatgacaagatctctgtgctgactgtggccgacacagtgaggacctgcagcctggaccagtgctacaagaccttcctgagccctgccaccagcgagaccaagaggaagatgagcacctttgtgtcctctgtgaagagcagtgacagccccacccagcacgctgtgggcttccagaaggccttccagctgatccgcagcaccaacaacaacaccaagttccaggccaacacagacatggtgatcatctacctgtctgctggcatcaccagcaaggacagcagcgaggaggacaagaaggccaccctgcaggtgatcaatgaagaaaattccttcctgaacaacagcgtgatgatcctgacctacgccctgatgaatgatggagtgacaggcctgaaggagctggccttcctgcgggacctggccgagcagaacagcggcaagtatggagtgcctgacaggatggccctgcccgtcatcaagggctccatgatggtgctgaaccagctgagcaacctggagaccaccgtgggccgcttctacaccaacctgcccaacaggatgattgatgaggccgtgttcagcctgcccttcagtgatgagatgggagatggcctcatcatgacagtgtccaagccctgctacttcggcaacctgctgctgggcatcgtgggcgtggatgtgaacctggcctacatcctggaggatgtgacctactaccaggacagcctggccagctacaccttcctgattgatgacaagggctacaccctgatgcaccccagcctgacccggccctacctgctgtctgagccccccctgcacacagacatcatccactatgagaacatccccaagtttgagctggtgcggcagaacatcctgagcctgcccctgggcagccagatcatcgctgtgcctgtgaacagcagcctgtcctggcacatcaacaagctgcgggagaccgggaaggaggcctacaacgtgtcctatgcctggaagatggtgcaggacaccagcttcatcctgtgcatcgtggtgatccagcctgagatccctgtgaagcagctgaagaacctgaacacagtgcccagcagcaagctgctgtaccaccggctggacctgctgggccagcccagcgcctgcctgcacttcaagcagctggccaccctggagagccccaccatcatgctgtctgctggcagcttcagcagcccctatgagcacctgagccagcctgagaccaagaggatggtggagcactacacagcctacctgagtgacaacacccggctgattgccaaccctggcctgaagttctctgtgagaaatgaggtgatggccaccagccacgtgacagatgagtggatgacccagatggagatgagcagcctgaacacctacatcgtgcggcgctacatcgccacccccaacggggtgctgcgcatctacccaggcagcctgatggacaaggcctttgaccccacccggcggcagtggtacctgcatgctgtggccaaccctggcctcatcagcctgaccggcccctacctggatgtgggcggggccggctacgtggtgaccatcagccacaccatccacagcagcagcacccagctgagcagcggccacacagtggccgtgatgggcatcgacttcaccctgcgctacttctacaaggtgctgatggacctgctgcctgtgtgcaaccaggacggcggcaacaagatccgctgcttcatcatggaggaccggggctacctggtggcccaccccaccctgattgaccccaagggccacgcccctgtggagcagcagcacatcacccacaaggagcccctggtggccaatgacatcctgaaccaccccaactttgtgaagaagaacctgtgcaacagcttcagtgacagaacagtgcagcgcttctacaagttcaacaccagcctggccggggacctgaccaacctggtgcacggcagccactgcagcaagtaccgcctggcccgcatccctggcaccaatgcctttgtgggcatcgtgaatgagacctgtgacagcctggccttctgtgcctgcagcatggtggaccggctgtgcctgaactgccacaggatggagcagaatgaatgtgaatgtccctgtgaatgtcccctggaggtgaatgaatgtacaggcaacctgaccaatgcagaaaatagaaaccccagctgtgaggtgcaccaggagcctgtgacctacacagccattgatcctggcctgcaggatgccctgcaccagtgtgtgaacagccgctgcagccagaggctggagagcggggactgctttggagtgctggactgtgagtggtgcatggtggacagtgatggcaagacccacctggacaagccctactgtgccccccagaaggaatgttttggaggcatcgtgggcgccaagagcccctacgtggatgacatgggcgccatcggagatgaggtgatcaccctgaacatgatcaagagcgcccctgtgggccctgtggccggcggcatcatgggctgcatcatggtgctggtgctggccgtgtatgcctaccgccaccagatccaccggcgcagccaccagcacatgagccccctggccgcccaggagatgtctgtgaggatgagcaacctggagaatgacagagatgaaagagatgatgacagccatgaggaccggggcatcatcagcaacacccgcttcatcgctgctgtgattgaaagacatgcccacagccctgagaggagaagacgctactggggccgcagcggcacagaaagtgaccacggctacagcaccatgagcccccaggaggacagcgagaaccccccctgcaacaatgaccccctgtctgctggggtggatgtgggcaaccatgatgaggacctggacctggacaccccaccccagacagctgccctgctgagccacaagttccaccactaccgcagccaccaccccaccctgcaccacagccaccacctgcaggccgctgtgacagtgcacacagtggatgctgagtgctag

SEQ ID NO: 32675 - DNA, 3825 bp, Artificial Sequence
  Description of Artificial Sequence: Synthetic coding sequence
atggcccggcagcctgaggaggaggagacagctgtggcccgggcccggcggccccccctgtggctgctgtgcctggtggcctgctggctgctgggcgctggagctgaggccgacttcagcatcctggatgaggcccaggtgctggccagccagatgaggcggctggccgctgaggagctgggcgtggtgaccatgcagaggatcttcaacagctttgtgtacacagagaagatcagcaatggagagagcgaggtgcagcagctggccaagaagatccgggagaagttcaaccgctacctggatgtggtgaacagaaacaagcaggtggtggaggccagctacacagcccacctgaccagccccctgacagccatccaggactgctgcaccatcccccccagcatgatggagtttgatggcaacttcaacaccaacgtgtccaggaccatcagctgtgaccggctgagcaccaccgtgaacagccgggccttcaaccctggccgggacctgaacagcgtgctggccgacaacctgaagagcaaccctggcatcaagtggcagtacttcagcagcgaggagggcatcttcaccgtcttccctgcccacaagttccgctgcaagggcagctatgagcacaggagccggcccatctacgtgtccacagtgcggccccagagcaagcacatcgtggtgatcctggaccatggagcctctgtgacagacacccagctgcagatcgccaaggatgctgcccaggtgatcctgagcgccattgatgaacatgacaagatctctgtgctgactgtggccgacacagtgaggacctgcagcctggaccagtgctacaagaccttcctgagccctgccaccagcgagaccaagaggaagatgagcacctttgtgtcctctgtgaagagcagtgacagccccacccagcacgctgtgggcttccagaaggccttccagctgatccgcagcaccaacaacaacaccaagttccaggccaacacagacatggtgatcatctacctgtctgctggcatcaccagcaaggacagcagcgaggaggacaagaaggccaccctgcaggtgatcaatgaggagaacagcttcctgaacaacagcgtgatgatcctgacctacgccctgatgaatgatggagtgacaggcctgaaggagctggccttcctgcgggacctggccgagcagaacagcggcaagtatggagtgcctgacaggatggccctgcctgtgatcaagggctccatgatggtgctgaaccagctgagcaacctggagaccaccgtgggccgcttctacaccaacctgcccaacaggatgattgatgaagctgtgttcagcctgcccttcagtgatgagatgggagatggcctcatcatgacagtgtccaagccctgctactttggaaacctgctgctgggcatcgtgggcgtggatgtgaacctggcctacatcctggaggatgtgacctactaccaggacagcctggccagctacaccttcctgattgatgacaagggctacaccctgatgcaccccagcctgacccggccctacctgctgtctgagccccccctgcacacagacatcatccactatgagaacatccccaagtttgagctggtgcggcagaacatcctgagcctgcccctgggcagccagatcatcgctgtgcctgtgaacagcagcctgtcctggcacatcaacaagctgcgggagaccgggaaggaggcctacaacgtgtcctatgcctggaagatggtgcaggacaccagcttcatcctgtgcatcgtggtgatccagcctgagatccctgtgaagcagctgaagaacctgaacacagtgcccagcagcaagctgctgtaccaccggctggacctgctgggccagcccagcgcctgcctgcacttcaagcagctggccaccctggagagccccaccatcatgctgtctgctggcagcttcagcagcccctatgagcacctgagccagcctgagaccaagaggatggtggagcactacacagcctacctgagtgacaacaccaggctcatcgccaaccctggcctgaagttctctgtgagaaatgaggtgatggccaccagccacgtgacagatgagtggatgacccagatggagatgagcagcctgaacacctacatcgtgcggcgctacatcgccaccccaaatggagtgctgcgcatctacccaggcagcctgatggacaaggcctttgaccccacccggcggcagtggtacctgcatgctgtggccaaccctggcctcatcagcctgaccggcccctacctggatgtgggcggggccggctacgtggtgaccatcagccacaccatccacagcagcagcacccagctgagcagcggccacacagtggccgtgatgggcatcgacttcaccctgcgctacttctacaaggtgctgatggacctgctgcctgtgtgcaaccaggacggcggcaacaagatccgctgcttcatcatggaggaccggggctacctggtggcccaccccaccctgattgaccccaagggccacgcccctgtggagcagcagcacatcacccacaaggagcccctggtggccaatgacatcctgaaccaccccaactttgtgaagaagaacctgtgcaacagcttcagtgacagaacagtgcagcgcttctacaagttcaacaccagcctggccggggacctgaccaacctggtgcacggcagccactgcagcaagtaccgcctggcccgcatccctggcaccaatgcctttgtgggcatcgtgaatgagacctgtgacagcctggccttctgtgcctgcagcatggtggaccggctgtgcctgaactgccacaggatggagcagaatgaatgtgagtgcccctgtgagtgccccctggaggtgaatgaatgtactggaaacctgaccaatgctgagaacagaaaccccagctgtgaggtgcaccaggagcctgtgacctacacagccatcgaccccggcctgcaggatgccctgcaccagtgtgtgaacagccgctgcagccagaggctggagagcggggactgcttcggcgtgctggactgtgagtggtgcatggtggacagtgatggcaagacccacctggacaagccctactgtgccccccagaaggagtgcttcggcggcatcgtgggcgccaagagcccctacgtggatgacatgggcgccatcggagatgaagtcatcaccctgaacatgatcaagagcgcccctgtgggccctgtggccggcggcatcatgggctgcatcatggtgctggtgctggccgtgtatgcctaccgccaccagatccacagaagaagccaccagcacatgagccccctggccgcccaggagatgtctgtgaggatgagcaacctggagaatgacagagatgaaagagatgatgacagccatgaagatcggggcatcatcagcaacacccgcttcatcgccgccgtcatcgagagacatgcccacagccctgagaggagaagacgctactggggccgctctggaacagaaagtgaccacggctacagcaccatgagcccccaggaggacagtgaaaatccaccctgcaacaatgaccccctgtctgctggggtggatgtgggcaaccatgatgaggacctggacctggacaccccaccccagacagctgccctgctgagccacaagttccaccactaccgcagccaccaccccaccctgcaccacagccaccacctgcaggccgctgtgacagtgcacacagtggatgctgaatgttag

SEQ ID NO: 32676 - DNA, 2460 bp, Artificial Sequence
  Description of Artificial Sequence: Synthetic coding sequence
atgtggggcctggtgcggctgctgctggcctggctgggcggctggggctgcatgggccgcctggccgccccagcccgggcctgggccggcagccgggagcaccctggccctgccctgctgcggaccaggaggtcctgggtgtggaaccagttcttcgtcatcgaggagtatgccggccctgagcctgtgctgattggcaagctgcacagtgatgtggacagaggagagggccgcaccaagtacctgctgaccggggagggcgccggcaccgtgtttgtgattgatgaggccaccggcaacatccacgtgaccaagagcctggaccgggaggagaaggcccagtatgtgctgctggcccaggccgtggaccgggccagcaaccggcccctggagccccccagcgagttcatcatcaaggtgcaggacatcaatgacaacccccccatcttccccctgggcccctaccacgccaccgtgcctgagatgagcaatgtgggcaccagcgtcatccaggtgacagcccatgatgctgatgaccccagctatggcaacagcgccaagctggtgtacacagtgctggatggcctgcccttcttctctgtggacccccagacaggagtggtgaggacagccatccccaacatggaccgggagacccaggaggagttcctggtggtgatccaggccaaggacatgggcggccacatgggcggcctgagcggcagcaccaccgtgacagtgaccctgagtgatgtgaatgacaacccccccaagttcccccagagcctgtaccagttctctgtggtggagacagctggccctggcaccctggtgggccgcctgcgggcccaggaccctgacctgggggacaatgccctgatggcctacagcatcctggatggagagggcagcgaggccttcagcatcagcacagacctgcagggcagagatggcctgctgactgtgaggaagcccctggactttgagagccagaggagctacagcttccgggtggaggccaccaacaccctgattgatcctgcctacctgcggcggggccccttcaaggatgtggcctctgtgcgggtggccgtgcaggatgcccctgagcccccagccttcacccaggccgcctaccacctgactgtgcctgagaacaaggcccctggcaccctggtgggccagatctctgctgctgacctggacagccctgccagccccatccgctacagcatcctgccccacagcgaccctgagcgctgcttcagcatccagcctgaggagggcaccatccacacagctgcccccctggaccgggaggcccgggcctggcacaacctgactgtgctggccacagagctgggctggagctggggccctgagcggggctgggtgcccctgctggtggccgagtggagcgccccagctgccccaccccagaggagccctgtgggcagcgctgtgggcatcccccaggacagcagcgcccaggccagccgggtgcaggtggccatccagaccctggatgaaaatgacaatgccccccagctggccgagccctatgacacctttgtgtgtgacagcgctgcccctggccagctgatccaggtgatccgggccctggacagagatgaggtgggcaacagcagccacgtgtccttccagggccccctgggcccagatgccaacttcaccgtgcaggacaacagagatggcagcgccagcctgctgctgcccagcaggcctgccccacccaggcatgccccctacctggtgcccatcgagctgtgggactggggccagcctgccctgagcagcacagccaccgtgacagtgtctgtgtgccgctgccagccagatggctctgtggccagctgctggccagaggcccacctgtctgctgctggcctgagcactggagccctgctggccatcatcacctgtgtgggcgccctgctggccctggtggtgctgtttgtggccctgcggcggcagaagcaggaggccctgatggtgctggaggaggaggatgtgcgggagaacatcatcacctatgatgatgaaggaggaggagaggaggacacagaggcctttgacatcacagccctgcagaacccagatggagctgcccccccagcccctggccccccagccaggagagatgtgctgccccgggcccgggtgtcccggcagccccggcccccaggccctgcagatgtggcccagctgctggccctgcggctgcgggaggctgatgaagatcctggggtgcccccctatgacagcgtgcaggtgtatggctatgagggccggggcagcagctgtggcagcctgagcagcctgggcagcggcagcgaggccggcggggcccctggccctgctgagcccctggatgactggggccccctcttccgcaccctggccgagctgtatggagccaaggagcccccagccccctag

SEQ ID NO: 32677 - DNA, 2460 bp, Artificial Sequence; identical to SEQ ID NO: 32676
  Description of Artificial Sequence: Synthetic coding sequence

SEQ ID NO: 32678 - DNA, 945 bp, Artificial Sequence
  Description of Artificial Sequence: Synthetic coding sequence
atgtggggcctggtgcggctgctgctggcctggctgggcggctggggctgcatgggccgcctggccgccccagcccgggcctgggccggcagccgggagcaccctggccctgccctgctgcggaccaggaggtcctgggtgtggaaccagttcttcgtcatcgaggagtatgccggccctgagcctgtgctgattggcaagctgcacagtgatgtggacagaggagagggccgcaccaagtacctgctgaccggggagggcgccggcaccgtgtttgtgattgatgaggccaccggcaacatccacgtgaccaagagcctggaccgggaggagaaggcccagtatgtgctgctggcccaggccgtggaccgggccagcaaccggcccctggagccccccagcgagttcatcatcaagatcatcacctgtgtgggcgccctgctggccctggtggtgctgtttgtggccctgcggcggcagaagcaggaggccctgatggtgctggaggaggaggatgtgcgggagaacatcatcacctatgatgatgagggcggcggggaggaggacacagaggcctttgacatcacagccctgcagaacccagatggagctgcccccccagcccctggccccccagccaggagagatgtgctgccccgggcccgggtgtcccggcagcccaggcctcctggccctgcagatgtggcccagctgctggccctgcggctgcgggaggctgatgaggaccccggggtgcccccctatgattctgtgcaggtgtatggctatgagggccggggcagcagctgtggcagcctgagcagcctgggcagcggcagcgaggccggcggggcccctggccctgctgagcccctggatgactggggccccctcttccgcaccctggccgagctgtatggagccaaggagcccccagccccctag

SEQ ID NO: 32679 - DNA, 2346 bp, Artificial Sequence
  Description of Artificial Sequence: Synthetic coding sequence
atgtggggcctggtgcggctgctgctggcctggctgggcggctggggctgcatgggccgcctggccgccccagcccgggcctgggccggcagccgggagcaccctggccctgccctgctgcggaccaggaggtcctgggtgtggaaccagttcttcgtcatcgaggagtatgccggccctgagcctgtgctgattggcaagctgcacagtgatgtggacagaggagagggccgcaccaagtacctgctgaccggggagggcgccggcaccgtgtttgtgattgatgaggccaccggcaacatccacgtgaccaagagcctggaccgggaggagaaggcccagtatgtgctgctggcccaggccgtggaccgggccagcaaccggcccctggagccccccagcgagttcatcatcaaggtgcaggacatcaatgacaacccccccatcttccccctgggcccctaccacgccaccgtgcctgagatgagcaatgtgggcaccagcgtcatccaggtgacagcccatgatgctgatgaccccagctatggcaacagcgccaagctggtgtacacagtgctggatggcctgcccttcttctctgtggacccccagacaggagtggtgaggacagccatccccaacatggaccgggagacccaggaggagttcctggtggtgatccaggccaaggacatgggcggccacatgggcggcctgagcggcagcaccaccgtgacagtgaccctgagtgatgtgaatgacaacccccccaagttcccccagagcctgtaccagttctctgtggtggagacagctggccctggcaccctggtgggccgcctgcgggcccaggaccctgacctgggggacaatgccctgatggcctacagcatcctggatggagagggcagcgaggccttcagcatcagcacagacctgcagggcagagatggcctgctgactgtgaggaagcccctggactttgagagccagaggagctacagcttccgggtggaggccaccaacaccctgattgatcctgcctacctgcggcggggccccttcaaggatgtggcctctgtgcgggtggccgtgcaggatgcccctgagcccccagccttcacccaggccgcctaccacctgactgtgcctgagaacaaggcccctggcaccctggtgggccagatctctgctgctgacctggacagccctgccagccccatccgctacagcatcctgccccacagcgaccctgagcgctgcttcagcatccagcctgaggagggcaccatccacacagctgcccccctggaccgggaggcccgggcctggcacaacctgactgtgctggccacagagctggacagcagcgcccaggccagccgggtgcaggtggccatccagaccctggatgaaaatgacaatgccccccagctggccgagccctatgacacctttgtgtgtgacagcgctgcccctggccagctgatccaggtgatccgggccctggacagagatgaggtgggcaacagcagccacgtgtccttccagggccccctgggcccagatgccaacttcaccgtgcaggacaacagagatggcagcgccagcctgctgctgcccagcaggcctgccccacccaggcatgccccctacctggtgcccatcgagctgtgggactggggccagcctgccctgagcagcacagccaccgtgacagtgtctgtgtgccgctgccagccagatggctctgtggccagctgctggccagaggcccacctgtctgctgctggcctgagcactggagccctgctggccatcatcacctgtgtgggcgccctgctggccctggtggtgctgtttgtggccctgcggcggcagaagcaggaggccctgatggtgctggaggaggaggatgtgcgggagaacatcatcacctatgatgatgaaggaggaggagaggaggacacagaggcctttgacatcacagccctgcagaacccagatggagctgcccccccagcccctggccccccagccaggagagatgtgctgccccgggcccgggtgtcccggcagccccggcccccaggccctgcagatgtggcccagctgctggccctgcggctgcgggaggctgatgaagatcctggggtgcccccctatgacagcgtgcaggtgtatggctatgagggccggggcagcagctgtggcagcctgagcagcctgggcagcggcagcgaggccggcggggcccctggccctgctgagcccctggatgactggggccccctcttccgcaccctggccgagctgtatggagccaaggagcccccagccccctag

SEQ ID NO: 32680 - DNA, 2346 bp, Artificial Sequence; identical to SEQ ID NO: 32679
  Description of Artificial Sequence: Synthetic coding sequence

SEQ ID NO: 32681 - DNA, 2559 bp, Artificial Sequence
  Description of Artificial Sequence: Synthetic coding sequence
atggccatgaggagcggccgccaccccagcctgctgctgctgctggtgctgctgctgtggctgctgcaggtgtccatcattgattctgtgcagcaggagacagatgacctgaccaagcagaccaaggagaagatctaccagcccctgcggcgcagcaagaggcgctgggtgatcaccaccctggagctggaggaggaggaccccggccccttccccaagctgattggagagctgttcaacaacatgagctacaacatgagcctgatgtacctgatcagcggccctggggtggatgagtacccagaaattggcctcttcagcctggaggaccatgaaaatggccgcatctacgtgcacaggcctgtggaccgggagatgacccccagcttcaccgtgtactttgatgtggtggagaggagcacaggcaagatcgtggacaccagcctcatcttcaacatccgcatcagtgatgtgaatgaccacgccccccagtttcctgagaaggagttcaacatcaccgtgcaggagaaccagagcgctggccagcccatcttccagatgctggccgtggacctggatgaggagaacacccccaacagccaggtgctgtacttcctgatcagccagacccccctgctgaaggagagcggcttccgggtggaccggctgagcggggagatccggctgagcggctgcctggactatgaaacagccccccagttcaccctgctgatccgggcccgggactgtggggagcccagcctgagcagcaccaccaccgtgcacgtggatgtgcaggagggcaacaaccacaggcctgccttcacccaggagaactacaaggtgcagatccctgagggccgggccagccagggcgtgctgcggctgctggtgcaggaccgggacagccccttcaccagcgcctggagggccaagttcaacatcctgcatggaaatgaggagggccactttgacatcagcacagatcctgagaccaatgaaggcatcctgaatgtcatcaagcccctggactatgagaccaggcctgcccagagcctcatcatcgtggtggagaatgaggagcggctggtgttctgtgagcggggcaagctgcagccccccaggaaggccgccgccagcgccaccgtgtctgtgcaggtgacagatgccaatgaccccccagccttccacccccagagcttcatcgtgaacaaggaggagggcgcccggcccggcaccctgctgggcaccttcaatgccatggaccctgacagccagatccgctatgagctggtgcatgaccctgccaactgggtgtctgtggacaagaacagcggcgtggtgatcaccgtggagcccatcgaccgggagagcccccacgtgaacaacagcttctacgtgatcatcatccatgctgtggatgatggcttccccccccagacagccaccggcaccctgatgctgttcctgagtgacatcaatgacaacgtgcccaccctgcggcccaggagccgctacatggaggtgtgtgagagcgctgtgcatgagcccctgcacatcgaggctgaagatcctgacctggagcccttcagtgaccccttcacctttgagctggacaacacctggggcaatgctgaggacacctggaagctgggcaggaactggggccagagcgtggagctgctgaccctgcggagcctgccccggggcaactacctggtgcccctcttcatcggggacaagcagggcctgagccagaagcagacagtgcacgtgcgcatctgcccctgtgccagcggcctgacctgtgtggagctggctgatgctgaggtgggcctgcacgtgggcgccctcttccctgtgtgtgccgcctttgtggccctggccgtggccctgctcttcctgctgcgctgctactttgtgctggagcccaagagacatggctgcagcgtgtccaatgatgagggccaccagaccctggtgatgtacaatgctgagagcaagggcaccagcgcccagacctggagcgatgtggagggccagaggcctgccctgctgatctgcacagctgctgctggccccacccagggcgtgaaggcctacccagatgccaccatgcaccggcagctgctggcccctgtggagggccgcatggccgagaccctgaaccagagcaaggagaggaaccgcttcagcctgagccggggctgcatcatcccccagggccgggccacagctggccggggcctgccccaggacatctacaaggagatgatgccccggcggctgacccagacaggcaagaggaagcatggagccctggcccggacccccagcttcaagaaggtggtgtatgaccacaaggaggatgaggagaacaaggccggcaggaagcagaggagccacctgttcaaggtgatgcagctgagaaatgagcagggcggcgtgcgggtgcagagcgcccacagccccagccccctgaacaagaaggcctgcttccctggggactacagaggagagagcgctgggggccacaactgcagagctgtgtctggatag

SEQ ID NO: 32682 - DNA, 375 bp, Artificial Sequence
  Description of Artificial Sequence: Synthetic coding sequence
atgaagcccctcatctggacctggagcgatgtggagggccagaggcctgccctgctgatctgcacagctgctgctggccccacccagggcgtgaaggcctacccagatgccaccatgcaccggcagctgctggcccctgtggagggccgcatggccgagaccctgaaccagaagctgcacgtggccaacgtgctggaggatgatcctggctacctgccccacgtgtacagcgaggagggagaatgtggcggggcccccagcctgagcagcctggccagcctggagcaggagctgcagcctgacctgctggacagcctgggcagcaaggccaccccatttgaggagatctacagcgagagcggcgtgcccagctag

SEQ ID NO: 32683 - DNA, 2499 bp, Artificial Sequence
  Description of Artificial Sequence: Synthetic coding sequence
atggccatgaggagcggccgccaccccagcctgctgctgctgctggtgctgctgctgtggctgctgcaggtgtccatcattgattctgtgcagcaggagacagatgacctgaccaagcagaccaaggagaagatctaccagcccctgcggcgcagcaagaggcgctgggtgatcaccaccctggagctggaggaggaggaccccggccccttccccaagctgattggagagctgttcaacaacatgagctacaacatgagcctgatgtacctgatcagcggccctggggtggatgagtacccagaaattggcctcttcagcctggaggaccatgaaaatggccgcatctacgtgcacaggcctgtggaccgggagatgacccccagcttcaccgtgtactttgatgtggtggagaggagcacaggcaagatcgtggacaccagcctcatcttcaacatccgcatcagtgatgtgaatgaccacgccccccagtttcctgagaaggagttcaacatcaccgtgcaggagaaccagagcgctggccagcccatcttccagatgctggccgtggacctggatgaggagaacacccccaacagccaggtgctgtacttcctgatcagccagacccccctgctgaaggagagcggcttccgggtggaccggctgagcggggagatccggctgagcggctgcctggactatgaaacagccccccagttcaccctgctgatccgggcccgggactgtggggagcccagcctgagcagcaccaccaccgtgcacgtggatgtgcaggagggcaacaaccacaggcctgccttcacccaggagaactacaaggtgcagatccctgagggccgggccagccagggcgtgctgcggctgctggtgcaggaccgggacagccccttcaccagcgcctggagggccaagttcaacatcctgcatggaaatgaggagggccactttgacatcagcacagatcctgagaccaatgaaggcatcctgaatgtcatcaagcccctggactatgagaccaggcctgcccagagcctcatcatcgtggtggagaatgaggagcggctggtgttctgtgagcggggcaagctgcagccccccaggaaggccgccgccagcgccaccgtgtctgtgcaggtgacagatgccaatgaccccccagccttccacccccagagcttcatcgtgaacaaggaggagggcgcccggcccggcaccctgctgggcaccttcaatgccatggaccctgacagccagatccgctatgagctggtgcatgaccctgccaactgggtgtctgtggacaagaacagcggcgtggtgatcaccgtggagcccatcgaccgggagagcccccacgtgaacaacagcttctacgtgatcatcatccatgctgtggatgatggcttccccccccagacagccaccggcaccctgatgctgttcctgagtgacatcaatgacaacgtgcccaccctgcggcccaggagccgctacatggaggtgtgtgagagcgctgtgcatgagcccctgcacatcgaggctgaagatcctgacctggagcccttcagtgaccccttcacctttgagctggacaacacctggggcaatgctgaggacacctggaagctgggcaggaactggggccagagcgtggagctgctgaccctgcggagcctgccccggggcaactacctggtgcccctcttcatcggggacaagcagggcctgagccagaagcagacagtgcacgtgcgcatctgcccctgtgccagcggcctgacctgtgtggagctggctgatgctgaggtgggcctgcacgtgggcgccctcttccctgtgtgtgccgcctttgtggccctggccgtggccctgctcttcctgctgcgctgctactttgtgctggagcccaagagacatggctgcagcgtgtccaatgatgagggccaccagaccctggtgatgtacaatgctgagagcaagggcaccagcgcccagacctggagcgatgtggagggccagaggcctgccctgctgatctgcacagctgctgctggccccacccagggcgtgaaggacctggaggaggtgcccccatctgctgccagccagagcgcccaggcccgctgtgccctgggctcctggggctacggcaagccctttgagcccaggtctgtgaagaacatccacagcaccccagcctacccagatgccaccatgcaccggcagctgctggcccctgtggagggccgcatggccgagaccctgaaccagaagctgcacgtggccaacgtgctggaggatgatcctggctacctgccccacgtgtacagcgaggagggagaatgtggcggggcccccagcctgagcagcctggccagcctggagcaggagctgcagcctgacctgctggacagcctgggcagcaaggccaccccatttgaggagatctacagcgagagcggcgtgcccagctag

SEQ ID NO: 32684 - DNA, 498 bp, Artificial Sequence
  Description of Artificial Sequence: Synthetic coding sequence
atgaagcccctcatctggacctggagcgatgtggagggccagaggcctgccctgctgatctgcacagctgctgctggccccacccagggcgtgaaggacctggaggaggtgccccccagcgctgccagccagagcgcccaggcccgctgtgccctgggctcctggggctacggcaagccctttgagcccaggtctgtgaagaacatccacagcaccccagcctacccagatgccaccatgcaccggcagctgctggcccctgtggagggccgcatggccgagaccctgaaccagaagctgcacgtggccaacgtgctggaggatgaccccggctacctgccccacgtgtacagcgaggagggggagtgtggcggggcccccagcctgagcagcctggccagcctggagcaggagctgcagcctgacctgctggacagcctgggcagcaaggccaccccatttgaggagatctacagcgagagcggcgtgcccagctag

SEQ ID NO: 32685 - DNA, 1335 bp, Artificial Sequence
  Description of Artificial Sequence: Synthetic coding sequence
tgaagacctggcaccctgctgggcaccttcaatgccatggaccctgacagccagatccgctatgagctggtgcatgaccctgccaactgggtgtctgtggacaagaacagcggcgtggtgatcaccgtggagcccatcgaccgggagagcccccacgtgaacaacagcttctacgtgatcatcatccatgctgtggatgatggcttccccccccagacagccaccggcaccctgatgctgttcctgagtgacatcaatgacaacgtgcccaccctgcggcccaggagccgctacatggaggtgtgtgagagcgctgtgcatgagcccctgcacatcgaggctgaagatcctgacctggagcccttcagtgaccccttcacctttgagctggacaacacctggggcaatgctgaggacacctggaagctgggcaggaactggggccagagcgtggagctgctgaccctgcggagcctgccccggggcaactacctggtgcccctcttcatcggggacaagcagggcctgagccagaagcagacagtgcacgtgcgcatctgcccctgtgccagcggcctgacctgtgtggagctggctgatgctgaggtgggcctgcacgtgggcgccctcttccctgtgtgtgccgcctttgtggccctggccgtggccctgctcttcctgctgcgctgctactttgtgctggagcccaagagacatggctgcagcgtgtccaatgatgagggccaccagaccctggtgatgtacaatgctgagagcaagggcaccagcgcccagacctggagcgatgtggagggccagaggcctgccctgctgatctgcacagctgctgctggccccacccagggcgtgaaggcctacccagatgccaccatgcaccggcagctgctggcccctgtggagggccgcatggccgagaccctgaaccagagcaaggagaggaaccgcttcagcctgagccggggctgcatcatcccccagggccgggccacagctggccggggcctgccccaggacatctacaaggagatgatgccccggcggctgacccagacaggcaagaggaagcatggagccctggcccggacccccagcttcaagaaggtggtgtatgaccacaaggaggatgaggagaacaaggccggcaggaagcagaggagccacctgttcaaggtgatgcagctgagaaatgagcagggcggcgtgcgggtgcagagcgcccacagccccagccccctgaacaagaaggcctgcttccctggggactacagaggagagagcgctgggggccacaactgcagagctgtgtctggatag

SEQ ID NO: 32686 - DNA, 3933 bp, Artificial Sequence
  Description of Artificial Sequence: Synthetic coding sequence
atggcccagctgtggctgagctgcttcctgctgcctgccctggtggtgtctgtggccgccaacgtggcccccaagttcctggccaacatgaccagcgtcatcctgcctgaggacctgcctgtgggcgcccaggccttctggctggtggccgaggaccaggacaatgaccccctgacctacggcatgagcggccccaatgcctacttctttgctgtgacccccaagacaggagaggtgaagctggccagcgccctggactatgagaccctgtacaccttcaaggtgaccatctctgtgtctgacccctacatccaggtgcagcgggagatgctggtgattgtggaggacagaaatgacaatgcccctgtgttccagaacacagccttcagcaccagcatcaatgagaccctgcctgtgggctctgtggtgttttctgtgctggccgtggacaaggacatgggcagcgctggcatggtggtgtacagcattgagaaggtgatccccagcactggagacagcgagcacctgttccgcatcctggccaacggcagcatcgtgctgaatggcagcctgagctacaacaacaagagcgccttctaccagctggagctgaaggcctgtgacctgggcggcatgtaccacaacaccttcaccatccagtgcagcctgcccgtcttcctgagcatctctgtggtggaccagcctgacctggacccccagtttgtgcgggagttctacagcgcctctgtggccgaggatgctgccaagggcacctctgtgctgactgtggaggccgtggatggagacaagggcatcaatgaccctgtgatctacagcatctcctacagcacccggcccggctggtttgatattggagcagatggagtcatccgggtgaatggcagcctggaccgggagcagctgctggaggctgatgaggaggtgcagctgcaggtgacagccacagagacccacctgaacatctacggccaggaggccaaggtgtccatctgggtgacagtgcgggtgatggatgtgaatgaccacaagccagagttctacaactgcagcctgcctgcctgcaccttcaccccagaggaggcccaggtgaacttcaccggctacgtggatgaacatgccagcccccgcatccccattgatgacctgaccatggtggtgtatgaccctgacaagggcagcaatggcaccttcctgctgagcctgggcggcccagatgctgaggccttctctgtgtccccagagagagctgtgggcagcgcctctgtgcaggtgctggtgcgggtgtctgccctggtggactatgagcggcagacagccatggctgtgcaggtggtggccacagacagcgtgtcccagaacttctctgtggccatggtgaccatccacctgcgggacatcaatgaccaccggcccaccttcccccagagcctgtatgtgctgactgtgcctgagcacagcgccactggatctgtggtgacagacagcatccacgccacagatcctgacaccggggcctggggccagatcacctacagcctgctgcctggaaatggagctgacctcttccaggtggaccctgtgtctggaacagtgacagtgagaaatggagagctgctggaccgggagagccaggccgtgtactacctgaccctgcaggccacagatggcggcaacctgagcagcagcaccaccctgcagatccacctgctggacatcaatgacaatgcccctgtggtgtctggcagctacaacatctttgtgcaggaggaggagggcaatgtgtctgtgaccatccaggcccatgacaatgatgagcccggcaccaacaacagccggctgctcttcaacctgctgcccggcccctacagccacaacttcagcctggaccctgacaccggcctgctgaggaacctgggccccctggaccgggaggccattgatcctgccctggagggcagaattgtgctgactgtgctggtgtctgactgtggggagcctgtgctgggcaccaaggtgaatgtgaccatcaccgtggaggacatcaatgacaacctgcccatcttcaaccagagcagctacaacttcaccgtgaaggaggaggaccccggggtgctggtgggcgtggtgaaggcctgggatgctgaccagacagaggccaacaaccgcatctccttcagcctgagcggcagcggggccaactacttcatgatccggggcctggtgctgggcgccggctgggccgagggctacctgcggctgcccccagatgtgtccctggactatgagacccagcccgtcttcaacctgactgtgtctgcagaaaatccagacccccagggcggggagaccatcgtggatgtgtgtgtgaatgtgaaggatgtgaatgacaacccccccaccctggatgtggccagcctgcggggcatccgggtggccgagaatggcagccagcacggccaggtggccgtggtggtggccagtgatgtggacaccagcgcccagctggagatccagctggtgaacatcctgtgcaccaaggccggcgtggatgtgggcagcctgtgctggggctggttctctgtggccgccaatggatctgtgtacatcaaccagagcaaggccatcgactatgaggcctgtgacctggtgaccctggtggtgcgggcctgtgacctggccacagatcctggcttccaggcctacagcaacaacggcagcctgctgatcaccattgaagatgtgaatgacaatgccccctacttcctgcctgagaacaagacctttgtgatcatccctgagctggtgctgcccaaccgggaggtggcctctgtgcgggccagagatgatgacagcggcaacaatggagtcatcctcttcagcatcctgcgggtggacttcatcagcaaggatggagccaccatccccttccagggcgtcttcagcatcttcaccagcagcgaggctgatgtgtttgctggcagcatccagcctgtgaccagcctggacagcaccctgcagggcacctaccaggtgacagtgcaggcccgggaccggcccagcctgggccccttcctggaggccaccaccaccctgaacctcttcaccgtggaccagagctaccgcagccggctgcagttcagcacccccaaggaggaggtgggcgccaaccggcaggccatcaatgctgccctgacccaggccaccaggaccaccgtgtacatcgtggacatccaggacattgattctgctgcccgggcccggccccacagctacctggatgcctactttgtgttccccaatggaagtgccctgaccctggatgagctgtctgtgatgatcagaaatgaccaggacagcctgacccagctgctgcagctgggcctggtggtgctgggcagccaggagagccaggagagtgacctgagcaagcagctgatcagcgtcatcatcggcctgggcgtggccctgctgctggtgctggtgatcatgaccatggcctttgtgtgtgtgaggaagagctacaacaggaagctgcaggccatgaaggccgccaaggaggccaggaagacagctgctggggtgatgcccagcgccccagccatccctggcaccaacatgtacaacacagagcgggccaaccccatgctgaacctgcccaacaaggacctgggcctggagtacctgagccccagcaatgacctggacagcgtgtctgtgaacagcctggatgacaacagcgtggatgtggacaagaacagccaggagatcaaggagcaccggcccccccacaccccacctgagccagaccctgagcccctgtctgtggtgctgctgggccggcaggccggggccagcggccagctggagggccccagctacaccaatgccggcctggacaccacagacctgtag

SEQ ID NO: 32687 - DNA, 3933 bp, Artificial Sequence; identical to SEQ ID NO: 32686
  Description of Artificial Sequence: Synthetic coding sequence

SEQ ID NO: 32688 - DNA, 3933 bp, Artificial Sequence; identical to SEQ ID NO: 32686
  Description of Artificial Sequence: Synthetic coding sequence

SEQ ID NO: 32689 - DNA, 2658 bp, Artificial Sequence
  Description of Artificial Sequence: Synthetic coding sequence
atgcaggaggccatcatcctgctggccctgctgggcgccatgtctggaggagaggccctgcacctgatcctgctgcctgccactggaaatgtggccgagaacagccccccaggcacctctgtgcacaagttctctgtgaagctgagcgccagcctgagccctgtgattcctggcttcccccagatcgtgaacagcaaccccctgacagaggccttccgggtgaactggctgagcggcacctactttgaggtggtgaccaccggcatggagcagctggactttgagaccggccccaacatctttgacctgcagatctacgtgaaggatgaggtgggcgtgacagacctgcaggtgctgactgtgcaggtgacagatgtgaatgaaccaccccagttccagggcaacctggccgagggcctgcacctgtacatcgtggagcgggccaaccctggcttcatctaccaggtggaggcctttgatcctgaggacaccagcaggaacatccccctgagctacttcctgatcagcccccccaagagcttcaggatgtctgccaacggcaccctcttcagcaccacagagctggactttgaagctggccaccgctccttccacctgattgtggaggtgcgggacagcggcggcctgaaggccagcacagagctgcaggtgaacatcgtgaacctgaatgatgaggtgccccgcttcaccagccccaccagggtgtacacagtgctggaggagctgagccctggcaccatcgtggccaacatcacagcagaagatcctgatgatgagggcttccccagccacctgctgtacagcatcaccaccgtgtccaagtacttcatgatcaaccagctgaccggcaccatccaggtggcccagagaattgacagagatgctggggagctgcggcagaaccccaccatcagcctggaggtgctggtgaaggaccggccctacggcggccaggagaaccgcatccagatcaccttcatcgtggaggatgtgaatgacaacccagccacctgccagaagttcaccttcagcatcatggtgcctgagaggacagccaagggcaccctgctgctggacctgaacaagttctgctttgatgatgacagcgaggcccccaacaaccgcttcaacttcaccatgcccagcggcgtgggcagcggcagccgcttcctgcaggaccctgctggcagcggcaagatcgtgctgattggagacctggactatgagaaccccagcaacctggccgccggcaacaagtacaccgtcatcatccaggtgcaggatgtggccccaccctactacaagaacaacgtgtatgtgtacatcctgaccagcccagaaaatgagttccccctcatctttgaccggcccagctatgtgtttgatgtgtctgaaagaagacctgcccggaccagggtgggccaggtgcgggccacagacaaggacctgccccagagcagcctgctgtacagcatcagcactggaggagccagcctgcagtaccccaacgtgttctggatcaaccccaagacaggagagctgcagctggtgaccaaggtggactgtgagaccacccccatctacatcctgcgcatccaggccaccaacaatgaagacaccagctctgtgacagtgacagtgaacatcctggaggagaatgatgagaagcccatctgcacccccaacagctacttcctggccctgcctgtggacctgaaggtgggcaccaacatccagaacttcaagctgacctgcacagacctggacagcagccccaggagcttccgctacagcatcggccctggaaatgtgaacaaccacttcaccttcagccccaatgccggcagcaatgtgacccggctgctgctgaccagcagatttgattatgccggcggctttgacaagatctgggactacaagctgctggtgtatgtgacagatgacaacctgatgtctgacaggaagaaggccgaggccctggtggagaccggcaccgtgaccctgagcatcaaggtgatcccccaccccaccaccatcatcaccaccaccccccggccccgggtgacctaccaggtgctgaggaagaatgtgtacagccccagcgcctggtacgtgcccttcgtcatcaccctgggcagcatcctgctgctgggcctgctggtgtacctggtggtgctgctggccaaggccatccaccgccactgcccctgcaagacaggcaagaacaaggagcccctgaccaagaagggggagaccaagacagctgagagagatgtggtggtggagaccatccagatgaacaccatctttgatggagaggccatcgaccctgtgactggagagacctatgagttcaacagcaagacaggagccaggaagtggaaggaccccctgacccagatgcccaagtggaaggagagcagccaccagggcgccgccccccggcgggtgacagctggggagggcatgggcagcctgcggagcgccaactgggaggaggatgagctgagcggcaaggcctgggccgaggatgctggcctgggcagcagaaatgaaggaggcaagctgggcaaccccaagaacagaaatcctgccttcatgaacagagcctaccccaagccccaccctgggaagtag

SEQ ID NO: 32690 - DNA, 600 bp, Artificial Sequence
  Description of Artificial Sequence: Synthetic coding sequence
atggtgctgctgcggctgctggtgttcctgtttgcccctgtggtgtctgacctgtgcagcctgccctgcttcatcaacgtgtctgagagccagggccctggcaccgtgctgcagttcctgtccttcaactgcagcagctacacccccacccccaccctggagctgctgaatgtgcagccccccaccaccttcttcaacccccccagcctggcccgctggcagggcacctacgtgggcaagctgaccctgagcagcagcgcccagctggatgccctgatggtgaaccactacaaggtgcagctgaagttcacctgtggcaaccacgtgatggagggcagcctgtctgtggatgtgcagagggacctgagccacatccagtgtgccggccagtttgccagccctggagaggcccggggcagccggcagggcggcggcagacatggcctgagccgcagcagcctgaccagcaccctggcctcctggggcaatgattctggggcccgggacagccacacctggggcagcgctgtgcacagcgccccaccccggcccaggacccccaggtctgctgggaagcccaggacctgggatggcggctag

SEQ ID NO: 32691 - DNA, 2367 bp, Artificial Sequence
  Description of Artificial Sequence: Synthetic coding sequence
atggtgctgctgcggctgctggtgttcctgtttgcccctgtggtgtctgacctgtgcagcctgccctgcttcatcaacgtgtctgagagccagggccctggcaccgtgctgcagttcctgtccttcaactgcagcagctacacccccacccccaccctggagctgctgaatgtgcagccccccaccaccttcttcaacccccccagcctggcccgctggcagggcacctacgtgggcaagctgaccctgagcagcagcgcccagctggatgccctgatggtgaaccactacaaggtgcagctgaagttcacctgtggcaaccacgtgatggagggcagcctgtctgtggatgtgcagagggacctgagccacatccagtgtgccggccagtttgccagccctgctggggagatgatccaggtgcctgagaccgtgacccctggggcccggctgtacaccctgctgctgcccggcctggagctgcacggggcccagatgagcatcatcagcgcccaggacctgccccacttccctggccccttcagcatcaatgagcagggctggctgcaggcccccagccagggcctgctgggccaggcccagaaggtgttccagctgcagatctctgtgtcctttggccagaggcagagctgccagggcatggtgattgtgaaggtgctgcctgtgcccagcagccaggtgtccttcctggagcaggcccagaacatcaccatccctgagaacctggcccctggcagcgaggtggtgcaggtgcaggcccggggcgtggacctgcgctatgagatcctgagccctgtgcccagccccctcttcagcatcggccgggcagatggagtggtgaggaccaccacccccctggagctggcccggaccagcggcacagctgtgtcccggctgcaggtgaaggcctttgagcagggccagctgtgggccagcgccaagctgaacctgaccatgaatgtgcagctggtgaacctgtggcccccacgctgcctgcctgccctgctggtgtcccagatccctgagacagcccctgtgggcaccgtgctgaacaccctgacctgtgaagatcctgattctgtgggcgccaccctggactacaagctgtggttccgcagcagcagcaacccagccagcctgtgcctgtatgacagagtgctggaggtgaatgccaccctggactgtgacacccctggggcctgcttccagcacgccgccagcatcctggtgctggatggcggccagccccagatgaccacagaggtgcctgtgctggtgatggtgacccccatcaatgagttctccccagcctgtgcccccaggaccttccgggtgcaggaggatgctgccccccacaccctgctgggctctgtggtgggcacagacatggactacccccatgacaacatcgagtactacaccagcggcggccccaccacctttgctgtggaccggctgagcggggaggtgcacctgctgggccccctggactatgagcagcagaggctgtaccgcctgactgtgctggtgattgaccacggccaggaccagaaccccaaccaccacctgagcggcagctgcaccatcaccatcgaggtggaggatgtgaatgaccacgccccagaatgtgagccccccttccaggagctgaccatctatgcccccctgggccgctctgtggaggtgaccaagatgagctgccagatcccccaggagccccagaggctcatctacagctacagcatcgtgggcggcaacagccagaaccgcttcatcctgcagggcgccatcctggtgcacagcgacctggtgctgggccccttctggccagagcagcccaggacctatgagctgctgatctgtgtggctgatgctggccccagcaccccccacctgagcaccacagccaccatcatcgtgcacctggtgccccggcgggccagcacagtggccaccagcacccacaggaccaccgtgcccagcaccatgacccccatgctggtgacagacacagaggccttctggcagccccagccctggtttgtggtggtgctgacagccactggagccctgctgctgctggccctgggctggctgctgggccgcctgctgcagggcctggcccagctgctgcaggcccccagcaagccagcccaggccctgctgctgaacagcatccagggcacagagggcagcattgagggcttcctggaggcccccaagatggagatgagccaggcccccagctctgtgatgagcctgcactttgatggccgggcccaggacagcaggacaggccgggactacctgttcaacacccacactggagcccggcgctggctgtag

SEQ ID NO: 32692 - DNA, 684 bp, Artificial Sequence
  Description of Artificial Sequence: Synthetic coding sequence
atgggcaactgtgtgaagtaccccctgaggaacctgagcaggaagatgtgccaggaggagcagaccagctacatggtggtgcagaccagcgaggagggcctggccgcagatgctgagctgcccggccccctgctgatgctggcccagaactgtgctgtgatgcacaacctgctgggccctgcctgcatcttcctgaggaaaggatttgctgaaaatcggcagcctgacaggagcctgcggcctgaggagattgaggagctgcgggaggccttccgggagtttgacaaggacaaggatggctacatcaactgccgggacctgggcaactgcatgaggaccatgggctacatgcccacagagatggagctgattgagctgagccagcagatcaacatgaacctgggcggccacgtggactttgatgactttgtggagctgatgggccccaagctgctggccgagacagctgacatgattggagtgaaggagctgagagatgccttccgggagtttgacaccaatggagatggagagatcagcaccagcgagctgcgggaggccatgaggaagctgctgggccaccaggtgggccaccgggacatcgaggagatcatcagagatgtggacctgaatggagatggccgggtggactttgaggagtttgtgaggatgatgagcaggtag

SEQ ID NO: 32693 - DNA, 1113 bp, Artificial Sequence
  Description of Artificial Sequence: Synthetic coding sequence
atgggcggcggagatggagctgccttcaagaggcctggagatggagcccggctgcagagggtgctgggcctgggcagcagaagagagcccaggagcctgcctgctgggggccctgcccccaggagaacagcccctcctcctcctggccacgccagcgctggccctgctgccatgagcagccacatcgccaagtctgagagcaagaccagcctgctgaaggctgctgctgctgctgccagcggcggcagccgggcccccaggcatggccctgcccgggaccccggcctgcccagccggcggctgcccggcagctgcccagccaccccccagagcagcggggaccccagcagccggcggcccctgtgcaggcctgccccccgggaggagggcgcccggggcagccagagggtgctgccccaggcccactgccggccccgggaggccctgcctgctgctgccagccggcccagccccagcagccccctgcccccagcccggggcagagatggagaggagcggggcctgagccctgccctgggcctgcggggcagcctgcgggcccggggccgcggggacagcgtgcctgctgctgccagcgaggccgaccccttcctgcaccggctgcggcccatgctgagcagcgccttcggccaggacaggagcctgcggcctgaggagattgaggagctgcgggaggccttccgggagtttgacaaggacaaggatggctacatcaactgccgggacctgggcaactgcatgaggaccatgggctacatgcccacagagatggagctgattgagctgagccagcagatcaacatgaacctgggcggccacgtggactttgatgactttgtggagctgatgggccccaagctgctggccgagacagctgacatgattggagtgaaggagctgagagatgccttccgggagtttgacaccaatggagatggagagatcagcaccagcgagctgcgggaggccatgaggaagctgctgggccaccaggtgggccaccgggacatcgaggagatcatcagagatgtggacctgaatggagatggccgggtggactttgaggagtttgtgaggatgatgagcaggtag

SEQ ID NO: 32694 - DNA, 504 bp, Artificial Sequence
  Description of Artificial Sequence: Synthetic coding sequence
atgggcaactgtgtgaagtaccccctgaggaacctgagcaggaaggacaggagcctgcggcctgaggagattgaggagctgcgggaggccttccgggagtttgacaaggacaaggatggctacatcaactgccgggacctgggcaactgcatgaggaccatgggctacatgcccacagagatggagctgattgagctgagccagcagatcaacatgaacctgggcggccacgtggactttgatgactttgtggagctgatgggccccaagctgctggccgagacagctgacatgattggagtgaaggagctgagagatgccttccgggagtttgacaccaatggagatggagagatcagcaccagcgagctgcgggaggccatgaggaagctgctgggccaccaggtgggccaccgggacatcgaggagatcatcagagatgtggacctgaatggagatggccgggtggactttgaggagtttgtgaggatgatgagcaggtag

SEQ ID NO: 32695 - DNA, 1266 bp, Artificial Sequence
  Description of Artificial Sequence: Synthetic coding sequence
atggtggagatgctgcccacagccatcctgctggtgctggccgtgtctgtggtggccaaggacaatgccacctgtgatggcccctgtggcctgcgcttccggcagaacccccagggcggcgtgagaattgtgggcggcaaggccgcccagcacggggcctggccctggatggtgtccctgcagatcttcacctacaacagccaccgctaccacacctgtggcggcagcctgctgaacagccgctgggtgctgacagctgcccactgctttgtgggcaagaacaacgtgcatgactggaggctggtgtttggagccaaggagatcacctacggcaacaacaagcctgtgaaggcccccctgcaggagcgctacgtggagaagatcatcatccacgagaagtacaacagcgccacagagggcaatgacatcgccctggtggagatcaccccacccatcagctgtggccgcttcatcggccctggctgcctgccccacttcaaggccggcctgccccggggcagccagagctgctgggtggccggctggggctacatcgaggagaaggccccccggcccagcagcatcctgatggaggcccgggtggacctgattgacctggacctgtgcaacagcacccagtggtacaacggccgggtgcagcccaccaacgtgtgtgccggctaccctgtgggcaagattgacacctgccagggcgacagcggcggccccctgatgtgcaaggacagcaaggagagcgcctacgtggtggtgggcatcacctcctggggcgtgggctgtgcccgggccaagaggcctggcatctacacagccacctggccctacctgaactggatcgccagcaagattggcagcaatgccctgaggatgatccagagcgccaccccacctccacccaccacccggcccccacccatccggccccccttcagccaccccatcagcgcccacctgccctggtacttccagcccccaccccggcccctgccccccaggcctcctgctgcccagccccggcccccacccagccccccacctcctcctcctcctccagccagccccctgcccccacctcctcctcctcctccacccacccccagcagcaccaccaagctgccccagggcctgagctttgccaagaggctgcagcagctgattgaggtgctgaagggcaagacctacagtgatggcaagaaccactatgacatggagaccacagagctgcctgagctgaccagcaccagctag

SEQ ID NO: 32696 - DNA, 3333 bp, Artificial Sequence
  Description of Artificial Sequence: Synthetic coding sequence
atggctgctggctgcctgctggccctgaccctgaccctcttccagagcctgctgattggccccagcagcgaggagcccttccccagcgctgtgaccatcaagtcctgggtggacaagatgcaggaggacctggtgaccctggccaagacagccagcggcgtgaaccagctggtggacatctatgagaagtaccaggacctgtacacagtggagcccaacaatgcccggcagctggtggagattgctgcccgggacatcgagaagctgctgagcaacagaagcaaggccctggtgcggctggccctggaggccgagaaggtgcaggccgcccaccagtggagagaagattttgccagcaatgaggtggtgtactacaatgccaaggatgacctggaccctgagaagaatgacagcgagcccggcagccagaggatcaagcctgtgttcattgaagatgccaactttggccggcagatctcctaccagcacgccgctgtgcacatccccacagacatctatgagggcagcaccatcgtgctgaatgagctgaactggaccagcgccctggatgaggtgttcaagaagaaccgggaggaggaccccagcctgctgtggcaggtgtttggcagcgccaccggcctggcccgctactacccagccagcccctgggtggacaacagcaggacccccaacaagattgacctgtatgatgtgagaagaagaccctggtacatccagggcgccgccagccccaaggacatgctgatcctggtggatgtgtctggctctgtgtctggcctgaccctgaagctgatccgcacctctgtgtctgagatgctggagaccctgagtgatgatgactttgtgaatgtggccagcttcaacagcaatgcccaggatgtgtcctgcttccagcacctggtgcaggccaacgtgaggaacaagaaggtgctgaaggatgctgtgaacaacatcacagccaagggcatcacagactacaagaagggcttctcctttgcctttgagcagctgctgaactacaacgtgtcccgggccaactgcaacaagatcatcatgctgttcacagatggaggagaggagcgggcccaggagatcttcaacaagtacaacaaggacaagaaggtgcgggtcttcaccttctctgtgggccagcacaactatgaccggggccccatccagtggatggcctgtgaaaataaaggctactactatgagatccccagcatcggggccatccgcatcaacacccaggagtacctggatgtgctgggccggcccatggtgctggccggggacaaggccaagcaggtgcagtggaccaacgtgtacctggatgccctggagctgggcctggtgatcaccggcaccctgcctgtgttcaacatcaccggccagtttgagaacaagaccaacctgaagaaccagctgatcctgggcgtgatgggcgtggatgtgtccctggaggacatcaagaggctgaccccccgcttcaccctgtgccccaacggctactactttgccatcgaccccaacggctacgtgctgctgcaccccaacctgcagcccaagcccatcggcgtgggcatccccaccatcaacctgaggaagaggcggcccaacatccagaaccccaagagccaggagcctgtgaccctggacttcctggatgctgagctggagaatgacatcaaggtggagatccggaacaagatgattgatggagagagcggggagaagaccttccgcaccctggtgaagagccaggatgagcgctacatcgacaagggcaacagaacctacacctggacccctgtgaatggaacagactacagcctggccctggtgctgcccacctacagcttctactacatcaaggccaagctggaggagaccatcacccaggcccgctgcaagtactgtgagaggagtgacagcgagaccctgaagccagacaactttgaggagagcggctacaccttcatcgccccccgggactactgcaatgacctgaagatcagtgacaacaacacagagttcctgctgaacttcaatgagttcatcgacaggaagacccccaacaaccccagctgcaatgctgacctgatcaacagagtgctgctggatgctggcttcaccaatgagctggtgcagaactactggagcaagcagaagaacatcaagggcgtgaaggccaggtttgtggtgacagatggcggcatcaccagggtgtaccccaaggaggccggggagaactggcaggagaaccctgagacctatgaagattccttctacaagaggagcctggacaatgacaactacgtgttcaccgccccctacttcaacaagagcggccctggggcctatgaaagtggcatcatggtgtccaaggctgtggagatctacatccagggcaagctgctgaagccagctgtggtgggcatcaagattgatgtgaacagctggattgagaacttcaccaagaccagcatccgggacccctgtgccggccctgtgtgtgactgcaagaggaacagtgatgtgatggactgtgtgatcctggatgatggcggcttcctgctgatggccaaccatgatgactacaccaaccagatcggccgcttcttcggggagattgaccccagcctgatgaggcacctggtgaacatctctgtgtatgccttcaacaagagctatgactaccagagcgtgtgtgagcctggagctgcccccaagcagggcgccggccacaggtctgcctacgtgcccagcgtggccgacatcctgcagatcggctggtgggccacagctgctgcctggagcatcctgcagcagttcctgctgagcctgaccttcccccggctgctggaggccgtggagatggaggatgatgacttcaccgccagcctgagcaagcagagctgcatcacagagcagacccagtacttctttgacaatgacagcaagagcttcagcggcgtgctggactgtggcaactgcagccgcatcttccatggagagaagctgatgaacaccaacctgatcttcatcatggtggagagcaagggcacctgcccctgtgacacccggctgctgatccaggccgagcagaccagtgatggccccaacccctgtgacatggtgaagcagccccgctacagaaaaggaccagatgtgtgctttgacaacaacgtgctggaggactacacagactgtggcggcgtgtctggcctgaaccccagcctgtggtacatcatcggcatccagttcctgctgctgtggctggtgtctggcagcacccaccggctgctgtag

SEQ ID NO: 32697 - DNA, 3312 bp, Artificial Sequence
  Description of Artificial Sequence: Synthetic coding sequence
atggctgctggctgcctgctggccctgaccctgaccctcttccagagcctgctgattggccccagcagcgaggagcccttccccagcgctgtgaccatcaagtcctgggtggacaagatgcaggaggacctggtgaccctggccaagacagccagcggcgtgaaccagctggtggacatctatgagaagtaccaggacctgtacacagtggagcccaacaatgcccggcagctggtggagattgctgcccgggacatcgagaagctgctgagcaacagaagcaaggccctggtgcggctggccctggaggccgagaaggtgcaggccgcccaccagtggagagaagattttgccagcaatgaggtggtgtactacaatgccaaggatgacctggaccctgagaagaatgacagcgagcccggcagccagaggatcaagcctgtgttcattgaagatgccaactttggccggcagatctcctaccagcacgccgctgtgcacatccccacagacatctatgagggcagcaccatcgtgctgaatgagctgaactggaccagcgccctggatgaggtgttcaagaagaaccgggaggaggaccccagcctgctgtggcaggtgtttggcagcgccaccggcctggcccgctactacccagccagcccctgggtggacaacagcaggacccccaacaagattgacctgtatgatgtgagaagaagaccctggtacatccagggcgccgccagccccaaggacatgctgatcctggtggatgtgtctggctctgtgtctggcctgaccctgaagctgatccgcacctctgtgtctgagatgctggagaccctgagtgatgatgactttgtgaatgtggccagcttcaacagcaatgcccaggatgtgtcctgcttccagcacctggtgcaggccaacgtgaggaacaagaaggtgctgaaggatgctgtgaacaacatcacagccaagggcatcacagactacaagaagggcttctcctttgcctttgagcagctgctgaactacaacgtgtcccgggccaactgcaacaagatcatcatgctgttcacagatggaggagaggagcgggcccaggagatcttcaacaagtacaacaaggacaagaaggtgcgggtcttcaccttctctgtgggccagcacaactatgaccggggccccatccagtggatggcctgtgaaaataaaggctactactatgagatccccagcatcggggccatccgcatcaacacccaggagtacctggatgtgctgggccggcccatggtgctggccggggacaaggccaagcaggtgcagtggaccaacgtgtacctggatgccctggagctgggcctggtgatcaccggcaccctgcctgtgttcaacatcaccggccagtttgagaacaagaccaacctgaagaaccagctgatcctgggcgtgatgggcgtggatgtgtccctggaggacatcaagaggctgaccccccgcttcaccctgtgccccaacggctactactttgccatcgaccccaacggctacgtgctgctgcaccccaacctgcagcccaagcccatcggcgtgggcatccccaccatcaacctgaggaagaggcggcccaacatccagaaccccaagagccaggagcctgtgaccctggacttcctggatgctgagctggagaatgacatcaaggtggagatccggaacaagatgattgatggagagagcggggagaagaccttccgcaccctggtgaagagccaggatgagcgctacatcgacaagggcaacagaacctacacctggacccctgtgaatggaacagactacagcctggccctggtgctgcccacctacagcttctactacatcaaggccaagctggaggagaccatcacccaggcccgctacagcgagaccctgaagccagacaactttgaggagagcggctacaccttcatcgccccccgggactactgcaatgacctgaagatcagtgacaacaacacagagttcctgctgaacttcaatgagttcatcgacaggaagacccccaacaaccccagctgcaatgctgacctgatcaacagagtgctgctggatgctggcttcaccaatgagctggtgcagaactactggagcaagcagaagaacatcaagggcgtgaaggccaggtttgtggtgacagatggcggcatcaccagggtgtaccccaaggaggccggggagaactggcaggagaaccctgagacctatgaggacagcttctacaagaggagcctggacaatgacaactacgtgttcaccgccccctacttcaacaagagcggccctggggcctatgagagcggcatcatggtgtccaaggctgtggagatctacatccagggcaagctgctgaagccagctgtggtgggcatcaagattgatgtgaacagctggattgagaacttcaccaagaccagcatccgggacccctgtgccggccctgtgtgtgactgcaagaggaacagtgatgtgatggactgtgtgatcctggatgatggcggcttcctgctgatggccaaccatgatgactacaccaaccagatcggccgcttctttggagaaattgaccccagcctgatgaggcacctggtgaacatctctgtgtatgccttcaacaagagctatgactaccagagcgtgtgtgagcccggggccgcccccaagcagggcgccggccacaggtctgcctacgtgcccagcgtggccgacatcctgcagatcggctggtgggccacagctgctgcctggagcatcctgcagcagttcctgctgagcctgaccttcccccggctgctggaggccgtggagatggaggatgatgacttcaccgccagcctgagcaagcagagctgcatcacagagcagacccagtacttctttgacaatgacagcaagagcttctctggagtgctggactgtggcaactgcagccgcatcttccacggggagaagctgatgaacaccaacctgatcttcatcatggtggagagcaagggcacctgcccctgtgacacccggctgctgatccaggccgagcagaccagtgatggccccaacccctgtgacatggtgaagcagccccgctacaggaagggcccagatgtgtgctttgacaacaacgtgctggaggactacacagactgtggcggcgtgtctggcctgaaccccagcctgtggtacatcatcggcatccagttcctgctgctgtggctggtgtctggcagcacccaccggctgctgtag

SEQ ID NO: 32698 - DNA, 3276 bp, Artificial Sequence
  Description of Artificial Sequence: Synthetic coding sequence
atggctgctggctgcctgctggccctgaccctgaccctcttccagagcctgctgattggccccagcagcgaggagcccttccccagcgctgtgaccatcaagtcctgggtggacaagatgcaggaggacctggtgaccctggccaagacagccagcggcgtgaaccagctggtggacatctatgagaagtaccaggacctgtacacagtggagcccaacaatgcccggcagctggtggagattgctgcccgggacatcgagaagctgctgagcaacagaagcaaggccctggtgcggctggccctggaggccgagaaggtgcaggccgcccaccagtggagagaagattttgccagcaatgaggtggtgtactacaatgccaaggatgacctggaccctgagaagaatgacagcgagcccggcagccagaggatcaagcctgtgttcattgaagatgccaactttggccggcagatctcctaccagcacgccgctgtgcacatccccacagacatctatgagggcagcaccatcgtgctgaatgagctgaactggaccagcgccctggatgaggtgttcaagaagaaccgggaggaggaccccagcctgctgtggcaggtgtttggcagcgccaccggcctggcccgctactacccagccagcccctgggtggacaacagcaggacccccaacaagattgacctgtatgatgtgagaagaagaccctggtacatccagggcgccgccagccccaaggacatgctgatcctggtggatgtgtctggctctgtgtctggcctgaccctgaagctgatccgcacctctgtgtctgagatgctggagaccctgagtgatgatgactttgtgaatgtggccagcttcaacagcaatgcccaggatgtgtcctgcttccagcacctggtgcaggccaacgtgaggaacaagaaggtgctgaaggatgctgtgaacaacatcacagccaagggcatcacagactacaagaagggcttctcctttgcctttgagcagctgctgaactacaacgtgtcccgggccaactgcaacaagatcatcatgctgttcacagatggaggagaggagcgggcccaggagatcttcaacaagtacaacaaggacaagaaggtgcgggtcttcaccttctctgtgggccagcacaactatgaccggggccccatccagtggatggcctgtgaaaataaaggctactactatgagatccccagcatcggggccatccgcatcaacacccaggagtacctggatgtgctgggccggcccatggtgctggccggggacaaggccaagcaggtgcagtggaccaacgtgtacctggatgccctggagctgggcctggtgatcaccggcaccctgcctgtgttcaacatcaccggccagtttgagaacaagaccaacctgaagaaccagctgatcctgggcgtgatgggcgtggatgtgtccctggaggacatcaagaggctgaccccccgcttcaccctgtgccccaacggctactactttgccatcgaccccaacggctacgtgctgctgcaccccaacctgcagcccaagaaccccaagagccaggagcctgtgaccctggacttcctggatgctgagctggagaatgacatcaaggtggagatccggaacaagatgattgatggagagagcggggagaagaccttccgcaccctggtgaagagccaggatgagcgctacatcgacaagggcaacagaacctacacctggacccctgtgaatggaacagactacagcctggccctggtgctgcccacctacagcttctactacatcaaggccaagctggaggagaccatcacccaggcccggagcaagaagggcaagatgaaggacagcgagaccctgaagccagacaactttgaggagagcggctacaccttcatcgccccccgggactactgcaatgacctgaagatcagtgacaacaacacagagttcctgctgaacttcaatgagttcatcgacaggaagacccccaacaaccccagctgcaatgctgacctgatcaacagagtgctgctggatgctggcttcaccaatgagctggtgcagaactactggagcaagcagaagaacatcaagggcgtgaaggccaggtttgtggtgacagatggcggcatcaccagggtgtaccccaaggaggccggggagaactggcaggagaaccctgagacctatgaggacagcttctacaagaggagcctggacaatgacaactacgtgttcaccgccccctacttcaacaagagcggccctggggcctatgagagcggcatcatggtgtccaaggctgtggagatctacatccagggcaagctgctgaagccagctgtggtgggcatcaagattgatgtgaacagctggattgagaacttcaccaagaccagcatccgggacccctgtgccggccctgtgtgtgactgcaagaggaacagtgatgtgatggactgtgtgatcctggatgatggcggcttcctgctgatggccaaccatgatgactacaccaaccagatcggccgcttctttggagaaattgaccccagcctgatgaggcacctggtgaacatctctgtgtatgccttcaacaagagctatgactaccagagcgtgtgtgagcccggggccgcccccaagcagggcgccggccacaggtctgcctacgtgcccagcgtggccgacatcctgcagatcggctggtgggccacagctgctgcctggagcatcctgcagcagttcctgctgagcctgaccttcccccggctgctggaggccgtggagatggaggatgatgacttcaccgccagcctgagcaagcagagctgcatcacagagcagacccagtacttctttgacaatgacagcaagagcttctctggagtgctggactgtggcaactgcagccgcatcttccacggggagaagctgatgaacaccaacctgatcttcatcatggtggagagcaagggcacctgcccctgtgacacccggctgctgatccaggccgagcagaccagtgatggccccaacccctgtgacatggtgaagcagccccgctacaggaagggcccagatgtgtgctttgacaacaacgtgctggaggactacacagactgtggcggcgtgtctggcctgaaccccagcctgtggtacatcatcggcatccagttcctgctgctgtggctggtgtctggcagcacccaccggctgctgtag

SEQ ID NO: 32699 - DNA, 912 bp, Artificial Sequence
  Description of Artificial Sequence: Synthetic coding sequence
atggtgggcctgcctgagttcatccccaagatcgtgggcatcaagattgatgtgaacagctggattgagaacttcaccaagaccagcatccgggacccctgtgccggccctgtgtgtgactgcaagaggaacagtgatgtgatggactgtgtgatcctggatgatggcggcttcctgctgatggccaaccatgatgactacaccaaccagatcggccgcttctttggagaaattgaccccagcctgatgaggcacctggtgaacatctctgtgtatgccttcaacaagagctatgactaccagagcgtgtgtgagcccggggccgcccccaagcagggcgccggccacaggtctgcctacgtgcccagcgtggccgacatcctgcagatcggctggtgggccacagctgctgcctggagcatcctgcagcagttcctgctgagcctgaccttcccccggctgctggaggccgtggagatggaggatgatgacttcaccgccagcctgagcaagcagagctgcatcacagagcagacccagtacttctttgacaatgacagcaagagcttctctggagtgctggactgtggcaactgcagccgcatcttccacggggagaagctgatgaacaccaacctgatcttcatcatggtggagagcaagggcacctgcccctgtgacacccggctgctgatccaggccgagcagaccagtgatggccccaacccctgtgacatggtgaagcagccccgctacaggaagggcccagatgtgtgctttgacaacaacgtgctggaggactacacagactgtggcggcgtgtctggcctgaaccccagcctgtggtacatcatcggcatccagttcctgctgctgtggctggtgtctggcagcacccaccggctgctgtag

SEQ ID NO: 32700 - DNA, 984 bp, Artificial Sequence
  Description of Artificial Sequence: Synthetic coding sequence
atggtgcgctgtgaccggggcctgcagatgctgctgaccacagctggggcctttgctgccttcagcctgatggccatcgccatcggcacagactactggctgtacagcagcgcccacatctgcaatggcaccaacctgaccatggatgatggccccccaccaagaagagcccggggggacctgacccacagcggcctgtggagggtgtgctgcatcgagggcatctacaagggccactgcttccgcatcaaccacttccctgaggacaatgactatgaccatgacagcagcgagtacctgctgagaattgtgcgggccagcagcgtcttccccatcctgagcaccatcctgctgctgctgggcggcctgtgcattggagctggccgcatctacagcaggaagaacaacatcgtgctgtctgctggcatcctgtttgtggccgccggcctgagcaacatcatcggcatcatcgtgtacatcagcagcaacacaggagaccccagcgacaagagagatgaggacaagaagaaccactacaactacggctggagcttctactttggagccctgtccttcatcgtggccgagaccgtgggcgtgctggccgtgaacatctacatcgagaagaacaaggagctgcgcttcaagaccaagcgggagttcctgaaggccagcagcagcagcccctatgccaggatgcccagctaccgctacagaagaagaagaagccgcagcagcagccgcagcacagaggccagccccagcagagatgtgagccccatgggcctgaagatcaccggggccatccccatgggagagctgtccatgtacaccctgagccgggagcccctgaaggtgaccacagctgccagctacagcccagaccaggaggccagcttcctgcaggtgcatgacttcttccagcaggacctgaaggagggcttccacgtgtccatgctgaacagaaggaccacccctgtgtag

SEQ ID NO: 32701 - DNA, 6120 bp, Artificial Sequence
  Description of Artificial Sequence: Synthetic coding sequence
gagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaagggggccggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctcttcgtcatcatcatctatgccatcatcggcctggagctgttcatgggcaagatgcacaagacctgctacaaccaggagggcattgctgatgtgcctgcagaagatgaccccagcccctgtgccctggagactggacatggccggcagtgccagaatggaacagtgtgcaagccaggctgggatggccccaagcacggcatcaccaactttgacaactttgcctttgccatgctgaccgtcttccagtgcatcaccatggagggctggacagatgtgctgtactggatgcaggatgccatgggctatgagctgccctgggtgtactttgtgtccctggtgatcttcggcagcttctttgtgctgaacctggtgctgggcgtgctgagcggggagttcagcaaggagcgggagaaggccaaggcccggggggacttccagaagctgcgggagaagcagcagctggaggaggacctgaagggctacctggactggatcacccaggccgaggacatcgaccctgaaaatgaagatgagggcatggatgaggagaagcccaggaacatgtccatgcccaccagcgagacagagagcgtgaacacagaaaatgtggccggcggggacattgaaggagagaactgtggggcccggctggcccaccgcatcagcaagagcaagttcagccgctactggaggcgctggaaccgcttctgcagaagaaaatgtagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagacccggcgcagcacctttgacaacttcccccagagcctgctgactgtgttccagatcctgactggagaggactggaacagcgtgatgtatgatggcatcatggcctacggcggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccaccggggaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccacagaattgtgaatgacaccatcttcaccaacctgatcctcttcttcatcctgctgagcagcatcagcctggccgcagaagatcctgtgcagcacaccagcttcaggaaccacatcctcttctactttgatattgtgttcaccaccatcttcaccattgaaattgccctgaagatgacagcctacggggccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtgattgtgaccaccctgctgcagttcatgtttgcctgcattggagtgcagctgttcaagggcaagctgtacacctgcagcgacagcagcaagcagacagaagcagaatgtaaaggaaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaagataaaggccccatctacaactacagagtggagatcagcatcttcttcatcatctacatcatcatcatcgccttcttcatgatgaacatctttgtgggctttgtgattgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaacaggatgcactgctgtgacatgctggatggcggcaccttccccccagccctgggcccccggcgggccccaccctgcctgcaccagcagctgcagggcagcctggccggcctgcgggaggacaccccctgcatcgtgcccggccacgccagcctgtgctgcagcagccgggtgggggagtggctgcctgctggctgcacagccccccagcacgcccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 32702 - DNA, 6522 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacatgtccatgcccaccagcgagacagaatctgtgaacacagaaaatgtggccggcggggacatcgagggggagaactgtggggcccggctggcccaccgcatcagcaagagcaagttcagccgctactggaggcgctggaaccgcttctgcaggaggaagtgcagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagaccaggaggagcacctttgacaacttcccccagagcctgctgaccgtcttccagatcctgaccggggaggactggaacagcgtgatgtatgatggcatcatggcctatggaggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccactggagaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccaccgcatcgtgaatgacaccatcttcaccaacctgatcctcttcttcatcctgctgagcagcatcagcctggccgctgaggaccctgtgcagcacaccagcttcaggaaccacatcctgggcaatgctgactatgtgttcaccagcatcttcaccctggagatcatcctgaagatgacagcctatggagccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtcatcgtgaccaccctgctgcagttcatgtttgcctgcatcggcgtgcagctgttcaagggcaagctgtacacctgcagcgacagcagcaagcagacagaagctgagtgcaagggcaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaggacaagggccccatctacaactacagagtggagatcagcatcttcttcatcatctacatcatcatcatcgccttcttcatgatgaacatctttgtgggcttcgtcatcgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccaccggggaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatccggcgggccatcagcggggacctgacagctgaggaggagctggacaaggccatgaaggaggccgtgtctgctgcctctgaagatgacatcttcagaagagctgggggcctgtttggaaaccacgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgggagcggcacgtgcccatgtgtgaggacctggagctgcggcgggacagcggcagcgctggcacccaggcccactgcctgctgctgaggaaggccaaccccagccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 32703 - DNA, 6492 bp, Artificial Sequence
  Description of Artificial Sequence: Synthetic coding sequence
atggtgaatgaaaacaccaggatgtacatccctgaggagaaccaccagggcagcaactacggcagccccaggcctgcccacgccaacatgaatgccaatgctgctgctggcctggcccctgagcacatccccacccctggggccgccctgtcctggcaggccgccattgatgctgcccggcaggccaagctgatgggcagcgctggaaatgccaccatcagcacagtgagcagcacccagaggaagaggcagcagtatggcaagcccaagaagcagggcagcaccacagccacccggcccccccgggccctgctgtgcctgaccctgaagaaccccatccggcgggcctgcatcagcatcgtggagtggaagccctttgagatcatcatcctgctgaccatctttgccaactgtgtggccctggccatctacatccccttcccagaagatgacagcaatgccaccaacagcaacctggagcgggtggagtacctgttcctgatcatcttcaccgtggaggccttcctgaaggtgattgcctacggcctgctcttccaccccaatgcctacctgagaaatggctggaacctgctggacttcatcatcgtggtggtgggcctcttcagcgccatcctggagcaggccaccaaggcagatggagccaatgccctgggcggcaaaggagctggctttgatgtgaaggccctgcgggccttccgggtgctgcggcccctgcggctggtgtctggagtgcccagcctgcaggtggtgctgaacagcatcatcaaggccatggtgcccctgctgcacatcgccctgctggtgctgtttgtgatcatcatctatgccatcatcggcctggagctgttcatgggcaagatgcacaagacctgctacaaccaggagggcattgctgatgtgcctgcagaagatgaccccagcccctgtgccctggagaccggccacggccggcagtgccagaatggcaccgtgtgcaagccaggctgggatggccccaagcacggcatcaccaactttgacaactttgcctttgccatgctgactgtgttccagtgcatcaccatggagggctggacagatgtgctgtactgggtgaatgatgctgtgggccgggactggccctggatctactttgtgaccctcatcatcatcggcagcttctttgtgctgaacctggtgctgggcgtgctgtctggagagttcagcaaggagcgggagaaggccaaggcccggggggacttccagaagctgcgggagaagcagcagctggaggaggacctgaagggctacctggactggatcacccaggctgaagatattgatcctgaaaatgaagatgagggcatggatgaggagaagcccaggaacagaggcaccccagctggcatgctggaccagaagaagggcaagtttgcctggttcagccacagcacagagacccacgtgtccatgcccaccagcgagacagagagcgtgaacacagaaaatgtggccggcggggacattgaaggagagaactgtggggcccggctggcccaccgcatcagcaagagcaagttcagccgctactggaggcgctggaaccgcttctgcagaagaaaatgtagagctgctgtgaagagcaatgtgttctactggctggtgatcttcctggtgttcctgaacaccctgaccatcgccagcgagcactacaaccagcccaactggctgacagaggtgcaggacacagccaacaaggccctgctggccctcttcaccgctgagatgctgctgaagatgtacagcctgggcctgcaggcctactttgtgtccctcttcaacagatttgactgctttgtggtgtgtggcggcatcctggagaccatcctggtggagaccaagatcatgagccccctgggcatctctgtgctgcgctgtgtgcggctgctgcgcatcttcaagatcacccgctactggaacagcctgagcaacctggtggccagcctgctgaacagcgtgcgcagcatcgccagcctgctgctgctgctcttcctgttcatcatcatcttcagcctgctgggcatgcagctgtttggaggcaagttcaactttgatgagatgcagacccggcgcagcacctttgacaacttcccccagagcctgctgactgtgttccagatcctgactggagaggactggaacagcgtgatgtatgatggcatcatggcctacggcggccccagcttccctggcatgctggtgtgcatctacttcatcatcctcttcatctgtggcaactacatcctgctgaatgtgttcctggccatcgctgtggacaacctggctgatgctgagagcctgaccagcgcccagaaggaggaggaggaggagaaggagaggaagaagctggccaggacagccagccctgagaagaagcaggagctggtggagaagccagctgtgggggagagcaaggaggagaagattgagctgaagagcatcacagcagatggagagagccccccagccaccaagatcaacatggatgacctgcagcccaatgaaaatgaagacaagagcccctaccccaaccctgagaccaccggggaggaggatgaggaggagcctgagatgcctgtgggcccccggccccggcccctgtctgagctgcacctgaaggagaaggctgtgcccatgcctgaggccagcgccttcttcatcttcagcagcaacaaccgcttccggctgcagtgccacagaattgtgaatgacaccatcttcaccaacctgatcctcttcttcatcctgctgagcagcatcagcctggccgcagaagatcctgtgcagcacaccagcttcaggaaccacatcctcttctactttgatattgtgttcaccaccatcttcaccattgaaattgccctgaagatgacagcctacggggccttcctgcacaagggcagcttctgcaggaactacttcaacatcctggacctgctggtggtgtctgtgtccctcatcagctttggcatccagagcagcgccatcaacgtggtgaagatcctgcgggtgctgcgggtgctgcggcccctgcgggccatcaacagagccaagggcctgaagcacgtggtgcagtgtgtgtttgtggccatccgcaccatcggcaacatcgtgattgtgaccaccctgctgcagttcatgtttgcctgcattggagtgcagctgttcaagggcaagctgtacacctgcagcgacagcagcaagcagacagaagcagaatgtaaaggaaactacatcacctacaaggatggagaggtggaccaccccatcatccagcccaggtcctgggagaacagcaagtttgattttgacaacgtgctggccgccatgatggccctcttcaccgtgtccacctttgagggctggccagagctgctgtaccgcagcattgacagccacacagaagataaaggccccatctacaactacagagtggagatcagcatcttcttcatcatctacatcatcatcatcgccttcttcatgatgaacatctttgtgggctttgtgattgtgaccttccaggagcagggcgagcaggagtacaagaactgtgagctggacaagaaccagaggcagtgtgtggagtatgccctgaaggcccggcccctgcggcgctacatccccaagaaccagcaccagtacaaggtgtggtacgtggtgaacagcacctactttgagtacctgatgtttgtgctgatcctgctgaacaccatctgcctggccatgcagcactacggccagagctgcctcttcaagatcgccatgaacatcctgaacatgctgttcaccggcctcttcaccgtggagatgatcctgaagctgattgccttcaagcccaagcactacttctgtgatgcctggaacacctttgatgccctgattgtggtgggcagcatcgtggacatcgccatcacagaggtgaacccagctgagcacacccagtgcagccccagcatgaatgctgaggagaacagccgcatcagcatcaccttcttccgcctcttccgggtgatgaggctggtgaagctgctgagcagaggagagggcatccgcaccctgctgtggaccttcatcaagagcttccaggccctgccctacgtggccctgctgattgtgatgctgttcttcatctatgctgtgattggcatgcaggtgtttgggaagatcgccctgaatgacaccacagagatcaacagaaacaacaacttccagaccttcccccaggccgtgctgctgctcttccgctgtgccactggagaggcctggcaggacatcatgctggcctgcatgcctgggaagaagtgtgcccctgagagcgagcccagcaacagcacagaaggagagaccccctgtggcagcagctttgctgtgttctacttcatctccttctacatgctgtgtgccttcctgatcatcaacctgtttgtggccgtcatcatggacaactttgactacctgacccgggactggagcatcctgggcccccaccacctggatgagttcaagaggatctgggccgagtatgaccctgaggccaagggccgcatcaagcacctggatgtggtgaccctgctgcggcgcatccagccccccctgggctttgggaagctgtgcccccaccgggtggcctgcaagaggctggtgtccatgaacatgcccctgaacagtgatggcaccgtgatgtttaatgccaccctgtttgccctggtgaggacagccctgcgcatcaagacagagggcaacctggagcaggccaatgaggagctgcgggccatcatcaagaagatctggaagaggacctccatgaagctgctggaccaggtggtgcccccagctggagatgatgaggtgacagtgggcaagttctacgccaccttcctgatccaggagtacttcaggaagttcaagaagaggaaggagcagggcctggtgggcaagcccagccagagaaatgccctgagcctgcaggccggcctgcggaccctgcatgacatcggccctgagatcagaagagccatcagcggggacctgacagctgaggaggagctggacaaggccatgaaggaggccgtgtctgctgcctctgaagatgacatcttccggcgggccggcggcctgtttggaaatcatgtgtcctactaccagagtgatggccgcagcgccttcccccagaccttcaccacccagaggcccctgcacatcaacaaggccggcagcagccagggcgacacagagagccccagccatgagaagctggtggacagcaccttcacccccagcagctacagcagcacaggcagcaatgccaacatcaacaatgccaacaacacagccctgggccgcctgcccaggcctgctggctaccccagcacagtgtccacagtggagggccacggcccccccctgagccctgccatccgggtgcaggaggtggcctggaagctgagcagcaaccgctgccacagccgggagagccaggccgccatggccggccaggaggagaccagccaggatgagacctatgaggtgaagatgaaccacgacacagaggcctgcagcgagcccagcctgctgagcacagagatgctgagctaccaggatgatgagaaccggcagctgaccctgcctgaggaggacaagagggacatccggcagagccccaagaggggcttcctgcggagcgccagcctgggccggcgggccagcttccacctggagtgcctgaagaggcagaaggaccggggcggggacatcagccagaagacagtgctgcccctgcacctggtgcaccaccaggccctggccgtggccggcctgagccccctgctgcagaggagccacagccctgccagcttcccccggccctttgccaccccaccagccaccccaggcagccggggctggccaccccagcctgtgcccaccctgcggctggagggcgtggagagcagcgagaagctgaacagcagcttccccagcatccactgcggctcctgggccgagaccaccccaggcggcggcggcagcagcgctgcccggcgggtgcggcctgtgtccctgatggtgcccagccaggccggggcccctggccggcagttccacggcagcgccagcagcctggtggaggccgtgctgatcagcgagggcctgggccagtttgcccaggaccccaagttcatcgaggtgaccacccaggagctggctgatgcctgtgacatgaccatcgaggagatggagagcgctgctgacaacatcctgagcggcggggccccccagagccccaacggggccctgctgccctttgtgaactgcagagatgctggccaggacagagctggaggagaagaagatgctggctgtgtgcgggcccggggccggcccagcgaggaggagctgcaggacagccgggtgtatgtgagcagcctgtag

SEQ ID NO: 32704 - DNA, 6753 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggagcaaggagaagcagatggccgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32705 - DNA, 7032 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggagcaaggagaagcagatggccgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatccccctggccgagatggaggccctgagcctgaccagcgagatcgtgtctgagcccagctgcagcctggccctgacagatgacagcctgcctgatgacatgcacaccctgctgctgagcgccctggagagcaacatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32706 - DNA, 6516 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggagcaaggagaagcagatggccgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32707 - DNA, 7134 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatccccctggccgagatggaggccctgagcctgaccagcgagatcgtgtctgagcccagctgcagcctggccctgacagatgacagcctgcctgatgacatgcacaccctgctgctgagcgccctggagagcaacatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32708 - DNA, 6786 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32709 - DNA, 4668 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggtgagcccccggctgcggggcggcgctgtggtgaaggaggccggcggcggcaccggcccctgcctggtgatcccagctgacagcggcggcggcggcctgcacgaggagatcagccccagccaccccctgctgagcaaccaccagcacgtggccaagcccagccccagccacagcgcccccaagagcggccccatgggcagcctggccgtgctgaaggatgaggagacagaggcccagaggggctag

SEQ ID NO: 32710 - DNA, 6801 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagaggaggaaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32711 - DNA, 6732 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggaaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32712 - DNA, 6921 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatccccctggccgagatggaggccctgagcctgaccagcgagatcgtgtctgagcccagctgcagcctggccctgacagatgacagcctgcctgatgacatgcacaccctgctgctgagcgccctggagagcaacatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32713 - DNA, 5262 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccagctgtgggcctggagcagcctggagacctggagcgtgaccaggcacacccctgtgcgggcctgggccgtgatgccacccttcggcaccctggcctggcccagctag

SEQ ID NO: 32714 - DNA, 6753 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32715 - DNA, 5208 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggaaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccagctgtgggcctggagcagcctggagacctggagcgtgaccaggcacacccctgtgcgggcctgggccgtgatgccacccttcggcaccctggcctggcccagctag

SEQ ID NO: 32716 - DNA, 5298 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccagctgtgggcctggagcagcctggagacctggagcgtgaccaggcacacccctgtgcgggcctgggccgtgatgccacccttcggcaccctggcctggcccagctag

SEQ ID NO: 32717 - DNA, 6618 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32718 - DNA, 5331 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccagctgtgggcctggagcagcctggagacctggagcgtgaccaggcacacccctgtgcgggcctgggccgtgatgcccccatttggcaccctggcctggcccagctag

SEQ ID NO: 32719 - DNA, 7101 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatccccctggccgagatggaggccctgagcctgaccagcgagatcgtgtctgagcccagctgcagcctggccctgacagatgacagcctgcctgatgacatgcacaccctgctgctgagcgccctggagagcaacatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32720 - DNA, 6999 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32721 - DNA, 6834 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32722 - DNA, 6585 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32723 - DNA, 6897 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagaggaggagcaaggagaagcagatggccgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32724 - DNA, 6699 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagaacttccacaagtgccggcagcaccaggaggaggaggaggcccggcggcgggaggagaagaggctgcggcggctggagaagaagaggaggaaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32725 - DNA, 5277 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagaggaggaaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccagctgtgggcctggagcagcctggagacctggagcgtgaccaggcacacccctgtgcgggcctgggccgtgatgcccccatttggcaccctggcctggcccagctag

SEQ ID NO: 32726 - DNA, 5241 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggccaggagaagagaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacaccctgtgggcctggagcagcctggagacctggagcgtgaccaggcacacccctgtgcgggcctgggccgtgatgcccccatttggcaccctggcctggcccagctag

SEQ ID NO: 32727 - DNA, 6822 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32728 - DNA, 6864 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32729 - DNA, 6720 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32730 - DNA, 6876 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggctgacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32731 - DNA, 6780 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagaggaggaaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32732 - DNA, 6684 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgagggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcccggggccgcccacgagatgaagagccccccatctgcccggagcagcccccacagcccctggagcgctgccagctcctggaccagcagaagaagcagcaggaacagcctgggccgggcccccagcctgaagaggaggagccccagcggggagaggaggagcctgctgagcggggagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgacccccccctggatggagatgatgctgatgatgagggcaacctgagcaaaggagagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgctttggagagcaggcctacctgcggagctcctggaatgtgctggatggcctgctggtgctgatcagcgtcatcgacatcctggtgtccatggtgtctgacagcggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagaacttccacaagtgccggcagcaccaggaggaggaggaggccaggagaagagaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32733 - DNA, 6855 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaaacctgatgctggatgatgtgattgccagcggcagcagcgccagcgctgccagcgaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccaccatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32734 - DNA, 6945 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagaggaggaaggcccagtgcaagccctactacagcgactacagccgcttccggctgctggtgcaccacctgtgcaccagccactacctggacctcttcatcaccggggtgattggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgcgcatcgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatgcagccccaccccacagagctgcccggccctgacctgctgactgtgaggaagagcggcgtgtccaggacccacagcctgcccaatgacagctacatgtgcagacatggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaaaggacctcctgagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagccccccatccatcaccatcgaccccccagagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32735 - DNA, 6966 bp, Artificial Sequence
  Description of Artificial Sequence: Synthetic coding sequence
atggatgaggaggaggatggagctggagctgaggagagcggccagcccaggagcttcatgaggctgaatgacctgagcggggccggcggccggcccggccctggcagcgctgagaaggaccccggcagcgctgacagcgaggccgagggcctgccctacccagccctggcccctgtggtgttcttctacctgagccaggacagccggcccaggtcctggtgcctgaggacagtgtgcaacccctggtttgagcgcatctccatgctggtgatcctgctgaactgtgtgaccctgggcatgttccggccctgtgaagatattgcctgtgacagccagcgctgccgcatcctgcaggcctttgatgacttcatctttgccttctttgctgtggagatggtggtgaagatggtggccctgggcatctttgggaagaagtgctacctgggggacacctggaaccggctggacttcttcatcgtgattgctggcatgctggagtacagcctggacctgcagaatgtgtccttctctgctgtgaggacagtgcgggtgctgcggcccctgcgggccatcaacagagtgcccagcatgaggatcctggtgaccctgctgctggacaccctgcccatgctgggcaatgtgctgctgctgtgcttctttgtgttcttcatctttggaattgtgggcgtgcagctgtgggccggcctgctgaggaaccgctgcttcctgcctgagaacttcagcctgcccctgtctgtggacctggagcgctactaccagacagaaaatgaagatgagagccccttcatctgcagccagccccgggagaatggcatgaggagctgccgctctgtgcccaccctgcggggagatggcggcggcggccccccctgtggcctggactatgaggcctacaacagcagcagcaacaccacctgtgtgaactggaaccagtactacaccaactgcagcgctggggagcacaaccccttcaagggggccatcaactttgacaacatcggctacgcctggatcgccatcttccaggtgatcaccctggagggctgggtggacatcatgtactttgtgatggatgcccacagcttctacaacttcatctacttcatcctgctgatcatcgtgggcagcttcttcatgatcaacctgtgcctggtggtgattgccacccagttcagcgagaccaagcagcgggagagccagctgatgagggagcagagggtgcgcttcctgagcaatgccagcaccctggccagcttcagcgagcccggcagctgctatgaggagctgctgaagtacctggtgtacatcctgaggaaggccgcccggcggctggcccaggtgtccagagctgctggggtgcgggtgggcctgctgagcagccctgcccccctgggcggccaggagacccagcccagcagcagctgcagccgcagccaccggcggctgtctgtgcaccacctggtgcaccaccaccaccaccaccaccaccactaccacctgggcaatggcaccctgcgggccccccgggccagccctgagatccaggacagagatgccaacggcagccggcggctgatgctgcccccacccagcaccccagccctgagcggggcccctcctggaggagctgagagcgtgcacagcttctaccacgccgactgccacctggagcctgtgcgctgccaggcccccccacccaggagccccagcgaggccagcggccgcacagtgggcagcggcaaggtgtaccccaccgtgcacaccagccccccacctgagaccctgaaggagaaggccctggtggaggtggccgccagcagcggcccccccaccctgaccagcctgaacatccccccaggcccctacagctccatgcacaagctgctggagacccagagcactggagcctgccagagcagctgcaagatcagcagcccctgcctgaaggctgacagcggggcctgtggccctgacagctgcccctactgtgcccgggccggggccggggaggtggagctggccgaccgggagatgccagacagcgacagcgaggccgtgtatgagttcacccaggatgcccagcacagcgacctgcgggacccccacagccggcggcagaggagcctgggcccagatgctgagcccagctctgtgctggccttctggaggctcatctgtgacaccttcaggaagatcgtggacagcaagtacttcggccggggcatcatgattgccatcctggtgaacaccctgtccatgggcatcgagtaccacgagcagcctgaggagctgaccaatgccctggagatcagcaacatcgtgttcaccagcctgtttgccctggagatgctgctgaagctgctggtgtatggccccttcggctacatcaagaacccctacaacatctttgatggagtcatcgtggtgatctctgtgtgggagatcgtgggccagcagggcggcggcctgtctgtgctgcggaccttccggctgatgagggtgctgaagctggtgcgcttcctgcctgccctgcagaggcagctggtggtgctgatgaagaccatggacaacgtggccaccttctgcatgctgctgatgctgttcatcttcatcttcagcatcctgggcatgcacctgtttggctgcaagtttgccagcgagagagatggagacaccctgcctgacaggaagaactttgacagcctgctgtgggccatcgtgacagtgttccagatcctgacccaggaggactggaacaaggtgctgtacaacggcatggccagcaccagctcctgggccgccctgtacttcatcgccctgatgaccttcggcaactacgtgctcttcaacctgctggtggccatcctggtggagggcttccaggccgaggagatcagcaagcgggaggatgccagcggccagctgagctgcatccagctgcctgtggacagccagggcggagatgccaacaagtctgagagcgagccagacttcttcagccccagcctggatggagatggagacaggaagaagtgcctggccctggtgtccctgggggagcaccctgagctgaggaagagcctgctgcccccactcatcatccacacagctgccacccccatgagcctgcccaagagcaccagcacaggcctgggggaggccctgggccctgccagcaggaggaccagcagcagcggcagcgctgagcctggagctgcccacgagatgaagagcccccccagcgcccggagcagcccccacagcccctggagcgctgccagctcctggaccagccgccgcagcagcaggaacagcctgggccgggcccccagcctgaagagaagaagccccagcggggagcggcgcagcctgctgtctggagagggccaggagagccaggatgaggaggagagcagcgaggaggagcgggccagccctgctggcagtgaccaccgccaccggggcagcctggagcgggaggccaagagcagctttgacctgcctgacaccctgcaggtgcccggcctgcacaggacagccagcggccggggcagcgccagcgagcaccaggactgcaatggcaagagcgccagcggccgcctggcccgggccctgcggccagatgatcctcccctggatggagatgatgctgatgatgagggcaacctgagcaagggggagcgggtgcgggcctggatccgggcccggctgcctgcctgctgcctggagcgggacagctggagcgcctacatcttccccccccagagccgcttccggctgctgtgccaccgcatcatcacccacaagatgtttgaccacgtggtgctggtgatcatcttcctgaactgcatcaccatcgccatggagcggcccaagattgacccccacagcgctgagcgcatcttcctgaccctgagcaactacatcttcaccgctgtgttcctggccgagatgacagtgaaggtggtggccctgggctggtgcttcggggagcaggcctacctgcggagctcctggaatgtgctggatggcctgctggtgctgatctctgtgattgacatcctggtgtccatggtgtctgattctggcaccaagatcctgggcatgctgcgggtgctgcggctgctgcggaccctgcggcccctgcgggtcatcagccgggcccagggcctgaagctggtggtggagaccctgatgagcagcctgaagcccatcggcaacatcgtggtgatctgctgtgccttcttcatcatcttcggcatcctgggcgtgcagctgttcaagggcaagttctttgtgtgccagggcgaggacaccaggaacatcaccaacaagagtgactgtgccgaggccagctaccgctgggtgcgccacaagtacaactttgacaacctgggccaggccctgatgagcctgtttgtgctggccagcaaggatggctgggtggacatcatgtatgatggcctggatgctgtgggcgtggaccagcagcccatcatgaaccacaacccctggatgctgctgtacttcatctccttcctgctgattgtggccttctttgtgctgaacatgtttgtgggcgtggtggtggagaacttccacaagtgccggcagcaccaggaggaggaggaggcccggcggcgggaggagaagaggctgcggcggctggagaagaagagaagaagcaaggagaagcagatggccgaggcccagtgcaagccctactacagcgactacagccgcttccggctgctggtgcaccacctgtgcaccagccactacctggacctcttcatcactggagtcatcggcctgaatgtggtgaccatggccatggagcactaccagcagccccagatcctggatgaggccctgaagatctgcaactacatcttcaccgtcatctttgtgctggagagcgtcttcaagctggtggccttcggcttccgccgcttcttccaggaccgctggaaccagctggacctggccatcgtgctgctgagcatcatgggcatcaccctggaggagattgaggtgaatgccagcctgcccatcaaccccaccatcatccgcatcatgagggtgctgagaattgcccgggtgctgaagctgctgaagatggctgtgggcatgagggccctgctggacacagtgatgcaggccctgccccaggtgggcaacctgggcctgctcttcatgctgctcttcttcatctttgctgccctgggcgtggagctgtttggagacctggagtgtgatgagacccacccctgtgagggcctgggcagacatgccaccttcaggaactttggcatggccttcctgaccctcttccgggtgtccactggagacaactggaatggcatcatgaaggacaccctgcgggactgtgaccaggagagcacctgctacaacacagtcatcagccccatctactttgtgtcctttgtgctgacagcccagtttgtgctggtgaatgtggtgattgctgtgctgatgaagcacctggaggagagcaacaaggaggccaaggaggaggccgagctggaggccgagctggagctggagatgaagaccctgagcccccagccccacagccccctgggcagccccttcctgtggccaggagtggagggccctgacagcccagacagccccaagccaggggccctgcaccctgctgcccacgcccggagcgccagccacttcagcctggagcaccccacagaccggcagctgtttgacaccatcagcctgctgatccagggcagcctggagtgggagctgaagctgatggatgagctggccggccctgggggccagcccagcgccttccccagcgcccccagcctgggcggcagtgacccccagatgcagccccaccccacagagctgcccggccctgacctgctgactgtgaggaagtctggagtgtccaggacccacagcctgcccaatgacagctacatgtgccgccacggcagcacagctgagggccccctgggccaccggggctggggcctgcccaaggcccagagcggctctgtgctgtctgtgcacagccagcctgctgacaccagctacatcctgcagctgcccaaggatgccccccacctgctgcagccccacagcgcccccacctggggcaccatccccaagctgcccccacctggccgcagccccctggcccagaggcccctgcggcggcaggccgccatcagaacagacagcctggatgtgcagggcctgggcagccgggaggacctgctggccgaggtgtctggccccagcccccccctggcccgggcctacagcttctggggccagagcagcacccaggcccagcagcacagccgcagccacagcaagatcagcaagcacatgaccccaccagccccctgccccggccctgagcccaactggggcaagggccccccagagaccaggagcagcctggagctggacacagagctgtcctggatcagcggggacctgctgcccccaggcggccaggaggagccccccagcccccgggacctgaagaagtgctacagcgtggaggcccagagctgccagaggcggcccacctcctggctggatgagcagaggaggcacagcattgctgtgtcctgcctggacagcggcagccagccccacctgggcacagaccccagcaacctgggcggccagcccctgggcggccctggcagccggcccaagaagaagctgagcccccccagcatcaccattgatcctcctgagagccagggccccaggaccccacccagccctggcatctgcctgcggcggcgggcccccagcagtgacagcaaggaccccctggccagcggccccccagacagcatggccgccagccccagccccaagaaggatgtgctgagcctgagcggcctgagcagtgaccctgctgacctggacccctag

SEQ ID NO: 32736 - DNA, 1035 bp, Artificial Sequence
  Description of Artificial Sequence: Synthetic coding sequence
atggacaagttcaggatgctgttccagcacttccagagcagcagcgagagcgtgatgaatggcatctgcctgctgctggccgctgtgacagtgaagctgtacagcagctttgacttcaactgcccctgcctggtgcactacaatgccctgtatggcctgggcctgctgctgaccccacccctggccctcttcctgtgtggcctgctggccaaccggcagagcgtggtgatggtggaggagtggaggaggcctgctggccacaggaggaaggaccccggcatcatccgctacatgtgcagctctgtgctgcagagggccctggccgcccccctggtgtggatcctgctggccctgctggatggcaagtgctttgtgtgtgccttcagcagctctgtggaccctgagaagttcctggactttgccaacatgacccccagccaggtgcagctgttcctggccaaggtgccctgcaaggaggatgagctggtgcgggacagccctgccaggaaggctgtgagccgctacctgcgctgcctgagccaggccatcggctggagcgtgaccctgctgctgatcatcgccgccttcctggcccgctgcctgcggccctgctttgaccagaccgtcttcctgcagaggcgctactggagcaactacgtggacctggagcagaagctgtttgatgagacctgctgtgagcacgcccgggactttgcccaccgctgtgtgctgcacttctttgcctccatgaggtctgagctgcaggcccggggcctgcggagaggaaatgccggccggcggctggagctgcctgctgtgcctgagcccccagagggcctggacagcggcagcggcaaggcccacctgcgggccatcagcagccgggagcaggtggaccggctgctgagcacctggtacagcagcaagccacccctggacctggccgccagccctggcctgtgtggcggcggcctgagccaccgggcccccaccctggccctgggcacccggctgagccagcacacagatgtgtag

SEQ ID NO: 32737 - DNA, 1431 bp, Artificial Sequence
  Description of Artificial Sequence: Synthetic coding sequence
atgggcaggaaggaggaggatgactgcagctcctggaagaagcagaccaccaacatcaggaagaccttcatcttcatggaggtgctgggcagcggggccttcagcgaggtgttcctggtgaagcagaggctgaccgggaagctgtttgccctgaagtgcatcaagaagagccctgccttccgggacagcagcctggagaatgaaattgctgtgctgaagaagatcaagcatgagaacatcgtgaccctggaggacatctatgagagcaccacccactactacctggtgatgcagctggtgtctggaggagagctgtttgaccgcatcctggagcggggcgtgtacacagagaaggatgccagcctggtgatccagcaggtgctgtctgctgtgaagtacctgcatgaaaatggaattgtgcaccgggacctgaagccagagaacctgctgtacctgaccccagaggagaacagcaagatcatgatcacagactttggcctgagcaagatggagcagaatggcatcatgagcacagcctgtggcaccccaggctacgtggcccctgaggtgctggcccagaagccctacagcaaggctgtggactgctggagcattggagtcatcacctacatcctgctgtgtggctacccacccttctatgaggagacagagagcaagctgtttgagaagatcaaggagggctactatgaatttgagagccccttctgggatgacatcagcgagagcgccaaggacttcatctgccacctgctggagaaggaccccaatgaaagatacacctgtgagaaggccctgagccacccctggattgatggcaacacagccctgcaccgggacatctaccccagcgtgtccctgcagatccagaagaactttgccaagagcaagtggaggcaggccttcaatgctgctgctgtggtgcaccacatgaggaagctgcacatgaacctgcacagccctggggtgcggcctgaggtggagaacagacctcctgagacccaggccagcgagaccagccggcccagcagccctgagatcaccatcacagaggcccctgtgctggaccacagcgtggccctgcctgccctgacccagctgccctgccagcacggcagaagacccacagcccctgggggccgcagcctgaactgcctggtgaatggcagcctgcacatcagcagcagcctggtgcccatgcaccagggcagcctggccgccggcccctgtggctgctgcagcagctgcctgaacatcggcagcaagggcaagagcagctactgcagcgagcccaccctgctgaagaaggccaacaagaagcagaacttcaagtctgaggtgatggtgcctgtgaaggccagcggcagcagccactgcagagctggccagacaggagtgtgcctgatcatgtag

SEQ ID NO: 32738 - DNA, 1431 bp, Artificial Sequence; identical to SEQ ID NO: 32737
  Description of Artificial Sequence: Synthetic coding sequence

SEQ ID NO: 32739 - DNA, 654 bp, Artificial Sequence
  Description of Artificial Sequence: Synthetic coding sequence
atggtgaagctgggctgcagcttcagcggcaagccaggcaaggaccccggggaccaggatggagctgccatggacagcgtgcccctcatcagccccctggacatcagccagctgcagccccccctgcctgaccaggtggtgatcaagacccagacagagtaccagctgagcagcccagaccagcagaacttcccagacctggagggccagaggctgaactgcagccaccctgaggagggccgccgcctgcccacagccaggatgattgcctttgccatggccctgctgggctgtgtgctgatcatgtacaaggccatctggtatgaccagttcacctgcccagatggcttcctgctgcggcacaagatctgcacccccctgaccctggagatgtactacacagagatggaccctgagcggcacaggagcatcctggccgccatcggggcctaccccctgagcaggaagcatggaacagagaccccagctgcctggggagatggctacagagctgccaaggaggagaggaagggccccacccaggccggggctgctgctgctgccacagagcccccaggcaagcccagcgccaaggccgagaaggaggccgccaggaaggccgccggcagcgctgcccctcctccagcccagtag

SEQ ID NO: 32740 - DNA, 477 bp, Artificial Sequence
  Description of Artificial Sequence: Synthetic coding sequence
atggtgaagctgggctgcagcttcagcggcaagccaggcaaggaccccggggaccaggatggagctgccatggacagcgtgcccctcatcagccccctggacatcagccagctgcagccccccctgcctgaccaggtggtgatcaagacccagacagagtaccagctgagcagcccagaccagcagaacttcccagacctggagggccagaggctgaactgcagccaccctgaggagggcagaagagtgaccacccccaccccacccaccgtgggcacccaggacagaagaagacgctggaaggctgctggaggagcctgggtgcccagcaggcctgtgtggggccccctggccctgcgggaggagcgggtggccgtgagccacccagcccagagctggccccaccggctgccctgcacccaccaggcccccagccggggctgccgctgccgcctgaccaagcagtggaggagctag

SEQ ID NO: 32741 - DNA, 375 bp, Artificial Sequence
  Description of Artificial Sequence: Synthetic coding sequence
atggtgaagctgggctgcagcttcagcggcaagccaggcaaggaccccggggaccaggatggagctgccatggacagcgtgcccctcatcagccccctggacatcagccagctgcagccccccctgcctgaccaggtggtgatcaagacccagacagagtaccagctgagcagcccagaccagcagaacttcccagacctggagggccagaggctgaactgcagccaccctgaggagggccgccgcctgcccacagccaggatgattgcctttgccatggccctgctgggctgtgtgctgatcatgtacaaggccatctggtatgaccagttcacctgcccagatggcttcctgctgcggggccctgagttctag

SEQ ID NO: 32742 - DNA, 375 bp, Artificial Sequence; identical to SEQ ID NO: 32741
  Description of Artificial Sequence: Synthetic coding sequence

SEQ ID NO: 32743 - DNA, 1833 bp, Artificial Sequence
  Description of Artificial Sequence: Synthetic coding sequence
atgcacttccaggccttctggctgtgcctgggcctgctcttcatcagcatcaatgctgagttcatggatgatgatgtggagacagaagattttgaagaaaattctgaggagattgatgtgaatgaaagtgagctgagcagcgagatcaagtacaagaccccccagcccatcggggaggtgtactttgctgagacctttgacagcggccgcctggccggctgggtgctgagcaaggccaagaaggatgacatggatgaggagatcagcatctatgatggccgctgggagattgaggagctgaaggagaaccaggtgcctggggaccggggcctggtgctgaagagccgggccaagcaccacgccatctctgctgtgctggccaagcccttcatctttgctgacaagcccctcatcgtgcagtatgaggtgaacttccaggacggcatcgactgtggcggggcctacatcaagctgctggccgacacagatgacctgatcctggagaacttctatgacaagaccagctacatcatcatgtttggaccagacaagtgtggggaggactacaagctgcacttcatcttccgccacaagcaccccaagacaggagtgtttgaggagaagcacgccaagcccccagatgtggacctgaagaagttcttcacagacaggaagacccacctgtacaccctggtgatgaacccagatgacacctttgaggtgctggtggaccagacagtggtgaacaagggcagcctgctggaggatgtggtgccccccatcaagccacccaaggagattgaggaccccaatgacaagaagccagaggagtgggatgagcgggccaagatcccagaccccagcgctgtgaagccagaggactgggatgagagcgagcccgcccagatcgaggacagctctgtggtgaagccagctggctggctggatgatgagcccaagttcatcccagaccccaatgctgagaagccagatgactggaatgaagacacagatggagagtgggaggccccccagatcctgaacccagcctgcagaattggctgtggggagtggaagccacccatgattgacaaccccaagtacaagggcgtgtggaggcctcccctggtggacaaccccaactaccagggcatctggagccccaggaagatccccaacccagactactttgaagatgaccaccccttcctgctgaccagcttcagcgccctgggcctggagctgtggagcatgaccagtgacatctactttgacaacttcatcatctgcagcgagaaggaggtggccgaccactgggccgcagatggctggcgctggaagatcatgattgccaatgccaacaagccaggagtgctgaagcagctgatggctgctgctgagggccacccctggctgtggctgatctacctggtgacagctggggtgcccatcgccctgatcaccagcttctgctggcccaggaaggtgaagaagaagcacaaggacacagagtacaagaagacagacatctgcatcccccagaccaagggcgtgctggagcaggaggagaaggaggagaaggccgccctggagaagcccatggacctggaggaggagaagaagcagaatgatggagagatgctggagaaggaggaggagagcgagcctgaggagaagtctgaggaggagattgagatcatcgagggccaggaggagagcaaccagagcaacaagagcggctctgaagatgagatgaaggaggctgatgagagcacaggcagcggagatggccccatcaagtctgtgaggaagagaagagtgaggaaggactag

SEQ ID NO: 32744 - DNA, 1833 bp, Artificial Sequence; identical to SEQ ID NO: 32743
  Description of Artificial Sequence: Synthetic coding sequence

SEQ ID NO: 32745 - DNA, 540 bp, Artificial Sequence
  Description of Artificial Sequence: Synthetic coding sequence
atgcacttccaggccttctggctgtgcctgggcctgctcttcatcagcatcaatgctgagttcatggatgatgatgtggagacagaagattttgaagaaaattctgaggagattgatgtgaatgaaagtgagctgagcagcgagatcaagtacaagaccccccagcccatcggggaggtgtactttgctgagacctttgacagcggccgcctggccggctgggtgctgagcaaggccaagaaggatgacatggatgaggagatcagcatctatgatggccgctgggagattgaggagctgaaggagaaccaggtgcctggggaccggggcctggtgctgaagagccgggccaagcaccacgccatctctgctgtgctggccaagcccttcatctttgctgacaagcccctcatcgtgcagtatgaggtgaacttccaggacggcatcgactgtggcggggcctacatcaagctgctggccgacacagatgacctgatcctggagaacttctatgacaagaccagctacatcatcatgtag

SEQ ID NO: 32746 - DNA, 1833 bp, Artificial Sequence; identical to SEQ ID NO: 32743
  Description of Artificial Sequence: Synthetic coding sequence

SEQ ID NO: 32747 - DNA, 1584 bp, Artificial Sequence
  Description of Artificial Sequence: Synthetic coding sequence
atggatgaggagatcagcatctatgatggccgctgggagattgaggagctgaaggagaaccaggtgcctggggaccggggcctggtgctgaagagccgggccaagcaccacgccatctctgctgtgctggccaagcccttcatctttgctgacaagcccctgattgtgcagtatgaggtgaacttccaggacggcatcgactgtggcggggcctacatcaagctgctggccgacacagatgacctgatcctggagaacttctatgacaagaccagctacatcatcatgtttggaccagacaagtgtggggaggactacaagctgcacttcatcttccgccacaagcaccccaagacaggagtgtttgaggagaagcacgccaagcccccagatgtggacctgaagaagttcttcacagacaggaagacccacctgtacaccctggtgatgaacccagatgacacctttgaggtgctggtggaccagacagtggtgaacaagggcagcctgctggaggatgtggtgccccccatcaagccacccaaggagattgaggaccccaatgacaagaagccagaggagtgggatgagcgggccaagatcccagaccccagcgctgtgaagccagaggactgggatgaaagtgagcccgcccagatcgaggacagctctgtggtgaagccagctggctggctggatgatgagcccaagttcatcccagaccccaatgctgagaagccagatgactggaatgaagacacagatggagagtgggaggccccccagatcctgaacccagcctgccgcatcggctgtggggagtggaagccacccatgattgacaaccccaagtacaagggcgtgtggaggcctcccctggtggacaaccccaactaccagggcatctggagccccaggaagatccccaacccagactactttgaagatgaccaccccttcctgctgaccagcttcagcgccctgggcctggagctgtggagcatgaccagtgacatctactttgacaacttcatcatctgcagcgagaaggaggtggccgaccactgggccgcagatggctggcgctggaagatcatgattgccaatgccaacaagccaggagtgctgaagcagctgatggctgctgctgagggccacccctggctgtggctgatctacctggtgacagctggggtgcccatcgccctgatcaccagcttctgctggcccaggaaggtgaagaagaagcacaaggacacagagtacaagaagacagacatctgcatcccccagaccaagggcgtgctggagcaggaggagaaggaggagaaggccgccctggagaagcccatggacctggaggaggagaagaagcagaatgatggagagatgctggagaaggaggaggagagcgagcctgaggagaagtctgaggaggagattgagatcatcgagggccaggaggagagcaaccagagcaacaagagcggctctgaagatgagatgaaggaggctgatgagagcactggaagtggagatggccccatcaagtctgtgaggaagagaagagtgaggaaggactag

SEQ ID NO: 32748 - DNA, 3750 bp, Artificial Sequence
  Description of Artificial Sequence: Synthetic coding sequence
atggtggaggccgcccctcctggccctggccccctgcggaggaccttcctggtgcctgagatcaagagcctggaccagtatgacttcagccgggccaaggctgctgccagcctggcctgggtgctgcgggccgccttcggcggcgctgagcacgtgcccccagagctgtgggagcccttctacacagaccagtatgcccaggagcacgtgaagccccctgtgacccggctgctgctgtctgctgagctgtactgccgggcctggaggcaggccctgccccagctggagaccccacccaaccccagcgccctgctggccctgctggcccggcggggcaccgtgcctgccctgcctgagaggcctgtgcgggaggccgacctgcggcaccagcccatcctgatgggcgcccacctggccgtgattgatgccctgatggccgcctttgcctttgagtggaccaagaccctgcccggccccctggccctgaccagcctggagcacaagctgctcttctgggtggacaccaccgtgcggcggctgcaggagaagacagagcaggaggccgcccagagggccagccctgctgccccagcagatggagctgccccagcccagcccagcatccgctacaggaaggacagagtggtggcccggcgggccccctgcttccccaccgtgaccagcctgcaggacctggccagcggggccgccctggccgccaccatccactgctactgcccccagctgctgcggctggaggaggtgtgcctgaaggaccccatgtctgtggccgacagcctgtacaacctgcagctggtgcaggacttctgtgccagccggctgccccggggctgccccctgagcctggaggacctgctgtatgtgcccccacccctgaaggtgaacctggtggtgatgctggccgagctgttcatgtgctttgaggtgctgaagccagactttgtgcaggtgaaggacctgcctgatggccacgccgccagcccccggggcacagaggccagccccccccagaacaacagcggcagcagcagccctgtgttcaccttccgccaccccctgctgagcagcggcggcccccagagccccctgcggggcagcacaggcagcctgaagagcagccccagcatgagccacatggaggccctgggcaaggcctggaaccggcagctgagccggcccctgagccaggccgtgtccttcagcaccccatttggcctggacagtgatgtggatgtggtgatgggagaccctgtgctgctgcggtctgtgtccagtgacagcctgggcccccccaggcctgccccagcccggacccccacccagcccccacctgagcccggggacctgcccaccatcgaggaggccctgcagatcatccacagcgctgagccccggctgctgcctgatggagctgctgatggcagcttctacctgcacagccctgagggccccagcaagcccagcctggccagcccctacctgcctgagggcaccagcaagcccctgagtgaccggcccaccaaggcccctgtgtacatgccccaccctgagacccccagcaagcccagcccctgcctggtgggggaggccagcaagcccccagcccccagcgagggcagccccaaggctgtggccagcagccctgctgccaccaacagcgaggtgaagatgaccagctttgctgagaggaagaagcagctggtgaaggccgaggccgaggccggggccggcagccccaccagcaccccagcccctcctgaggccctgagcagcgagatgtctgagctgagcgcccggctggaggagaagagaagagccatcgaggcccagaagagaagaattgaggccatctttgccaagcaccggcagaggctgggcaagagcgccttcctgcaggtgcagccccgggaggccagcggggaggccgaggccgaggccgaggaggccgacagcggccctgtgcctggaggagagaggcctgctggggagggccagggcgagcccaccagccggcccaaggctgtgaccttctccccagacctgggccctgtgccccatgagggcctgggggagtacaacagagctgtgtccaagctgtctgctgccctgagcagcctgcagagggacatgcagaggctgacagaccagcagcagaggctgctggcccctcctgaggcccctggcagcgcccctcctcctgctgcctgggtgattcctggccccaccaccggccccaaggccgccagccccagccctgccaggagagtgcctgccaccaggaggagccctggccctggccccagccagagccccaggagccccaagcacaccaggcctgctgagctgcggctggcccccctgaccagggtgctgaccccacctcatgatgtggacagcctgccccacctgaggaagttcagccccagccaggtgcctgtgcagaccaggagcagcatcctgctggccgaggagaccccacctgaggagcctgctgcccggcccggcctcatcgagatccccctgggcagcctggccgaccctgctgctgaagatgaaggagatggcagccctgctggagctgaggacagcctggaggaggaggccagcagcgagggggagccccgggtgggcctgggcttcttctacaaggatgaggacaagccagaagatgagatggcccagaagagggccagcctgctggagcggcagcagaggagagctgaggaggcccggcggaggaagcagtggcaggaggtggagaaggagcagaggcgggaggaggccgcccggctggcccaggaggaggcccctggccctgcccccctggtgtctgctgtgcccatggccaccccagccccagctgcccgggccccagctgaggaggaggtgggccccaggaagggggacttcacccggcaggagtatgaaagaagagcccagctgaagctgatggatgacctggacaaggtgctgcggcccagggctgctggcagcggcggccctggccggggcggcagaagagccacccggcccaggagcggctgctgtgatgacagcgccctggcccggagccctgcccggggcctgctgggcagccggctgagcaagatctacagccagagcaccctgagcctgagcacagtggccaatgaggcccacaacaacctgggcgtgaagaggcccaccagccgggcccccagccccagcggcctgatgagccccagccggctgcccggcagccgggagcgggactgggagaatggcagcaatgccagcagccctgcctctgtgcctgagtacacaggcccccggctgtacaaggagcccagcgccaagagcaacaagttcatcatccacaatgccctgagccactgctgcctggccggcaaggtgaatgagccccagaagaaccgcatcctggaggagattgagaagagcaaggccaaccacttcctgatcctcttccgggacagcagctgccagttccgggccctgtacaccctgagcggggagacagaggagctgagccggctggccggctacggccccaggacagtgaccccagccatggtggagggcatctacaagtacaacagcgacaggaagcgcttcacccagatcccagccaagaccatgtccatgtctgtggatgccttcaccatccagggccacctgtggcagggcaagaagcccaccacccccaagaagggcggcggcacccccaagtag

SEQ ID NO: 32749 - DNA, 3831 bp, Artificial Sequence
  Description of Artificial Sequence: Synthetic coding sequence
atggtggaggccgcccctcctggccctggccccctgcggaggaccttcctggtgcctgagatcaagagcctggaccagtatgacttcagccgggccaaggctgctgccagcctggcctgggtgctgcgggccgccttcggcggcgctgagcacgtgcccccagagctgtgggagcccttctacacagaccagtatgcccaggagcacgtgaagccccctgtgacccggctgctgctgtctgctgagctgtactgccgggcctggaggcaggccctgccccagctggagaccccacccaaccccagcgccctgctggccctgctggcccggcggggcaccgtgcctgccctgcctgagaggcctgtgcgggaggccgacctgcggcaccagcccatcctgatgggcgcccacctggccgtgattgatgccctgatggccgcctttgcctttgagtggaccaagaccctgcccggccccctggccctgaccagcctggagcacaagctgctcttctgggtggacaccaccgtgcggcggctgcaggagaagacagagcaggaggccgcccagagggccagccctgctgccccagcagatggagctgccccagcccagcccagctgccccacccgctggtactggaagctggtgccccacgccatcgccttctgcctgaaggagagcggcagcaagccacccatgatccgctacaggaaggacagagtggtggcccggcgggccccctgcttccccaccgtgaccagcctgcaggacctggccagcggggccgccctggccgccaccatccactgctactgcccccagctgctgcggctggaggaggtgtgcctgaaggaccccatgtctgtggccgacagcctgtacaacctgcagctggtgcaggacttctgtgccagccggctgccccggggctgccccctgagcctggaggacctgctgtatgtgcccccacccctgaaggtgaacctggtggtgatgctggccgagctgttcatgtgctttgaggtgctgaagccagactttgtgcaggtgaaggacctgcctgatggccatgctgccagcccccggggcacagaggccagccccccccagaacaacagcggcagcagcagccctgtgttcaccttccgccaccccctgctgagcagcggcggcccccagagccccctgcggggcagcacaggcagcctgaagagcagccccagcatgagccacatggaggccctgggcaaggcctggaaccggcagctgagccggcccctgagccaggccgtgtccttcagcacccccttcggcctggacagtgatgtggatgtggtgatgggagaccctgtgctgctgcggtctgtgtccagtgacagcctgggcccccccaggcctgccccagcccggacccccacccagcccccacctgagcccggggacctgcccaccatcgaggaggccctgcagatcatccacagcgctgagccccggctgctgcctgatggagctgctgatggcagcttctacctgcacagccctgagggccccagcaagcccagcctggccagcccctacctgcctgagggcaccagcaagcccctgagtgaccggcccaccaaggcccctgtgtacatgccccaccctgagacccccagcaagcccagcccctgcctggtgggggaggccagcaagcccccagcccccagcgagggcagccccaaggctgtggccagcagccctgctgccaccaacagcgaggtgaagatgaccagctttgctgagaggaagaagcagctggtgaaggccgaggccgaggccggggccggcagccccaccagcaccccagcccctcctgaggccctgagcagcgagatgtctgagctgagcgcccggctggaggagaagaggcgggccatcgaggcccagaagaggcgcatcgaggccatctttgccaagcaccggcagaggctgggcaagagcgccttcctgcaggtgcagccccgggaggccagcggggaggccgaggccgaggccgaggaggccgacagcggccctgtgcctggaggagagaggcctgctggggagggccagggcgagcccaccagccggcccaaggctgtgaccttctccccagacctgggccctgtgccccatgagggcctgggggagtacaacagagctgtgtccaagctgtctgctgccctgagcagcctgcagagggacatgcagaggctgacagaccagcagcagaggctgctggcccctcctgaggcccctggcagcgcccctcctcctgctgcctgggtgattcctggccccaccaccggccccaaggccgccagccccagccctgcccggcgggtgcctgccacccggcgcagccctggccctggccccagccagagccccaggagccccaagcacaccaggcctgctgagctgcggctggcccccctgaccagggtgctgaccccacctcatgatgtggacagcctgccccacctgaggaagttcagccccagccaggtgcctgtgcagaccaggagcagcatcctgctggccgaggagaccccacctgaggagcctgctgcccggcccggcctgattgagatccccctgggcagcctggccgaccctgctgctgaagatgaaggagatggcagccctgctggagctgaggacagcctggaggaggaggccagcagcgagggggagccccgggtgggcctgggcttcttctacaaggatgaggacaagccagaagatgagatggcccagaagagggccagcctgctggagcggcagcagaggagagctgaggaggcccggcggaggaagcagtggcaggaggtggagaaggagcagaggcgggaggaggccgcccggctggcccaggaggaggcccctggccctgcccccctggtgtctgctgtgcccatggccaccccagccccagctgcccgggccccagctgaggaggaggtgggccccaggaaaggagacttcacccggcaggagtatgaaagaagagcccagctgaagctgatggatgacctggacaaggtgctgcggcccagggctgctggcagcggcggccctggccggggcggccggcgggccacccggcccaggagcggctgctgtgatgattctgccctggcccggagccctgcccggggcctgctgggcagccggctgagcaagatctacagccagagcaccctgagcctgagcacagtggccaatgaggcccacaacaacctgggcgtgaagaggcccaccagccgggcccccagccccagcggcctgatgagccccagccggctgcccggcagccgggagcgggactgggagaatggcagcaatgccagcagccctgcctctgtgcctgagtacacaggcccccggctgtacaaggagcccagcgccaagagcaacaagttcatcatccacaatgccctgagccactgctgcctggccggcaaggtgaatgagccccagaagaaccgcatcctggaggagattgagaagagcaaggccaaccacttcctgatcctcttccgggacagcagctgccagttccgggccctgtacaccctgtctggagaaacagaggagctgagccggctggccggctacggccccaggacagtgaccccagccatggtggagggcatctacaagtacaacagcgacaggaagcgcttcacccagatcccagccaagaccatgtccatgtctgtggatgccttcaccatccagggccacctgtggcagggcaagaagcccaccacccccaagaagggcggcggcacccccaagtag

SEQ ID NO: 32750 - DNA, 660 bp, Artificial Sequence
  Description of Artificial Sequence: Synthetic coding sequence
atgcccttccaccacgtgacagctggcctgctgtacaagggcaactacctgaacagaagcctgtctgctggcagtgacagcgagcagctggccaacatctctgtggaggagctggatgagatccgggaggccttccgggtgctggacagagatggaaatggcttcatcagcaagcaggagctgggcatggccatgaggagcctgggctacatgcccagcgaggtggagctggccatcatcatgcagaggctggacatggatggagatggccaggtggactttgatgagttcatgaccatcctgggccccaagctggtgagcagcgagggcagagatggcttcctgggcaacaccatcgacagcatcttctggcagtttgacatgcagaggatcaccctggaggagctgaagcacatcctgtaccacgccttccgggaccacctgaccatgaaggacatcgagaacatcatcatcaatgaggaggagagcctgaatgagaccagcggcaactgccagacagaatttgaaggagtgcacagccagaagcagaaccggcagacctgtgtgaggaagagcctcatctgtgcctttgccatggccttcatcatctctgtgatgctgattgctgccaaccagatcctgcggagcggcatggagtag

SEQ ID NO: 32751 - DNA, 786 bp, Artificial Sequence
  Description of Artificial Sequence: Synthetic coding sequence
atgaggctgcctgagcagcctggagagggcaagccagaaaatgagaagaagggagatggaggagccctgggcggcggggaggagcccccaagaagccaggccccagacttccccacctgggagaagatgcccttccaccacgtgacagctggcctgctgtacaagggcaactacctgaacagaagcctgtctgctggcagtgacagcgagcagctggccaacatctctgtggaggagctggatgagatccgggaggccttccgggtgctggacagagatggaaatggcttcatcagcaagcaggagctgggcatggccatgaggagcctgggctacatgcccagcgaggtggagctggccatcatcatgcagaggctggacatggatggagatggccaggtggactttgatgagttcatgaccatcctgggccccaagctggtgagcagcgagggcagagatggcttcctgggcaacaccatcgacagcatcttctggcagtttgacatgcagaggatcaccctggaggagctgaagcacatcctgtaccacgccttccgggaccacctgaccatgaaggacatcgagaacatcatcatcaatgaggaggagagcctgaatgagaccagcggcaactgccagacagaatttgaaggagtgcacagccagaagcagaaccggcagacctgtgtgaggaagagcctcatctgtgcctttgccatggccttcatcatctctgtgatgctgattgctgccaaccagatcctgcggagcggcatggagtag

SEQ ID NO: 32752 - DNA, 660 bp, Artificial Sequence; identical to SEQ ID NO: 32750
  Description of Artificial Sequence: Synthetic coding sequence

SEQ ID NO: 32753 - DNA, 660 bp, Artificial Sequence; identical to SEQ ID NO: 32750
  Description of Artificial Sequence: Synthetic coding sequence

SEQ ID NO: 32754 - DNA, 786 bp, Artificial Sequence; identical to SEQ ID NO: 32751
  Description of Artificial Sequence: Synthetic coding sequence

SEQ ID NO: 32755 - DNA, 660 bp, Artificial Sequence; identical to SEQ ID NO: 32750
  Description of Artificial Sequence: Synthetic coding sequence

SEQ ID NO: 32756 - DNA, 378 bp, Artificial Sequence
  Description of Artificial Sequence: Synthetic coding sequence
atgcccttccaccacgtgacagctggcctgctgtacaagggcaactacctgaacagaagcctgtctgctggcagtgacagcgagcagctggccaacatctctgtggaggagctggatgagatccgggaggccttccgggtgctggacagagatggaaatggcttcatcagcaagcaggagctgggcatggccatgaggagcctgggctacatgcccagcgaggtggagctggccatcatcatgcagaggctggacatggatggagatggccaggtggactttgatgagttcatgaccatcctgggccccaagctggtgagcagcgagggcagagatggcttcctgggcaacaccatcgacagcatcttctggcagtag

SEQ ID NO: 32757 - DNA, 747 bp, Artificial Sequence
  Description of Artificial Sequence: Synthetic coding sequence
atgttcctggccaaggccctgctggagggcgctgaccggggcctgggggaggccctgggcggcctgtttggaggcggcggccagaggcgggagggcggcggcagaaatattggaggcatcgtgggcggcatcgtgaacttcatcagcgaggccgctgctgcccagtacaccccagagcccccacccacccagcagcacttcacctctgtggaggccagcgagagcgaggaggtgcggcgcttccggcagcagttcacccagctggccggccctgacatggaggtgggcgccacagacctgatgaacatcctgaacaaggtgctgagcaagcacaaggacctgaagacagatggcttcagcctggacacctgccgcagcatcgtgtctgtgatggacagcgacaccaccgggaagctgggctttgaggagttcaagtacctgtggaacaacatcaagaagtggcagtgtgtgtacaagcagtatgaccgggaccacagcggcagcctgggcagcagccagctgcggggggccctgcaggccgccggcttccagctgaatgagcagctgtaccagatgattgtgagaagatatgccaatgaagatggagacatggacttcaacaacttcatcagctgcctggtgcggctggatgccatgttccgggccttcaagagcctggaccgggacagagatggcctcatccaggtgtccatcaaggagtggctgcagctgaccatgtacagctag

SEQ ID NO: 32758 - DNA, 2868 bp, Artificial Sequence
  Description of Artificial Sequence: Synthetic coding sequence
atgctgcccggccgcctgtgctgggtgcccctgctgctggccctgggcgtgggcagcggcagcggcggcggcggggacagccggcagaggcggctgctggccgccaaggtgaacaagcacaagccctggattgagaccagctaccatggagtcatcacagagaacaatgacaccgtcatcctggacccccccctggtggccctggacaaggatgcccctgtgccctttgctggggagatctgtgccttcaagatccacggccaggagctgccctttgaggccgtggtgctgaacaagaccagcggggagggccgcctgcgggccaagagccccatcgactgtgagctgcagaaggagtacaccttcatcatccaggcctatgactgtggggccggcccccatgaaacagcctggaagaagagccacaaggctgtggtgcacatccaggtgaaggatgtgaatgaatttgcccccaccttcaaggagcccgcctacaaggctgtggtgacagagggcaagatctatgacagcatcctgcaggtggaggccattgatgaggactgcagcccccagtacagccagatctgcaactatgagatcgtgaccacagatgtgccctttgccatcgacagaaatggaaacatccggaacacagagaagctgtcctatgacaagcagcaccagtatgagatcctggtgacagcctatgactgtggccagaagccagctgcccaggacaccctggtgcaggtggatgtgaagcctgtgtgcaagccaggctggcaggactggaccaagagaattgagtaccagcccggcagcggctccatgcccctcttccccagcatccacctggagacctgtgatggagctgtgagcagcctgcagatcgtgacagagctgcagaccaactacatcggcaagggctgtgaccgggagacctacagcgagaagagcctgcagaagctgtgtggggccagcagcggcatcatcgacctgctgcccagccccagcgctgccaccaactggacagctggcctgctggtggacagcagcgagatgatcttcaagtttgatggccggcagggcgccaaggtgcctgatggcatcgtgcccaagaacctgacagaccagttcaccatcaccatgtggatgaagcacggccccagccctggggtgcgggcagagaaggagaccatcctgtgcaacagcgacaagacagagatgaacagacaccactacgccctgtatgtgcacaactgccgcctggtgttcctgctgaggaaggactttgaccaggccgacaccttccggcctgctgagttccactggaagctggaccagatctgtgacaaggagtggcactactacgtgatcaacgtggagttccctgtggtgaccctgtacatggatggagccacctatgagccctacctggtgaccaatgactggcccatccaccccagccacatcgccatgcagctgactgtgggcgcctgctggcagggcggggaggtgaccaagccccagtttgcccagttcttccacggcagcctggccagcctgaccatccggcctgggaagatggagagccagaaggtgatcagctgcctgcaggcctgcaaggagggcctggacatcaacagcctggagagcctgggccagggcatcaagtaccacttcaaccccagccagagcatcctggtgatggagggagatgacatcggcaacatcaacagagccctgcagaaggtgtcctacatcaacagccggcagttccccacagctggggtgcggcggctgaaggtgagcagcaaggtgcagtgcttcggggaggatgtgtgcatcagcatccctgaggtggatgcctacgtgatggtgctgcaggccatcgagccccgcatcaccctgcggggcacagaccacttctggaggcctgctgcccagtttgagagcgcccggggcgtgaccctcttcccagacatcaagatcgtgtccacctttgccaagacagaggcccctggagatgtgaagaccacagaccccaagtctgaggtgctggaggagatgctgcacaacctggacttctgtgacatcctggtgattggaggagacctggacccccggcaggagtgcctggagctgaaccacagcgagctgcaccagaggcacctggatgccaccaacagcacagctggctacagcatctatggagtgggctccatgagccgctatgagcaggtgctgcaccacatccgctacagaaactggaggcctgccagcctggaggcccggcgcttccgcatcaagtgcagcgagctgaatggccgctacaccagcaatgagttcaacctggaggtgtccatcctgcacgaggaccaggtgtctgacaaggagcacgtgaaccacctgattgtgcagccccccttcctgcagagcgtgcaccaccctgagagccgcagcagcatccagcacagctctgtggtgcccagcatcgccaccgtggtgatcatcatctctgtgtgcatgctggtgtttgtggtggccatgggcgtgtacagagtgagaattgcccaccagcacttcatccaggagacagaggccgccaaggagagcgagatggactgggatgattctgccctgaccatcaccgtgaaccccatggagaagcatgagggccctggccacggggaggatgaaacagaaggagaggaggaggaggaggccgaggaggagatgagcagcagcagcggcagtgatgacagcgaggaggaggaggaggaggagggcatgggccggggccgccacggccagaatggagcccggcaggcccagctggagtgggatgacagcaccctgccctactag

SEQ ID NO: 32759 - DNA, 2871 bp, Artificial Sequence
  Description of Artificial Sequence: Synthetic coding sequence
atgaccctgctgctgctgcccctgctgctggccagcctgctggccagctgcagctgcaacaaggccaacaagcacaagccctggattgaagctgagtaccagggcatcgtgatggagaatgacaacacagtgctgctgaacccccccctgtttgccctggacaaggatgcccccctgcgctatgctggggagatctgtggcttccggctgcacggcagcggcgtgccctttgaagctgtgatcctggacaaggccaccggggagggcctcatccgggccaaggagcctgtggactgtgaggcccagaaggagcacaccttcaccatccaggcctatgactgtggggagggcccagatggagccaacaccaagaagagccacaaggccaccgtgcacgtgcgggtgaatgatgtgaatgaatttgcccctgtgtttgtggagcggctgtacagagctgctgtgacagagggcaagctgtatgaccgcatcctgcgggtggaggccattgatggagactgcagcccccagtacagccagatctgctactatgagatcctgacccccaacacccccttcctgattgacaatgatggcaacattgaaaatacagagaagctgcagtacagcggggagcggctgtacaagttcaccgtgacagcctatgactgtgggaagaagagagctgctgatgatgctgaggtggagatccaggtgaagcccacctgcaagcccagctggcagggctggaacaagagaattgaatatgcccctggagctggcagcctggccctcttccctggcatccggctggagacctgtgatgagcccctgtggaacatccaggccaccatcgagctgcagaccagccacgtggccaagggctgtgaccgggacaactacagcgagcgggccctgaggaagctgtgtggggccgccactggagaggtggacctgctgcccatgcctggccccaatgccaactggacagctggcctgtctgtgcactacagccaggacagcagcctcatctactggttcaacggcacccaggccgtgcaggtgcccctgggcggccccagcggcctgggcagcggcccccaggacagcctgagtgaccacttcaccctgtccttctggatgaagcacggcgtgacccccaacaagggcaagaaggaggaggagaccatcgtgtgcaacacagtgcagaatgaagatggcttcagccactacagcctgactgtgcacggctgcagaattgccttcctgtactggcccctgctggagagcgcccggcctgtgaagttcctgtggaagctggagcaggtgtgtgatgatgagtggcaccactacgccctgaacctggagttccccaccgtgaccctgtacacagatggcatcagctttgatcctgccctgattcatgacaatggcctcatccaccccccaagaagagagcccgccctgatgattggagcctgctggacagaggagaagaacaaggagaaggagaagggggacaacagcacagacaccacccagggcgaccccctgagcatccaccactacttccacggctacctggccggcttctctgtgcgcagcggccgcctggagagccgggaggtgattgagtgcctgtatgcctgccgggagggcctggactacagagactttgagagcctgggcaagggcatgaaggtgcacgtgaaccccagccagagcctgctgaccctggagggagatgatgtggagaccttcaaccacgccctgcagcacgtggcctacatgaacaccctgcgctttgccaccccaggagtgcggcccctgcggctgaccacagctgtgaagtgcttcagcgaggagagctgtgtgtccatccctgaggtggagggctacgtggtggtgctgcagccagatgccccccagatcctgctgagcggcacagcccactttgcccggcctgctgtggactttgagggcaccaacggggtgcccctcttcccagacctgcagatcacctgcagcatcagccaccaggtggaggccaagaaggatgagagctggcagggcaccgtgacagacaccaggatgtctgatgaaattgtgcacaacctggatggctgtgagatcagcctggtgggagatgacctggaccctgagcgggagagcctgctgctggacaccaccagcctgcagcagaggggcctggagctgaccaacaccagcgcctacctgaccatcgccggcgtggagagcatcaccgtgtatgaggagatcctgcggcaggcccgctaccgcctgcggcatggagctgccctgtacaccaggaagttccggctgagctgcagcgagatgaatggccgctacagcagcaatgagttcatcgtggaggtgaatgtgctgcacagcatgaacagagtggcccaccccagccacgtgctgagcagccagcagttcctgcaccggggccaccagcccccacctgagatggccggccacagcctggccagcagccacaggaacagcatgatccccagcgctgccaccctcatcatcgtggtgtgtgtgggcttcctggtgctgatggtggtgctgggcctggtgcgcatccacagcctgcacagaagagtgtctggggccggcggccccccaggggccagcagtgaccccaaggaccctgacctcttctgggatgacagcgccctgaccatcatcgtgaaccccatggagagctaccagaaccggcagagctgtgtgactggagctgtgggcggccagcaggaggatgaggacagcagtgacagcgaggtggccgacagccccagcagtgatgagcggcgcatcatcgagaccccaccccaccgctactag

SEQ ID NO: 32760 - DNA, 2907 bp, Artificial Sequence
  Description of Artificial Sequence: Synthetic coding sequence
atggtgctgggctgtgagctgagcggcagcaccagggtggtggtgggcgtggaggccctgctgaccggggccagcagccccctgcccggggtgggccctgccaacaagcacaagccctggattgaagctgagtaccagggcatcgtgatggagaatgacaacacagtgctgctgaacccccccctgtttgccctggacaaggatgcccccctgcgctatgctggggagatctgtggcttccggctgcacggcagcggcgtgccctttgaagctgtgatcctggacaaggccaccggggagggcctcatccgggccaaggagcctgtggactgtgaggcccagaaggagcacaccttcaccatccaggcctatgactgtggggagggcccagatggagccaacaccaagaagagccacaaggccaccgtgcacgtgcgggtgaatgatgtgaatgaatttgcccctgtgtttgtggagcggctgtacagagctgctgtgacagagggcaagctgtatgaccgcatcctgcgggtggaggccattgatggagactgcagcccccagtacagccagatctgctactatgagatcctgacccccaacacccccttcctgattgacaatgatggcaacattgaaaatacagagaagctgcagtacagcggggagcggctgtacaagttcaccgtgacagcctatgactgtgggaagaagagagctgctgatgatgctgaggtggagatccaggtgaagcccacctgcaagcccagctggcagggctggaacaagagaattgaatatgcccctggagctggcagcctggccctcttccctggcatccggctggagacctgtgatgagcccctgtggaacatccaggccaccatcgagctgcagaccagccacgtggccaagggctgtgaccgggacaactacagcgagcgggccctgaggaagctgtgtggggccgccactggagaggtggacctgctgcccatgcctggccccaatgccaactggacagctggcctgtctgtgcactacagccaggacagcagcctcatctactggttcaacggcacccaggccgtgcaggtgcccctgggcggccccagcggcctgggcagcggcccccaggacagcctgagtgaccacttcaccctgtccttctggatgaagcacggcgtgacccccaacaagggcaagaaggaggaggagaccatcgtgtgcaacacagtgcagaatgaagatggcttcagccactacagcctgactgtgcacggctgcagaattgccttcctgtactggcccctgctggagagcgcccggcctgtgaagttcctgtggaagctggagcaggtgtgtgatgatgagtggcaccactacgccctgaacctggagttccccaccgtgaccctgtacacagatggcatcagctttgatcctgccctgattcatgacaatggcctcatccaccccccaagaagagagcccgccctgatgattggagcctgctggacagaggagaagaacaaggagaaggagaagggggacaacagcacagacaccacccagggcgaccccctgagcatccaccactacttccacggctacctggccggcttctctgtgcgcagcggccgcctggagagccgggaggtgattgagtgcctgtatgcctgccgggagggcctggactacagagactttgagagcctgggcaagggcatgaaggtgcacgtgaaccccagccagagcctgctgaccctggagggagatgatgtggagaccttcaaccacgccctgcagcacgtggcctacatgaacaccctgcgctttgccaccccaggagtgcggcccctgcggctgaccacagctgtgaagtgcttcagcgaggagagctgtgtgtccatccctgaggtggagggctacgtggtggtgctgcagccagatgccccccagatcctgctgagcggcacagcccactttgcccggcctgctgtggactttgagggcaccaacggggtgcccctcttcccagacctgcagatcacctgcagcatcagccaccaggtggaggccaagaaggatgagagctggcagggcaccgtgacagacaccaggatgtctgatgaaattgtgcacaacctggatggctgtgagatcagcctggtgggagatgacctggaccctgagcgggagagcctgctgctggacaccaccagcctgcagcagaggggcctggagctgaccaacaccagcgcctacctgaccatcgccggcgtggagagcatcaccgtgtatgaggagatcctgcggcaggcccgctaccgcctgcggcatggagctgccctgtacaccaggaagttccggctgagctgcagcgagatgaatggccgctacagcagcaatgagttcatcgtggaggtgaatgtgctgcacagcatgaacagagtggcccaccccagccacgtgctgagcagccagcagttcctgcaccggggccaccagcccccacctgagatggccggccacagcctggccagcagccacaggaacagcatgatccccagcgctgccaccctcatcatcgtggtgtgtgtgggcttcctggtgctgatggtggtgctgggcctggtgcgcatccacagcctgcacagaagagtgtctggggccggcggccccccaggggccagcagtgaccccaaggaccctgacctcttctgggatgacagcgccctgaccatcatcgtgaaccccatggagagctaccagaaccggcagagctgtgtgactggagctgtgggcggccagcaggaggatgaggacagcagtgacagcgaggtggccgacagccccagcagtgatgagcggcgcatcatcgagaccccaccccaccgctactag

SEQ ID NO: 32761 - DNA, 405 bp, Artificial Sequence
  Description of Artificial Sequence: Synthetic coding sequence
atgaccctgctgctgctgcccctgctgctggccagcctgctggccagctgcagctgcaacaaggccaacaagcacaagccctggattgaagctgagtaccagggcatcgtgatggagaatgacaacacagtgctgctgaacccccccctgtttgccctggacaaggatgcccccctgcgctatgctggggagatctgtggcttccggctgcacggcagcggcgtgccctttgaagctgtgatcctggacaaggccaccggggagggcctcatccgggccaaggagcctgtggactgtgaggcccagaaggagcacaccttcaccatccaggcctatgactgtggggagggcccagatggagccaacaccaagaagagccacaaggccaccgtgcacgtgaggtag

SEQ ID NO: 32762 - DNA, 1422 bp, Artificial Sequence
  Description of Artificial Sequence: Synthetic coding sequence
atgcccttcggctgtgtgaccctgggggacaagaagaactacaaccagcccagcgaggtgacagacagatatgacctgggccaggtgatcaagacagaggagttctgtgagatcttccgggccaaggacaagaccaccgggaagctgcacacctgcaagaagttccagaagagagatggcaggaaggtgaggaaggccgccaagaatgaaattggcatcctgaagatggtgaagcaccccaacatcctgcagctggtggatgtgtttgtgaccaggaaggagtacttcatcttcctggagctggccaccggccgggaggtgtttgactggatcctggaccagggctactacagcgagcgggacaccagcaatgtggtgcggcaggtgctggaggccgtggcctacctgcacagcctgaagatcgtgcacaggaacctgaagctggagaacctggtgtactacaaccggctgaagaacagcaagatcgtcatcagtgacttccacctggccaagctggagaatggcctcatcaaggagccctgtggcaccccagagtacctgggcaacccccccttctatgaggaggtggaggaggatgattatgagaaccacgacaagaacctcttcaggaagatcctggccggggactatgaatttgacagcccctactgggatgacatcagccaggccgccaaggacctggtgacccggctgatggaggtggagcaggaccagaggatcacagctgaggaggccatcagccatgagtggatctctggaaatgctgccagtgacaagaacatcaaggatggagtgtgtgcccagatcgagaagaactttgcccgggccaagtggaagaaggctgtgcgggtgaccaccctgatgaagaggctgcgggcccctgagcagagcagcacagctgctgcccagagcgccagcgccacagacacagccaccccaggagctgctggaggagccacagctgctgctgccagcggggccaccagcgccccagaaggagatgctgcccgggccgccaagagtgacaacgtggccccagctgacagaagtgccaccccagccacagatggcagcgccaccccagccacagatggctctgtgaccccagccacagatggcagcatcaccccagccacagatggctctgtgaccccagccacagacagaagtgccaccccagccacagatggccgggccaccccagccacagaggagagcacagtgcccaccacccagagcagcgccatgctggccaccaaggctgctgccaccccagagcccgccatggcccagcctgacagcacagcccctgagggcgccaccggccaggccccacccagcagcaagggggaggaggccgccggctacgcccaggagagccagcgggaggaggccagctag

SEQ ID NO: 32763 - DNA, 1506 bp, Artificial Sequence
  Description of Artificial Sequence: Synthetic coding sequence
atgcccttcggctgtgtgaccctgggggacaagaagaactacaaccagcccagcgaggtgacagacagatatgacctgggccaggtgatcaagacagaggagttctgtgagatcttccgggccaaggacaagaccaccgggaagctgcacacctgcaagaagttccagaagagagatggcaggaaggtgaggaaggccgccaagaatgaaattggcatcctgaagatggtgaagcaccccaacatcctgcagctggtggatgtgtttgtgaccaggaaggagtacttcatcttcctggagctggccaccggccgggaggtgtttgactggatcctggaccagggctactacagcgagcgggacaccagcaatgtggtgcggcaggtgctggaggccgtggcctacctgcacagcctgaagatcgtgcacaggaacctgaagctggagaacctggtgtactacaaccggctgaagaacagcaagatcgtcatcagtgacttccacctggccaagctggagaatggcctcatcaaggagccctgtggcaccccagagtacctggcccctgaggtggtgggccggcagagatatggccggcctgtggactgctgggccatcggggtcatcatgtacatcctgctgagcggcaacccccccttctatgaggaggtggaggaggatgattatgagaaccacgacaagaacctcttcaggaagatcctggccggggactatgaatttgacagcccctactgggatgacatcagccaggccgccaaggacctggtgacccggctgatggaggtggagcaggaccagaggatcacagctgaggaggccatcagccatgagtggatctctggaaatgctgccagtgacaagaacatcaaggatggagtgtgtgcccagatcgagaagaactttgcccgggccaagtggaagaaggctgtgcgggtgaccaccctgatgaagaggctgcgggcccctgagcagagcagcacagctgctgcccagagcgccagcgccacagacacagccaccccaggagctgctggaggagccacagctgctgctgccagcggggccaccagcgccccagaaggagatgctgcccgggccgccaagagtgacaacgtggccccagctgacagaagtgccaccccagccacagatggcagcgccaccccagccacagatggctctgtgaccccagccacagatggcagcatcaccccagccacagatggctctgtgaccccagccacagacagaagtgccaccccagccacagatggccgggccaccccagccacagaggagagcacagtgcccaccacccagagcagcgccatgctggccaccaaggctgctgccaccccagagcccgccatggcccagcctgacagcacagcccctgagggcgccaccggccaggccccacccagcagcaagggggaggaggccgccggctacgcccaggagagccagcgggaggaggccagctag

SEQ ID NO: 32764 - DNA, 1413 bp, Artificial Sequence
  Description of Artificial Sequence: Synthetic coding sequence
atgcccttcggctgtgtgaccctgggggacaagaagaactacaaccagcccagcgaggtgacagacagatatgacctgggccaggtgatcaagacagaggagttctgtgagatcttccgggccaaggacaagaccaccgggaagctgcacacctgcaagaagttccagaagagagatggcaggaaggtgaggaaggccgccaagaatgaaattggcatcctgaagatggtgaagcaccccaacatcctgcagctggtggatgtgtttgtgaccaggaaggagtacttcatcttcctggagctggccaccggccgggaggtgtttgactggatcctggaccagggctactacagcgagcgggacaccagcaatgtggtgcggcaggtgctggaggccgtggcctacctgcacagcctgaagatcgtgcacaggaacctgaagctggagaacctggtgtactacaaccggctgaagaacagcaagatcgtcatcagtgacttccacctggccaagctggagaatggcctcatcaaggagccctgtggcaccccagagtacctggcccctgaggtggtgggccggcagagatatggccggcctgtggactgctgggccatcggggtcatcatgtacatcctgctgagcggcaacccccccttctatgaggaggtggaggaggatgattatgagaaccacgacaagaacctcttcaggaagatcctggccggggactatgaatttgacagcccctactgggatgacatcagccaggccgccaaggacctggtgacccggctgatggaggtggagcaggaccagaggatcacagctgaggaggccatcagccatgagtggatctctggaaatgctgccagtgacaagaacatcaaggatggagtgtgtgcccagatcgagaagaactttgcccgggccaagtggaagaaggctgtgcgggtgaccaccctgatgaagaggctgcgggcccctgagcagagcagcacagctgctgcccagagcgccagcgccacagacacagccaccccaggagctgctgacagaagtgccaccccagccacagatggcagcgccaccccagccacagatggctctgtgaccccagccacagatggcagcatcaccccagccacagatggctctgtgaccccagccacagacagaagtgccaccccagccacagatggccgggccaccccagccacagaggagagcacagtgcccaccacccagagcagcgccatgctggccaccaaggccgccgccaccccagagcccgccatggcccagcctgacagcacagcccctgagggcgccaccggccaggccccacccagcagcaaaggagaggaggccgccggctacgcccaggagagccagcgggaggaggccagctag

SEQ ID NO: 32765 - DNA, 1560 bp, Artificial Sequence
  Description of Artificial Sequence: Synthetic coding sequence
atggatgctgtgctggagcccttccctgctgacaggctcttccctggcagcagcttcctggacctgggggacctgaatgaaagtgacttcctgaacaatgcccacttccctgagcacctggaccacttcacagagaacatggaggacttcagcaatgacctcttcagcagcttctttgatgatcctgtgctggatgagaagagccccctgctggacatggagctggacagccccaccccaggcatccaggccgagcacagctacagcctgagcggggacagcgccccccagagccccctggtgcccatcaagatggaggacaccacccaggatgctgagcacggggcctgggccctgggccacaagctgtgcagcatcatggtgaagcaggagcagagccctgagctgcctgtggaccccctggccgcccccagcgccatggctgctgctgctgccatggccaccacccccctgctgggcctgagccccctgagccggctgcccatcccccaccaggcccctggagagatgacccagctgcctgtgatcaaggccgagcccctggaggtgaaccagttcctgaaggtgaccccagaggacctggtgcagatgccacccaccccacccagcagccacggcagtgacagtgatggcagccagagccccaggagcctgccccccagcagccctgtgcggcccatggcccggagcagcacagccatcagcaccagccccctgctgacagccccccacaagctgcagggcaccagcggccccctgctgctgacagaggaggagaagaggaccctgattgctgagggctaccccatccccaccaagctgcccctgaccaaggccgaggagaaggccctgaagagggtgcggaggaagatcaagaacaagatcagcgcccaggagagcaggaggaagaagaaggagtatgtggagtgcctggagaagaaggtggagaccttcaccagcgagaacaatgagctgtggaagaaggtggagaccctggagaatgccaacagaaccctgctgcagcagctgcagaagctgcagaccctggtgaccaacaagatcagccggccctacaagatggccgccacccagacaggcacctgcctgatggtggccgccctgtgctttgtgctggtgctgggcagcctggtgccctgcctgcctgagttcagcagcggcagccagacagtgaaggaggaccccctggccgcagatggagtgtacacagccagccagatgcccagccgcagcctgctcttctatgatgatggagctggcctgtgggaggatggccgcagcaccctgctgcccatggagcccccagatggctgggagatcaaccctgggggccctgctgagcagaggccccgggaccacctgcagcacgaccacctggacagcacccatgagaccaccaagtacctgtctgaggcctggcccaaggatggcggcaatggcaccagcccagacttcagccacagcaaggagtggttccatgaccgggacctgggccccaacaccaccatcaagctgtcctag

SEQ ID NO: 32766 - DNA, 1296 bp, Artificial Sequence
  Description of Artificial Sequence: Synthetic coding sequence
atggatgctgtgctggagcccttccctgctgacaggctcttccctggcagcagcttcctggacctgggggacctgaatgaaagtgacttcctgaacaatgcccacttccctgagcacctggaccacttcacagagaacatggaggacttcagcaatgacctcttcagcagcttctttgatgatcctgtgctggatgagaagagccccctgctggacatggagctggacagccccaccccaggcatccaggccgagcacagctacagcctgagcggggacagcgccccccagagccccctggtgcccatcaagatggaggacaccacccaggaggacctggtgcagatgccacccaccccacccagcagccacggcagtgacagtgatggcagccagagccccaggagcctgccccccagcagccctgtgcggcccatggcccggagcagcacagccatcagcaccagccccctgctgacagccccccacaagctgcagggcaccagcggccccctgctgctgacagaggaggagaagaggaccctgattgctgagggctaccccatccccaccaagctgcccctgaccaaggccgaggagaaggccctgaagagggtgcggaggaagatcaagaacaagatcagcgcccaggagagcaggaggaagaagaaggagtatgtggagtgcctggagaagaaggtggagaccttcaccagcgagaacaatgagctgtggaagaaggtggagaccctggagaatgccaacagaaccctgctgcagcagctgcagaagctgcagaccctggtgaccaacaagatcagccggccctacaagatggccgccacccagacaggcacctgcctgatggtggccgccctgtgctttgtgctggtgctgggcagcctggtgccctgcctgcctgagttcagcagcggcagccagacagtgaaggaggaccccctggccgcagatggagtgtacacagccagccagatgcccagccgcagcctgctcttctatgatgatggagctggcctgtgggaggatggccgcagcaccctgctgcccatggagcccccagatggctgggagatcaaccctgggggccctgctgagcagaggccccgggaccacctgcagcacgaccacctggacagcacccatgagaccaccaagtacctgtctgaggcctggcccaaggatggcggcaatggcaccagcccagacttcagccacagcaaggagtggttccatgaccgggacctgggccccaacaccaccatcaagctgtcctag

SEQ ID NO: 32767 - DNA, 1560 bp, Artificial Sequence; identical to SEQ ID NO: 32765
  Description of Artificial Sequence: Synthetic coding sequence

SEQ ID NO: 32768 - DNA, 1563 bp, Artificial Sequence
  Description of Artificial Sequence: Synthetic coding sequence
atggaggtgctggagagcggggagcagggcgtgctgcagtgggacaggaagctgtctgagctgtctgagcctggagatggagaggccctgatgtaccacacccacttcagcgagctgctggatgagttcagccagaatgtgctgggccagctgctgaatgaccccttcctgtctgagaagtctgtgtccatggaggtggagcccagccccaccagccctgcccccctcatccaggccgagcacagctacagcctgtgtgaggagccccgggcccagagccccttcacccacatcaccaccagtgacagcttcaatgatgatgaggtggagagcgagaagtggtacctgagcacagacttccccagcaccagcatcaagacagagcctgtgacagatgagcccccacctggcctggtgcccagcgtgaccctgaccatcacagccatcagcacccccctggagaaggaggagccccccctggagatgaacacaggagtggacagcagctgccagaccatcatccccaagatcaagctggagccccatgaggtggaccagttcctgaacttcagccccaaggaggcccctgtggaccacctgcacctgccccccaccccacccagcagccacggcagtgacagcgagggcagcctgagccccaacccccggctgcaccccttcagcctgccccagacccacagccccagccgggccgccccccgggcccccagcgccctgagcagcagccccctgctgacagccccccacaagctgcagggcagcggccccctggtgctgacagaggaggagaagaggaccctgattgctgagggctaccccatccccaccaagctgcccctgagcaagtctgaggagaaggccctgaagaagatccggaggaagatcaagaacaagatcagcgcccaggagagcaggaggaagaagaaggagtacatggacagcctggagaagaaggtggagagctgcagcacagagaacctggagctgaggaagaaggtggaggtgctggagaacaccaacagaaccctgctgcagcagctgcagaagctgcagaccctggtgatgggcaaggtgtccaggacctgcaagctggccggcacccagacaggcacctgcctgatggtggtggtgctgtgctttgctgtggccttcggcagcttcttccagggctacggcccctaccccagcgccaccaagatggccctgcccagccagcacagcctgcaggagccctacacagcctctgtggtgcgcagcaggaacctgctgatctatgaggagcacagccccccagaggagagcagcagccctggcagcgctggggagctgggcggctgggaccggggcagcagcctgctgcgggtgtctggcctggagagcaggccagatgtggacctgccccacttcatcatcagcaatgagaccagcctggagaagtctgtgctgctggagctgcagcagcacctggtgtctgccaagctggagggcaatgagaccctgaaggtggtggagctggaccggcgggtgaacaccaccttctag

SEQ ID NO: 32769 - DNA, 528 bp, Artificial Sequence
  Description of Artificial Sequence: Synthetic coding sequence
atggaggtgctggagagcggggagcagggcgtgctgcagtgggacaggaagctgtctgagctgtctgagcctggagatggagaggccctgatgtaccacacccacttcagcgagctgctggatgagttcagccagaatgtgctgggccagctgctgaatgaccccttcctgtctgagaagtctgtgtccatggaggtggagcccagccccaccagccctgcccccctcatccaggccgagcacagctacagcctgtgtgaggagccccgggcccagagccccttcacccacatcaccaccagtgacagcttcaatgatgatgaggtggagagcgagaagtggtacctgagcacagacttccccagcaccagcatcaagacagagcctgtgacagatgagcccccacctggcctggtgcccagcgtgaccctgaccatcacagccatcagcacccccctggagaaggaggagccccccctggagatgaacacaggagtggacagcagctgccagaccaacaccacctag

SEQ ID NO: 32770 - DNA, 747 bp, Artificial Sequence
  Description of Artificial Sequence: Synthetic coding sequence
atggaggtgctggagagcggggagcagggcgtgctgcagtgggacaggaagctgtctgagctgtctgagcctggagatggagaggccctgatgtaccacacccacttcagcgagctgctggatgagttcagccagaatgtgctgggccagctgctgaatgaccccttcctgtctgagaagtctgtgtccatggaggtggagcccagccccaccagccctgcccccctcatccaggccgagcacagctacagcctgtgtgaggagccccgggcccagagccccttcacccacatcaccaccagtgacagcttcaatgatgatgaggtggagagcgagaagtggtacctgagcacagacttccccagcaccagcatcaagacagagcctgtgacagatgagcccccacctggcctggtgcccagcgtgaccctgaccatcacagccatcagcacccccctggagaaggaggagccccccctggagatgaacacaggagtggacagcagctgccagaccatcatccccaagatcaagctggagccccatgaggtggaccagttcctgaacttcagccccaaggagggcctgagcgccctgcctgtgtccctgtgggtgatggacatggtgtctggcagcacagagcgggagtatggagagagagctggcatgagcctgtaccaccgctgctgctcctggctgtatgagatcgccctcttcctgaagaacaagaactttgccagcaagtag

SEQ ID NO: 32771 - DNA, 1383 bp, Artificial Sequence
  Description of Artificial Sequence: Synthetic coding sequence
atggaggtgctggagagcggggagcagggcgtgctgcagtgggacaggaagctgtctgagctgtctgagcctggagatggagaggccctgatgtaccacacccacttcagcgagctgctggatgagttcagccagaatgtgctgggccagctgctgaatgaccccttcctgtctgagaagtctgtgtccatggaggtggagcccagccccaccagccctgcccccctcatccaggccgagcacagctacagcctgtgtgaggagccccgggcccagagccccttcacccacatcaccaccagtgacagcttcaatgatgatgaggtggagagcgagaagtggtacctgagcacagacttccccagcaccagcatcaagacagagcctgtgacagatgagcccccacctggcctggtgcccagcgtgaccctgaccatcacagccatcagcacccccctggagaaggaggagccccccctggagatgaacacaggagtggacagcagctgccagaccatcatccccaagatcaagctggagccccatgaggtggaccagttcctgaacttcagccccaaggaggcccctgtggaccacctgcacctgccccccaccccacccagcagccacggcagtgacagcgagggcagcctgagccccaacccccggctgcaccccttcagcctgccccagacccacagccccagccgggccgccccccgggcccccagcgccctgagcagcagccccctgctgacagccccccacaagctgcagggcagcggccccctggtgctgacagaggaggagaagaggaccctgattgctgagggctaccccatccccaccaagctgcccctgagcaagtctgaggagaaggccctgaagaagatccggaggaagatcaagaacaagatcagcgcccaggagagcaggaggaagaagaaggagtacatggacagcctggagaagaaggtggagagctgcagcacagagaacctggagctgaggaagaaggtggaggtgctggagaacaccaacagaaccctgctgcagcagctgcagaagctgcagaccctggtgatgggcaaggtgtccaggacctgcaagctggccggcacccagacaggcacctgcctgatggtggtggtgctgtgctttgctgtggccttcggcagcttcttccagggctacggcccctaccccagcgccaccaagatggccctgcccagccagcacagcctgcaggagccctacacagcctctgtgggcaagacagcctgtgggaagctgggccgggtgctcttctacttccccagggctggcttcctgagcctgcccaagggcatcttctgtgagagccccatgttcaagaagtggtag

SEQ ID NO: 32772 - DNA, 453 bp, Artificial Sequence
  Description of Artificial Sequence: Synthetic coding sequence
atggaggtgctggagagcggggagcagggcgtgctgcagtgggacaggaagctgtctgagctgtctgagcctggagatggagaggccctgatgtaccacacccacttcagcgagctgctggatgagttcagccagaatgtgctgggccagctgctgaatgaccccttcctgtctgagaagtctgtgtccatggaggtggagcccagccccaccagccctgcccccctcatccaggccgagcacagctacagcctgtgtgaggagccccgggcccagagccccttcacccacatcaccaccagtgacagcttcaatgatgatgaggtggagagcgagaagtggtacctgagcacagacttccccagcaccagcatctgccacagcgaccaccacagccacctgcaccctgtgggcaaaggaggcaccagcagtggaaatgagcactggggctag

SEQ ID NO: 32773 - DNA, 1311 bp, Artificial Sequence
  Description of Artificial Sequence: Synthetic coding sequence
atggtgggctttggagccaacagaagagctggccgcctgcccagcctggtgctggtggtgctgctggtggtgattgtggtgctggccttcaactactggagcatcagcagcagacatgtgctgctgcaggaggaggtggccgagctgcagggccaggtgcagaggacagaggtggcccggggccgcctggagaagaggaacagcgacctgctgctgctggtggacacccacaagaagcagattgaccagaaggaggccgactatggccgcctgagcagccggctgcaggcccgggagggcctgggcaagagatgtgaagatgacaaggtgaagctgcagaacaacatctcctaccagatggctgacatccaccacctgaaggagcagctggccgagctgcggcaggagttcctgcggcaggaggaccagctgcaggactacaggaagaacaacacctacctggtgaagaggctggagtatgagagcttccagtgtggccagcagatgaaggagctgcgggcccagcacgaggagaacatcaagaagctggccgaccagttcctggaggagcagaagcaggagacccagaagatccagagcaatgatggcaaggagctggacatcaacaaccaggtggtgcccaagaacatccccaaggtggccgagaatgtggccgacaagaatgaggagcccagcagcaaccacatcccccacggcaaggagcagatcaagagaggaggagatgctggcatgcctggcatcgaggagaatgacctggccaaggtggatgacctgcccccagccctgaggaagccacccatctctgtgtcccagcacgagagccaccaggccatcagccacctgcccaccggccagcccctgagccccaacatgcccccagacagccacatcaaccacaatggaaatcctggcaccagcaagcagaaccccagcagccccctgcagaggctcatccctggcagcaacctggacagcgagccccgcatccagacagacatcctgaagcaggccaccaaggacagagtgtctgacttccacaagctgaagcagagccgcttctttgatgaaaatgaaagccctgtggacccccagcacggcagcaagctggccgactacaatggagatgatggaaatgtgggggagtatgaagctgacaagcaggccgagctggcctacaatgaggaggaggatggagatggaggagaggaggatgtgcaggatgatgaggagcgggagctgcagatggaccctgctgactatggcaagcagcacttcaatgatgtgctgtag

SEQ ID NO: 32774 - DNA, 1143 bp, Artificial Sequence
  Description of Artificial Sequence: Synthetic coding sequence
atggtgggctttggagccaacagaagagctggccgcctgcccagcctggtgctggtggtgctgctggtggtgattgtggtgctggccttcaactactggagcatcagcagcagacatgtgctgctgcaggaggaggtggccgagctgcagggccaggtgcagaggacagaggtggcccggggccgcctggagaagaggaacagcgacctgctgctgctggtggacacccacaagaagcagattgaccagaaggaggccgactatggccgcctgagcagccggctgcaggcccgggagggcctgggcaagagatgtgaagatgacaaggtgaagctgcagaacaacatctcctaccagatggctgacatccaccacctgaaggagcagctggccgagctgcggcaggagttcctgcggcaggaggaccagctgcaggactacaggaagaacaacacctacctggtgaagaggctggagtatgagagcttccagtgtggccagcagatgaaggagctgcgggcccagcacgaggagaacatcaagaagctggccgaccagttcctggaggagcagaagcaggagacccagaagatccagagcaatgatggcaaggagctggacatcaacaaccaggtggtgcccaagaacatccccaaggtggccgagaatgtggccgacaagaatgaggagcccagcagcaaccacatcccccacggcaaggagcagatcaagagaggaggagatgctggcatgcctggcatcgaggagaatgacctggccaaggtggatgacctgcccccagccctgaggaagccacccatctctgtgtcccagcacgagagccaccaggccatcagccacctgcccaccggccagcccctgagccccaacatgcccccagacagccacatcaaccacaatggaaatcctggcaccagcaagcagaaccccagcagccccctgcagaggctcatccctggcagcaacctggacagcgagccccgcatccagacagacatcctgaagcaggccaccaaggacagagtgtctgacttccacaagctgaagcagaatgatgaggagcgggagctgcagatggaccctgctgactatggcaagcagcacttcaatgatgtgctgtag

SEQ ID NO: 32775 - DNA, 534 bp, Artificial Sequence
  Description of Artificial Sequence: Synthetic coding sequence
atggtgggctttggagccaacagaagagctggccgcctgcccagcctggtgctggtggtgctgctggtggtgattgtggtgctggccttcaactactggagcatcagcagcagacatgtgctgctgcaggaggaggtggccgagctgcagggccaggtgcagaggacagaggtggcccggggccgcctggagaagaggaacagcgacctgctgctgctggtggacacccacaagaagcagattgaccagaaggaggccgactatggccgcctgagcagccggctgcaggcccgggagggcctgggcaagagatgtgaagatgacaaggtgaagctgcagaacaacatctcctaccagatggctgacatccaccacctgaaggagcagctggccgagctgcggcaggagttcctgcggcaggaggaccagctgcaggactacaggaagaacaacacctacctggtgaagaggctggagtatgagagcaagaggcccaagcgcttcaaccagatgatggagaggaactggatctag

SEQ ID NO: 32776 - DNA, 1248 bp, Artificial Sequence
  Description of Artificial Sequence: Synthetic coding sequence
atggtggtgattgtggtgctggccttcaactactggagcatcagcagccgccacgtgctgctgcaggaggaggtggccgagctgcagggccaggtgcagaggacagaggtggcccggggccgcctggagaagaggaacagcgacctgctgctgctggtggacacccacaagaagcagattgaccagaaggaggccgactatggccgcctgagcagccggctgcaggcccgggagggcctgggcaagagatgtgaagatgacaaggtgaagctgcagaacaacatctcctaccagatggctgacatccaccacctgaaggagcagctggccgagctgcggcaggagttcctgcggcaggaggaccagctgcaggactacaggaagaacaacacctacctggtgaagaggctggagtatgagagcttccagtgtggccagcagatgaaggagctgcgggcccagcacgaggagaacatcaagaagctggccgaccagttcctggaggagcagaagcaggagacccagaagatccagagcaatgatggcaaggagctggacatcaacaaccaggtggtgcccaagaacatccccaaggtggctgaaaatgtggccgacaagaatgaggagcccagcagcaaccacatcccccacggcaaggagcagatcaagagaggaggagatgctggcatgcctggcattgaagaaaatgacctggccaaggtggatgacctgcccccagccctgaggaagccacccatctctgtgtcccagcacgagagccaccaggccatcagccacctgcccaccggccagcccctgagccccaacatgcccccagacagccacatcaaccacaacggcaaccctggcaccagcaagcagaaccccagcagccccctgcagaggctcatccctggcagcaacctggacagcgagccccgcatccagacagacatcctgaagcaggccaccaaggacagagtgtctgacttccacaagctgaagcagagccgcttctttgatgaaaatgaaagccctgtggacccccagcacggcagcaagctggccgactacaatggagatgatggaaatgtgggggagtatgaggccgacaagcaggccgagctggcctacaatgaggaggaggatggagatggaggagaagaagatgtgcaggatgatgaggagcgggagctgcagatggaccctgctgactatggcaagcagcacttcaatgatgtgctgtag

SEQ ID NO: 32777 - DNA, 75 bp, Artificial Sequence
  Description of Artificial Sequence: Synthetic coding sequence
caggatgatgaggagcgggagctgcagatggaccctgctgactatggcaagcagcacttcaatgatgtgctgtag

SEQ ID NO: 32778 - DNA, 1302 bp, Artificial Sequence
  Description of Artificial Sequence: Synthetic coding sequence
atggtgggctttggagccaacagaagagctggccgcctgcccagcctggtgctggtggtgctgctggtggtgattgtggtgctggccttcaactactggagcatcagcagcagacatgtgctgctgcaggaggaggtggccgagctgcagggccaggtgcagaggacagaggtggcccggggccgcctggagaagaggaacagcgacctgctgctgctggtggacacccacaagaagcagattgaccagaaggaggccgactatggccgcctgagcagccggctgcaggcccgggagggcctgggcaagagatgtgaagatgacaaggtgaagctgcagaacaacatctcctaccagatggctgacatccaccacctgaaggagcagctggccgagctgcggcaggagttcctgcggcaggaggaccagctgcaggactacaggaagaacaacacctacctggtgaagaggctggagtatgagagcttccagtgtggccagcagatgaaggagctgcgggcccagcacgaggagaacatcaagaagctggccgaccagttcctggaggagcagaagcaggagacccagaagatccagagcaatgatggcaaggagctggacatcaacaaccaggtggtgcccaagaacatccccaaggtggccgagaatgtggccgacaagaatgaggagcccagcagcaaccacatcccccacggcaaggagcagatcaagagaggaggagatgctggcatgcctggcatcgaggagaatgacctggccaaggtggatgacctgcccccagccctgaggaagccacccatctctgtgtcccagcacgagagccaccaggccatcagccacctgcccaccggccagcccctgagccccaacatgcccccagacagccacatcaaccacaatggaaatcctggcaccagcaagcagaaccccagcagccccctgcagaggctcatccctggcagcaacctggacagcgagccccgcatccagacagacatcctgaagcaggccaccaaggacagagtgtctgacttccacaagctgaagcagagccgcttctttgatgaaaatgaaagccctgtggacccccagcacggcagcaagctggccgactacaatggagatgatggaaatgtgggggagtatgaagctgacaagcaggccgagctggcctacaatgaggaggaggatggagatggaggagaggaggatgtgcagggcgagcggggccctggcctgcacgccatcaccatgaagcccaccagcaagttcttcggctag

SEQ ID NO: 32779 - DNA, 549 bp, Artificial Sequence
  Description of Artificial Sequence: Synthetic coding sequence
atgaagggctggggctggctggccctgctgctgggcgccctgctgggcacagcctgggcccggcgcagccaggacctgcactgtggggcctgccgggccctggtggatgagctggagtgggagatcgcccaggtggaccccaagaagaccatccagatgggcagcttccgcatcaacccagatggcagccagagcgtggtggaggtgccctatgcccggtctgaggcccacctgacagagctgctggaggagatctgtgacaggatgaaggagtatggagagcagattgaccccagcacccacaggaagaactacgtgcgggtggtgggcagaaatggagagagcagcgagctggacctgcagggcatcagaattgacagcgacatcagcggcaccctgaagtttgcctgtgagagcatcgtggaggagtatgaagatgagctgattgagttcttcagccgggaggccgacaacgtgaaggacaagctgtgcagcaagaggacagacctgtgtgaccacgccctgcacatcagccatgatgagctgtag

SEQ ID NO: 32780 - DNA, 507 bp, Artificial Sequence
  Description of Artificial Sequence: Synthetic coding sequence
atgaagggctggggctggctggccctgctgctgggcgccctgctgggcacagcctgggcccggcgcagccaggacctgcactgtggggcctgccgggccctggtggatgagctggagtgggagatcgcccaggtggaccccaagaagaccatccagatgggcagcttccgcatcaacccagatggcagccagagcgtggtggaggtgccctatgcccggtctgaggcccacctgacagagctgctggaggagatctgtgacaggatgaaggagtatggagagcagattgaccccagcacccacaggaagaactacgtgcgggtggtgggcagaaatggagagagcagcgagctggacctgcagggcatcagaattgacagcgacatcagcggcaccctgaagtttgcctgtgagagcatcgtggaggagtatgaagatgagctgattgagttcttcagccgggaggccgacaacgtgaaggacaagctgtgcagcaagaggacatag

SEQ ID NO: 32781 - DNA, 1644 bp, Artificial Sequence
  Description of Artificial Sequence: Synthetic coding sequence
atgaccaagacagatcctgcccccatggcccccccaccaagaggagaggaggaggaggaggaggaggaggatgagcctgtgcctgaggcccccagccccacccaggagcggcggcagaagcctgtggtgcaccccagcgccccagcccccctgcccaaggactatgccttcaccttctttgaccccaatgaccctgcctgccaggagatcctgtttgacccccagaccaccatccctgagctgtttgccatcgtgcggcagtgggtgccccaggtgcagcacaagattgatgtgattggaaatgagatcctgcggcggggctgccacgtgaatgacagagatggcctgacagacatgaccctgctgcactacgcctgcaaggccggggcccatggagtgggggaccctgctgctgctgtgcggctgagccagcagctgctggccctgggcgcagatgtgaccctgcggagccgctggaccaacatgaatgccctgcactacgccgcctactttgatgtgcctgacctggtgcgggtgctgctgaagggggcccggccccgggtggtgaacagcacctgcagcgacttcaaccacggcagcgccctgcacatcgccgccagcagcctgtgcctgggcgccgccaagtgcctgctggagcacggggccaacccagccctgaggaacaggaagggccaggtgcctgctgaggtggtgcctgaccccatggacatgagcctggacaaggccgaggccgccctggtggccaaggagctgcggaccctgctggaggaggccgtgcccctgagctgtgccctgcccaaggtgaccctgcccaactatgacaacgtgcccggcaacctgatgctgagcgccctgggcctgcggctgggggacagagtgctgctggatggccagaagacaggcaccctgcgcttctgtggcaccacagaatttgccagcggccagtgggtgggcgtggagctggatgagcctgagggcaagaatgatggctctgtgggcggcgtgcgctacttcatctgcccccccaagcagggcctgtttgcctctgtgtccaagatcagcaaggctgtggatgccccacccagctctgtgaccagcacccccaggacccccaggatggacttcagccgggtgacaggcaagggccggcgggagcacaagggcaagaagaagacccccagcagccccagcctgggcagcctgcagcagagagatggagccaaggccgaggtgggggaccaggtgctggtggccggccagaagcagggcatcgtgcgcttctacggcaagacagactttgcccctggctactggtacggcatcgagctggaccagcccaccgggaagcatgatggctctgtgtttggagtgcgctacttcacctgcccccccaggcatggagtgtttgccccagccagccgcatccagagaattggaggcagcacagacagccctggggacagcgtgggcgccaagaaggtgcaccaggtgaccatgacccagcccaagaggaccttcaccaccgtgaggacccccaaggacatcgcctctgaaaattccatcagccggctgctcttctgctgctggttcccctggatgctgcgggcagagatgcagagctag

SEQ ID NO: 32782 - DNA, 1572 bp, Artificial Sequence
  Description of Artificial Sequence: Synthetic coding sequence
atgaaccccagcccccggcccccagccccacccaggtctgctggccgcagcctgctgtgcacccccaggcacctgccccccagcctgcggaccaccctgaccttctttgaccccaatgaccctgcctgccaggagatcctgtttgacccccagaccaccatccctgagctgtttgccatcgtgcggcagtgggtgccccaggtgcagcacaagattgatgtgattggaaatgagatcctgcggcggggctgccacgtgaatgacagagatggcctgacagacatgaccctgctgcactacgcctgcaaggccggggcccatggagtgggggaccctgctgctgctgtgcggctgagccagcagctgctggccctgggcgcagatgtgaccctgcggagccgctggaccaacatgaatgccctgcactacgccgcctactttgatgtgcctgacctggtgcgggtgctgctgaagggggcccggccccgggtggtgaacagcacctgcagcgacttcaaccacggcagcgccctgcacatcgccgccagcagcctgtgcctgggcgccgccaagtgcctgctggagcacggggccaacccagccctgaggaacaggaagggccaggtgcctgctgaggtggtgcctgaccccatggacatgagcctggacaaggccgaggccgccctggtggccaaggagctgcggaccctgctggaggaggccgtgcccctgagctgtgccctgcccaaggtgaccctgcccaactatgacaacgtgcccggcaacctgatgctgagcgccctgggcctgcggctgggggacagagtgctgctggatggccagaagacaggcaccctgcgcttctgtggcaccacagaatttgccagcggccagtgggtgggcgtggagctggatgagcctgagggcaagaatgatggctctgtgggcggcgtgcgctacttcatctgcccccccaagcagggcctgtttgcctctgtgtccaagatcagcaaggctgtggatgccccacccagctctgtgaccagcacccccaggacccccaggatggacttcagccgggtgacaggcaagggccggcgggagcacaagggcaagaagaagacccccagcagccccagcctgggcagcctgcagcagagagatggagccaaggccgaggtgggggaccaggtgctggtggccggccagaagcagggcatcgtgcgcttctacggcaagacagactttgcccctggctactggtacggcatcgagctggaccagcccaccgggaagcatgatggctctgtgtttggagtgcgctacttcacctgcccccccaggcatggagtgtttgccccagccagccgcatccagagaattggaggcagcacagacagccctggggacagcgtgggcgccaagaaggtgcaccaggtgaccatgacccagcccaagaggaccttcaccaccgtgaggacccccaaggacatcgcctctgaaaattccatcagccggctgctcttctgctgctggttcccctggatgctgcgggcagagatgcagagctag

SEQ ID NO: 32783 - DNA, 1290 bp, Artificial Sequence
  Description of Artificial Sequence: Synthetic coding sequence
atgaccctgctgcactacgcctgcaaggccggggcccatggagtgggggaccctgctgctgctgtgcggctgagccagcagctgctggccctgggcgcagatgtgaccctgcggagccgctggaccaacatgaatgccctgcactacgccgcctactttgatgtgcctgacctggtgcgggtgctgctgaagggggcccggccccgggtggtgaacagcacctgcagcgacttcaaccacggcagcgccctgcacatcgccgccagcagcctgtgcctgggcgccgccaagtgcctgctggagcacggggccaacccagccctgaggaacaggaagggccaggtgcctgctgaggtggtgcctgaccccatggacatgagcctggacaaggccgaggccgccctggtggccaaggagctgcggaccctgctggaggaggccgtgcccctgagctgtgccctgcccaaggtgaccctgcccaactatgacaacgtgcccggcaacctgatgctgagcgccctgggcctgcggctgggggacagagtgctgctggatggccagaagacaggcaccctgcgcttctgtggcaccacagaatttgccagcggccagtgggtgggcgtggagctggatgagcctgagggcaagaatgatggctctgtgggcggcgtgcgctacttcatctgcccccccaagcagggcctgtttgcctctgtgtccaagatcagcaaggctgtggatgccccacccagctctgtgaccagcacccccaggacccccaggatggacttcagccgggtgacaggcaagggccggcgggagcacaagggcaagaagaagacccccagcagccccagcctgggcagcctgcagcagagagatggagccaaggccgaggtgggggaccaggtgctggtggccggccagaagcagggcatcgtgcgcttctacggcaagacagactttgcccctggctactggtacggcatcgagctggaccagcccaccgggaagcatgatggctctgtgtttggagtgcgctacttcacctgcccccccaggcatggagtgtttgccccagccagccgcatccagagaattggaggcagcacagacagccctggggacagcgtgggcgccaagaaggtgcaccaggtgaccatgacccagcccaagaggaccttcaccaccgtgaggacccccaaggacatcgcctctgaaaattccatcagccggctgctcttctgctgctggttcccctggatgctgcgggcagagatgcagagctag

SEQ ID NO: 32784 - DNA, 1059 bp, Artificial Sequence
  Description of Artificial Sequence: Synthetic coding sequence
atgaagccagccctgctggaggtgatgaggatgaaccgcatctgcaggatggtgctggccacctgcctgggcagcttcatcctggtgatcttctacttccagagcatgctgcaccctgtgatgagaagaaaccccttcggcgtggacatctgctgcaggaagggcagccgcagccccctgcaggagctgtacaaccccatccagctggagctgagcaacacagctgtgctgcaccagatgagaagagaccaggtgacagacacctgccgggccaacagcgccaccagcaggaagagaagagtgctgaccccaaatgacctgaagcacctggtggtggatgaggaccacgagctgatctactgctacgtgcccaaggtggcctgcaccaactggaagaggctgatgatggtgctgaccggccggggcaagtacagcgaccccatggagatcccagccaatgaggcccacgtgtctgccaacctgaagaccctgaaccagtacagcatccctgagatcaaccaccggctgaagagctacatgaagttcctgtttgtgcgggagccctttgagcggctggtgtctgcctacagaaacaagttcacccagaagtacaacatctccttccacaagagatatggcaccaagatcatcaagaggcagaggaagaatgccacccaggaggccctgaggaaaggagatgatgtgaagtttgaggagtttgtggcctacctgattgacccccacacccagcgggaggagcccttcaatgagcactggcagacagtgtacagcctgtgccacccctgccacatccactatgacctggtgggcaagtatgagaccctggaggaggacagcaactacgtgctgcagctggccggcgtgggcagctacctgaagttccccacctacgccaagagcaccaggaccacagatgagatgaccacagagttcttccagaacatcagcagcgagcaccagacccagctgtatgaggtgtacaagctggacttcctgatgttcaactacagcgtgcccagctacctgaagctggagtag

SEQ ID NO: 32785 - DNA, 1044 bp, Artificial Sequence
  Description of Artificial Sequence: Synthetic coding sequence
atgaagccagccctgctggaggtgatgaggatgaaccgcatctgcaggatggtgctggccacctgcctgggcagcttcatcctggtgatcttctacttccagatcatgagaagaaacccctttggagtggacatctgctgcaggaagggcagccgcagccccctgcaggagctgtacaaccccatccagctggagctgagcaacacagctgtgctgcaccagatgaggcgggaccaggtgacagacacctgccgggccaacagcgccaccagcaggaagagaagagtgctgaccccaaatgacctgaagcacctggtggtggatgaagatcatgagctgatctactgctacgtgcccaaggtggcctgcaccaactggaagaggctgatgatggtgctgaccggccggggcaagtacagcgaccccatggagatcccagccaatgaggcccacgtgtctgccaacctgaagaccctgaaccagtacagcatccctgagatcaaccaccggctgaagagctacatgaagttcctgtttgtgcgggagccctttgagcggctggtgtctgcctacagaaacaagttcacccagaagtacaacatctccttccacaagagatatggcaccaagatcatcaagaggcagaggaagaatgccacccaggaggccctgaggaaaggagatgatgtgaagtttgaggagtttgtggcctacctgattgacccccacacccagcgggaggagcccttcaatgagcactggcagacagtgtacagcctgtgccacccctgccacatccactatgacctggtgggcaagtatgagaccctggaggaggacagcaactacgtgctgcagctggccggcgtgggcagctacctgaagttccccacctacgccaagagcaccaggaccacagatgagatgaccacagagttcttccagaacatcagcagcgagcaccagacccagctgtatgaggtgtacaagctggacttcctgatgttcaactacagcgtgcccagctacctgaagctggagtag

SEQ ID NO: 32786 - DNA, 1245 bp, Artificial Sequence
  Description of Artificial Sequence: Synthetic coding sequence
atgaccaaggcccggctcttccggctgtggctggtgctgggctctgtgttcatgatcctgctgatcatcgtgtactgggacagcgctggagctgcccacttctacctgcacaccagcttcagccggccccacactggaccacccctgcccaccccaggccctgaccgggaccgggagctgacagctgacagtgatgtggatgagttcctggacaagttcctgtctgctggggtgaagcagagcgacctgcccaggaaggagacagagcagcccccagcccctggctccatggaggagagcgtgcggggctatgactggagccccagagatgcccggcgcagcccagaccagggccggcagcaggccgagcggcgctctgtgctgcggggcttctgtgccaacagcagcctggccttccccaccaaggagcgggcctttgatgacatccccaacagcgagctgagccacctgattgtggatgacagacatggagccatctactgctacgtgcccaaggtggcctgcaccaactggaagagggtgatgattgtgctgagcggcagcctgctgcacagaggagccccctacagagaccccctgcgcatcccccgggagcacgtgcacaatgccagcgcccacctgaccttcaacaagttctggaggagatatggcaagctgagccgccacctgatgaaggtgaagctgaagaagtacaccaagttcctgtttgtgcgggacccctttgtgcggctcatcagcgccttccgcagcaagtttgagctggagaatgaggagttctacaggaagtttgctgtgcccatgctgcggctgtatgccaaccacaccagcctgcctgccagcgcccgggaggccttccgggccggcctgaaggtgtcctttgccaacttcatccagtacctgctggacccccacacagagaagctggcccccttcaatgagcactggaggcaggtgtaccgcctgtgccacccctgccagattgattatgactttgtgggcaagctggagaccctggatgaagatgctgcccagctgctgcagctgctgcaggtggaccggcagctgcgcttccccccatcctacagaaacagaacagccagctcctgggaggaggactggtttgccaagatccccctggcctggaggcagcagctgtacaagctgtatgaggccgactttgtgctgtttggctaccccaagccagagaacctgctgcgggactag

SEQ ID NO: 32787 - DNA, 738 bp, Artificial Sequence
  Description of Artificial Sequence: Synthetic coding sequence
atgaccaaggcccggctcttccggctgtggctggtgctgggctctgtgttcatgatcctgctgatcatcgtgtactgggacagcgctggagctgcccacttctacctgcacaccagcttcagccggccccacactggaccacccctgcccaccccaggccctgaccgggaccgggagctgacagctgacagtgatgtggatgagttcctggacaagttcctgtctgctggggtgaagcagagcgacctgcccaggaaggagacagagcagcccccagcccctggctccatggaggagagcgtgcggggctatgactggagccccagagatgcccggcgcagcccagaccagggccggcagcaggccgagcggcgctctgtgctgcggggcttctgtgccaacagcagcctggccttccccaccaaggagcgggcctttgatgacatccccaacagcgagctgagccacctgattgtggatgacagacatggagccatctactgctacgtgcccaaggtggcctgcaccaactggaagagggtgatgattgtgctgagcggcagcctgctgcacagaggagccccctacagagaccccctgcgcatcccccgggagcacgtgcacaatgccagcgcccacctgaccttcaacaagttctggaggagatatggcaagctgagccgccacctgatgaaggtgaagctgaagaagtacaccaagttcctgtttgtgaggtag

SEQ ID NO: 32788 - DNA, 1026 bp, Artificial Sequence
  Description of Artificial Sequence: Synthetic coding sequence
atgggccgccgctgctgcagaagaagagtgctggccgccgcctgcctgggcgccgccctgctgctgctgtgtgccgcccccaggagcctgcggcctgccttcggcaacagagccctgggcagctcctggctgggcggggagaagaggagccccctgcagaagctgtatgacctggaccaggaccccaggagcaccctggccaaggtgcaccggcagaggcgggacctgctgaacagcgcctgcagccgccacagccggcggcagaggctgctgcagcctgaggacctgcggcacgtgctggtggatgatgcccacggcctgctgtactgctacgtgcccaaggtggcctgcaccaactggaagagggtgctgctggccctgagcggccaggcccggggggacccccgggccatcagcgcccaggaggcccacgcccctggccgcctgcccagcctggccgacttctccccagctgagatcaacagaaggctgcgggcctacctggccttcctgtttgtgcgggagccctttgagcggctggccagcgcctacagaaacaagctggcccggccctacagcgctgccttccagaggcgctacggggcccgcatcgtgcagaggctgcggccccgggccctgcctgatgcccgggcccggggccatgatgtgcgctttgctgagttcctggcctacctgctggaccccaggacccggcgggaggagcccttcaatgagcactgggagcgggcccacgccctgtgccacccctgccgcctgcgctatgatgtggtgggcaagtttgagaccctggccgaggatgctgcctttgtgctgggcctggccggggccagtgacctgtccttccctggccccccccggcccagaggagctgctgccagccgggacctggccgcccggctcttccgggacatcagccccttctaccagaggcggctgtttgacctgtacaagatggacttcctgctcttcaactacagcgcccccagctacctgcggctgctgtag

SEQ ID NO: 32789 - DNA, 678 bp, Artificial Sequence
  Description of Artificial Sequence: Synthetic coding sequence
atgggccgccgctgctgcagaagaagagtgctggccgccgcctgcctgggcgccgccctgctgctgctgtgtgccgcccccaggagcctgcggcctgccttcggcaacagagccctgggcagctcctggctgggcggggagaagaggagccccctgcagaagctgtatgacctggaccaggaccccaggagcaccctggccaaggtgcaccggcagaggcgggacctgctgaacagcgcctgcagccgccacagccggcggcagaggctgctgcagcctgaggacctgcggcacgtgctggtggatgatgcccacggcctgctgtactgctacgtgcccaaggtggcctgcaccaactggaagagggtgctgctggccctgagcggccaggcccggggggacccccgggccatcagcgcccaggaggcccacgcccctggccgcctgcccagcctggccgacttctccccagctgagatcaacagaaggctgcgggcctacctggccttcctgtttgtgcgggagccctttgagcggctggccagcgcctacagaaacaagctggcccggaccaggtctgccaccagggtggccagcgccaccacctcctgggccagcagccgccgctggaggaggacccggcccagctgctgggcctggagggcccaccccacctag

SEQ ID NO: 32790 - DNA, 1161 bp, Artificial Sequence
  Description of Artificial Sequence: Synthetic coding sequence
atgctgctgcccaagaagatgaagctgctgctcttcctggtgtcccagatggccatcctggccctcttcttccacatgtacagccacaacatcagcagcctgtccatgaaggcccagcctgagaggatgcacgtgctggtgctgagctcctggaggagcggcagcagctttgtgggccagctgtttggccagcacccagatgtgttctacctgatggagcccgcctggcacgtgtggatgaccttcaagcagagcacagcctggatgctgcacatggctgtgcgggacctgatccgggctgtgttcctgtgtgacatgtctgtgtttgatgcctacatggagcccggcccccggcggcagagcagcctcttccagtgggagaacagccgggccctgtgcagcgccccagcctgtgacatcatcccccaggatgagatcatcccccgggcccactgccgcctgctgtgcagccagcagccctttgaggtggtggagaaggcctgccgcagctacagccacgtggtgctgaaggaggtgcgcttcttcaacctgcagagcctgtaccccctgctgaaggaccccagcctgaacctgcacatcgtgcacctggtgcgggaccccagggctgtgttccgcagccgggagaggaccaagggggacctgatgattgacagcagaattgtgatgggccagcacgagcagaagctgaagaaggaggaccagccctactacgtgatgcaggtgatctgccagagccagctggagatctacaagaccatccagagcctgcccaaggccctgcaggagcgctacctgctggtgcgctatgaggacctggcccgggcccctgtggcccagaccagcaggatgtatgaatttgtgggcctggagttcctgccccacctgcagacctgggtgcacaacatcacccggggcaagggcatgggagaccacgccttccacaccaatgccagagatgccctgaatgtgtcccaggcctggcgctggagcctgccctatgagaaggtgtcccggctgcagaaggcctgtggagatgccatgaacctgctgggctacagacatgtgcgctctgagcaggagcagaggaacctgctgctggacctgctgagcacctggacagtgcctgagcagatccactag

SEQ ID NO: 32791 - DNA, 1161 bp, Artificial Sequence; identical to SEQ ID NO: 32790
  Description of Artificial Sequence: Synthetic coding sequence

SEQ ID NO: 32792 - DNA, 918 bp, Artificial Sequence
  Description of Artificial Sequence: Synthetic coding sequence
atgctgggcaggaacacctggaagaccagcgccttctccttcctggtggagcagatgtgggcccccctgtggagccgctccatgaggcctggccgctggtgcagccagaggagctgtgcctggcagaccagcaacaacaccctgcaccccctgtggacagtgcctgtgtctgtgcctgggggcacccggcagagccccatcaacatccagtggagggacagcgtgtatgacccccagctgaagcccctgcgggtgtcctatgaagctgccagctgcctgtacatctggaacacaggctacctgttccaggtggagtttgatgatgccacagaggccagcggcatcagcggcggccccctggagaaccactaccgcctgaagcagttccacttccactggggcgctgtgaatgaaggaggcagcgagcacacagtggatggccacgcctacccagctgagctgcacctggtgcactggaacagcgtgaagtaccagaactacaaggaggccgtggtgggggagaatggcctggccgtcatcggggtcttcctgaagctgggcgcccaccaccagaccctgcagaggctggtggacatcctgcctgagatcaagcacaaggatgcccgggccgccatgaggccctttgaccccagcaccctgctgcccacctgctgggactactggacctacgccggcagcctgaccaccccacccctgacagagagcgtgacctggatcatccagaaggagcctgtggaggtggcccccagccagctgagcgccttccgcaccctgctcttcagcgccctgggggaggaggagaagatgatggtgaacaactaccggcccctgcagcccctgatgaacaggaaggtgtgggccagcttccaggccaccaatgaaggcaccaggagctag

SEQ ID NO: 32793 - DNA, 714 bp, Artificial Sequence
  Description of Artificial Sequence: Synthetic coding sequence
atggacaaggtgtgtgctgtgtttggaggcagccggggcatcggccgggctgtggcccagctgatggccaggaagggctaccgcctggccgtcatcgccaggaacctggagggcgccaaggctgctgctggggacctgggcggggaccacctggccttcagctgtgatgtggccaaggagcatgatgtgcagaacacctttgaggagctggagaagcacctgggccgggtgaacttcctggtgaatgctgctggcatcaacagagatggcctgctggtgaggaccaagacagaggacatggtgtcccagctgcacaccaacctgctgggctccatgctgacctgcaaggccgccatgaggaccatgatccagcagcagggcggcagcatcgtgaatgtgggcagcatcgtgggcctgaagggcaacagcggccagagcgtgtacagcgccagcaagggcggcctggtgggcttcagccgggccctggccaaggaggtggccaggaagaagatccgggtgaatgtggtggcccctggctttgtgcacacagacatgaccaaggacctgaaggaggagcacctgaagaagaacatccccctgggccgctttggagagaccatcgaggtggcccatgctgtggtgttcctgctggagagcccctacatcactggacatgtgctggtggtggatggcggcctgcagctgatcctgtag

SEQ ID NO: 32794 - DNA, 540 bp, Artificial Sequence
  Description of Artificial Sequence: Synthetic coding sequence
atggacaaggtgtgtgctgtgtttggaggcagccggggcatcggccgggctgtggcccagctgatggccaggaagggctaccgcctggccgtcatcgccaggaacctggagggcgccaaggctgctgctggggacctgggcggggaccacctggccttcagctgtgatgtggccaaggagcatgatgtgcagaacacctttgaggagctggagaagcacctgggccgggtgaacttcctggtgaatgctgctggcatcaacagagatggcctgctggtgaggaccaagacagaggacatggtgtcccagctgcacaccaacctgctgggctccatgctgacctgcaaggccgccatgaggaccatgatccagcagcagggcggcagcatcgtgaatgtgggcagcatcgtgggcctgaagggcaacagcggccagagcgtgtacagcgccagcaagggcggcctggtgggcttcagccgggccctggccaaggaggtggccaggaagaagatccgggtgaatgtggtggcccctggatag

SEQ ID NO: 32795 - DNA, 1872 bp, Artificial Sequence
  Description of Artificial Sequence: Synthetic coding sequence
atgacagcccagagccgcagccccaccacccccaccttccctggccccagccagaggacccccctgaccccctgccctgtgcagaccccccggctgggcaaggccctgatccactgctggacagatcctggccagcccctgggggagcagcagagggtgcggcggcagaggacagagaccagcgagcccaccatgaggctgcaccggctgcgggcccggctgtctgctgtggcctgtggcctgctgctgctgctggtgcggggccagggccaggacagcgccagccccatccgcaccacccacacaggccaggtgctgggcagcctggtgcacgtgaagggggccaatgccggcgtgcagaccttcctgggcatcccctttgccaagccacccctgggccccctgcgctttgcccctcctgagcccccagagagctggagcggcgtgagagatggcaccacccacccagccatgtgcctgcaggacctgacagctgtggagagcgagttcctgagccagttcaacatgaccttccccagcgacagcatgtctgaggactgcctgtacctgagcatctacaccccagcccacagccatgagggcagcaacctgcctgtgatggtgtggattcatggaggagccctggtgtttggcatggccagcctgtatgatggctccatgctggccgccctggagaatgtggtggtggtgatcatccagtaccgcctgggcgtgctgggcttcttcagcactggagacaagcacgccactggaaactggggctacctggaccaggtggccgccctgcgctgggtgcagcagaacatcgcccactttggaggcaacccagacagagtgaccatctttggagagagcgctgggggcacctctgtgagcagcctggtggtgagccccatcagccagggcctcttccacggggccatcatggagagcggcgtggccctgctgcccggcctgattgccagcagcgcagatgtgatcagcacagtggtggccaacctgagcgcctgtgaccaggtggacagcgaggccctggtgggctgcctgcggggcaagagcaaggaggagatcctggccatcaacaagcccttcaagatgatccctggggtggtggatggagtcttcctgcccaggcacccccaggagctgctggccagcgctgacttccagcctgtgcccagcatcgtgggcgtgaacaacaatgaatttggctggctgatccccaaggtgatgaggatctatgacacccagaaggagatggaccgggaggccagccaggccgccctgcagaagatgctgaccctgctgatgctgccccccacctttggagacctgctgcgggaggagtacatcggggacaatggagacccccagaccctgcaggcccagttccaggagatgatggctgacagcatgtttgtgatcccagccctgcaggtggcccacttccagtgcagccgggcccctgtgtacttctatgagttccagcaccagcccagctggctgaagaacatccggcccccccacatgaaggctgaccatggagatgagctgccctttgtgttccgctccttctttggaggcaactacatcaagttcacagaggaggaggagcagctgagcaggaagatgatgaagtactgggccaactttgccagaaatggaaaccccaatggagagggcctgccccactggcccctgtttgaccaggaggagcagtacctgcagctgaacctgcagcctgctgtgggccgggccctgaaggcccaccggctgcagttctggaagaaggccctgccccagaagatccaggagctggaggagcctgaggagcggcacacagagctgtag

SEQ ID NO: 32796 - DNA, 1824 bp, Artificial Sequence
  Description of Artificial Sequence: Synthetic coding sequence
atgacagcccagagccgcagccccaccacccccaccttccctggccccagccagaggacccccctgaccccctgccctgtgcagaccccccggctgggcaaggccctgatccactgctggacagatcctggccagcccctgggggagcagcagagggtgcggcggcagaggacagagaccagcgagcccaccatgaggctgcaccggctgcgggcccggctgtctgctgtggcctgtggcctgctgctgctgctggtgcggggccagggccaggacagcgccagccccatccgcaccacccacacaggccaggtgctgggcagcctggtgcacgtgaagggggccaatgccggcgtgcagaccttcctgggcatcccctttgccaagccacccctgggccccctgcgctttgcccctcctgagcccccagagagctggagcggcgtgagagatggcaccacccacccagccatgtgcctgcaggacctgacagctgtggagagcgagttcctgagccagttcaacatgaccttccccagcgacagcatgtctgaggactgcctgtacctgagcatctacaccccagcccacagccatgagggcagcaacctgcctgtgatggtgtggattcatggaggagccctggtgtttggcatggccagcctgtatgatggctccatgctggccgccctggagaatgtggtggtggtgatcatccagtaccgcctgggcgtgctgggcttcttcagcactggagacaagcacgccactggaaactggggctacctggaccaggtggccgccctgcgctgggtgcagcagaacatcgcccactttggaggcaacccagacagagtgaccatctttggagagagcgctgggggcacctctgtgagcagcctggtggtgagccccatcagccagggcctcttccacggggccatcatggagagcggcgtggccctgctgcccggcctgattgccagcagcgcagatgtgatcagcacagtggtggccaacctgagcgcctgtgaccaggtggacagcgaggccctggtgggctgcctgcggggcaagagcaaggaggagatcctggccatcaacaagcccttcaagatgatccctggggtggtggatggagtcttcctgcccaggcacccccaggagctgctggccagcgctgacttccagcctgtgcccagcatcgtgggcgtgaacaacaatgaatttggctggctgatccccaaggtgatgaggatctatgacacccagaaggagatggaccgggaggccagccaggccgccctgcagaagatgctgaccctgctgatgctgccccccacctttggagacctgctgcgggaggagtacatcggggacaatggagacccccagaccctgcaggcccagttccaggagatgatggctgacagcatgtttgtgatcccagccctgcaggtggcccacttccagtgcagccgggcccctgtgtacttctatgagttccagcaccagcccagctggctgaagaacatccggcccccccacatgaaggctgaccacgtgaagttcacagaggaggaggagcagctgagcaggaagatgatgaagtactgggccaactttgccagaaatggaaaccccaatggagagggcctgccccactggcccctgtttgaccaggaggagcagtacctgcagctgaacctgcagcctgctgtgggccgggccctgaaggcccaccggctgcagttctggaagaaggccctgccccagaagatccaggagctggaggagcctgaggagcggcacacagagctgtag

SEQ ID NO: 32797 - DNA, 903 bp, Artificial Sequence
  Description of Artificial Sequence: Synthetic coding sequence
atggagatccccatgggcacccagggctgcttcagcaagagcctgctgctgagcgccagcatcctggtgctgtggatgctgcagggcagccaggccgccctgtacatccagaagatccctgagcagccccagaagaaccaggacctgctgctgtctgtgcagggcgtgcctgacaccttccaggacttcaactggtacctgggggaggagacctacggcggcaccaggctcttcacctacatccctggcatccagaggccccagagagatggcagcgccatgggccagagggacatcgtgggcttccccaacggctccatgctgctgcggcgggcccagcccacagattctggcacctaccaggtggccatcaccatcaacagcgagtggaccatgaaggccaagacagaggtgcaggtggccgagaagaacaaggagctgcccagcacccacctgcccaccaatgccggcatcctggccgccaccatcatcggcagcctggccgccggggccctgctgatcagctgcatcgcctacctgctggtgaccaggaactggaggggccagagccaccggctgcctgccccccggggccagggcagcctgagcatcctgtgcagcgctgtgtcccctgtgcccagcgtgacccccagcacctggatggccaccacagagaagccagagctgggccctgcccatgatgctggggacaacaacatctatgaggtgatgcccagccctgtgctgctggtgagccccatcagtgacaccaggagcatcaacccagcccggcccctgcccaccccaccccacctgcaggccgagcctgagaaccaccagtaccagcaggacctgctgaacccagaccctgccccctactgccagctggtgcccaccagctag

SEQ ID NO: 32798 - DNA, 900 bp, Artificial Sequence
  Description of Artificial Sequence: Synthetic coding sequence
atggagatccccatgggcacccagggctgcttcagcaagagcctgctgctgagcgccagcatcctggtgctgtggatgctgcagggcagccaggccgccctgtacatccagaagatccctgagcagccccagaagaaccaggacctgctgctgtctgtgcagggcgtgcctgacaccttccaggacttcaactggtacctgggggaggagacctacggcggcaccaggctcttcacctacatccctggcatccagaggccccagagagatggcagcgccatgggccagagggacatcgtgggcttccccaacggctccatgctgctgcggcgggcccagcccacagattctggcacctaccaggtggccatcaccatcaacagcgagtggaccatgaaggccaagacagaggtgcaggtggccgagaagaacaaggagctgcccagcacccacctgcccaccaatgccggcatcctggccgccaccatcatcggcagcctggccgccggggccctgctgatcagctgcatcgcctacctgctggtgaccaggaactggaggggccagagccaccggctgcctgccccccggggccagggcagcctgagcatcctgtgcagcgctgtgtcccctgtgcccagcgtgacccccagcacctggatggccaccacagagaagccagagctgggccctgcccatgatgctggggacaacaacatctatgaggtgatgcccagccctgtgctgctggtgagccccatcagtgacaccaggagcatcaacccagcccggcccctgcccaccccaccccacctgcaggccgagcctgagaaccaccagtaccaggacctgctgaacccagaccctgccccctactgccagctggtgcccaccagctag

SEQ ID NO: 32799 - DNA, 879 bp, Artificial Sequence
  Description of Artificial Sequence: Synthetic coding sequence
atgggccccccatctgcctgcccccaccgggagtgcatcccctggcagggcctgctgctgacagccagcctgctgaccttctggaatgcccccaccacagcctggctgttcatcgccagcgccccctttgaggtggccgagggagaaaatgtgcacctgtctgtggtgtacctgcctgagaacctgtacagctatggctggtacaagggcaagacagtggagcccaaccagctgattgctgcctacgtgattgacacccacgtgaggaccccaggccctgcctacagcggccgggagaccatcagccccagcggggacctgcacttccagaatgtgaccctggaggacaccggctactacaccctgcaggtgacctacagaaacagccagatcgagcaggccagccaccacctgcgggtgtatgaatctgtggcccagcccagcatccaggccagcagcaccaccgtgacagagaagggctctgtggtgctgacctgccacaccaacaacacaggcaccagcttccagtggatcttcaacaaccagaggctgcaggtgaccaagaggatgaagctgtcctggttcaaccacatgctgaccatcgaccccatccggcaggaggatgctggggagtaccagtgtgaggtgagcaaccctgtgagcagcaacagaagtgaccccctgaagctgactgtgaagtatgacaacaccctgggcatcctgattggagtgctggtgggcagcctgctggtggccgccctggtgtgcttcctgctgctgaggaagacaggccgggccagtgaccagagcgacttccgggagcagcagcccccagccagcaccccaggccacggccccagcgacagcagcatctcctag

SEQ ID NO: 32800 - DNA, 882 bp, Artificial Sequence
  Description of Artificial Sequence: Synthetic coding sequence
atgggccccccatctgcctgcccccaccgggagtgcatcccctggcagggcctgctgctgacagccagcctgctgaccttctggaatgcccccaccacagcctggctgttcatcgccagcgccccctttgaggtggccgagggagaaaatgtgcacctgtctgtggtgtacctgcctgagaacctgtacagctatggctggtacaagggcaagacagtggagcccaaccagctgattgctgcctacgtgattgacacccacgtgaggaccccaggccctgcctacagcggccgggagaccatcagccccagcggggacctgcacttccagaatgtgaccctggaggacaccggctactacaccctgcaggtgacctacagaaacagccagatcgagcaggccagccaccacctgcgggtgtatgaatctgtggcccagcccagcatccaggccagcagcaccaccgtgacagagaagggctctgtggtgctgacctgccacaccaacaacacaggcaccagcttccagtggatcttcaacaaccagaggctgcaggtgaccaagaggatgaagctgtcctggttcaaccacatgctgaccatcgaccccatccggcaggaggatgctggggagtaccagtgtgaggtgagcaaccctgtgagcagcaacagaagtgaccccctgaagctgactgtgaagagtgatgacaacaccctgggcatcctgattggagtgctggtgggcagcctgctggtggccgccctggtgtgcttcctgctgctgaggaagacaggccgggccagtgaccagagcgacttccgggagcagcagcccccagccagcaccccaggccacggccccagcgacagcagcatctcctag

SEQ ID NO: 32801 - DNA, 900 bp, Artificial Sequence
  Description of Artificial Sequence: Synthetic coding sequence
atgatggcctacatgaaccctggcccccactacagcgtgaatgccctggccctgagcggccccagcgtggacctgatgcaccaggccgtgccctaccccagcgcccccaggaagcagaggcgggagaggaccaccttcaccaggagccagctggaggagctggaggccctgtttgccaagacccagtacccagatgtgtatgcccgggaggaggtggccctgaagatcaacctgcctgagagccgggtgcaggtgtggttcaagaacagaagagccaagtgccggcagcagaggcagcagcagaagcagcagcagcagcccccaggcggccaggccaaggcccggcctgccaagaggaaggccggcaccagcccccggcccagcacagatgtgtgcccagaccccctgggcatcagtgacagctacagcccccccctgcccggccccagcggcagccccaccacagctgtggccaccgtgtccatctggagccctgccagcgagagccccctgcctgaggcccagagagctggcctggtggccagcggccccagcctgaccagcgccccctatgccatgacctacgccccagccagcgccttctgcagcagccccagcgcctacggcagccccagcagctacttcagcggcctggacccctacctgagccccatggtgccccagctgggcggccctgccctgagccccctgagcggccccagcgtgggccccagcctggcccagagccccaccagcctgagcggccagagctatggagcctacagccctgtggacagcctggagttcaaggaccccaccggcacctggaagttcacctacaaccccatggaccccctggactacaaggaccagagcgcctggaagttccagatcctgtag

SEQ ID NO: 32802 - DNA, 639 bp, Artificial Sequence
  Description of Artificial Sequence: Synthetic coding sequence
atgggccccccatctgccagcccccaccgggagtgcatcccctggcagggcctgctgctgacagccagcctgctgaacttctggaacccccccaccacagccaagctgaccatcgagagcatgcccctgtctgtggccgagggcaaggaggtgctgctgctggtgcacaacctgccccagcacctgtttggctacagctggtacaagggggagcgggtggatggcaacagcctgattgtgggctacgtgattggcacccagcaggccaccccaggagctgcctacagcggccgggagaccatctacaccaatgccagcctgctgatccagaatgtgacccagaatgacatcggcttctacaccctgcaggtgatcaagagtgacctggtgaatgaggaggccaccggccagttccacgtgtaccaggagaatgcccctggcctgcctgtgggcgctgtggccggcatcgtgactggagtgctggtgggcgtggccctggtggccgccctggtgtgcttcctgctgctggccaagacaggccggccctggagcctgccccagctgtgcctgctggatgtgcccagcctgcactgccccggcccccccacccagccccaggacagcagcttccacctgtag

SEQ ID NO: 32803 - DNA, 759 bp, Artificial Sequence
  Description of Artificial Sequence: Synthetic coding sequence
atgggccccccatctgccagcccccaccgggagtgcatcccctggcagggcctgctgctgacagccagcctgctgaacttctggaacccccccaccacagccaagctgaccatcgagagcatgcccctgtctgtggccgagggcaaggaggtgctgctgctggtgcacaacctgccccagcacctgtttggctacagctggtacaagggggagcgggtggatggcaacagcctgattgtgggctacgtgattggcacccagcaggccaccccaggagctgcctacagcggccgggagaccatctacaccaatgccagcctgctgatccagaatgtgacccagaatgacatcggcttctacaccctgcaggtgatcaagagtgacctggtgaatgaggaggccaccggccagttccacgtgtaccaggagaatgcccctggcctgcctgtgggcgctgtggccggcatcgtgactggagtgctggtgggcgtggccctggtggccgccctggtgtgcttcctgctgctggccaagacaggccgcaccagcatccagagggacctgaaggagcagcagccccaggccctggcccctggccggggccccagccacagcagcgccttctccatgagccccctgagcacagcccaggcccccctgcccaaccccaggacagctgccagcatctatgaggagctgctgaagcatgacaccaacatctactgcaggatggaccacaaggccgaggtggccagctag

SEQ ID NO: 32804 - DNA, 534 bp, Artificial Sequence
  Description of Artificial Sequence: Synthetic coding sequence
atgggccccccatctgccagcccccaccgggagtgcatcccctggcagggcctgctgctgacagccagcctgctgaacttctggaacccccccaccacagccaagctgaccatcgagagcatgcccctgtctgtggccgagggcaaggaggtgctgctgctggtgcacaacctgccccagcacctgtttggctacagctggtacaagggggagcgggtggatggcaacagcctgattgtgggctacgtgattggcacccagcaggccaccccaggagctgcctacagcggccgggagaccatctacaccaatgccagcctgctgatccagaatgtgacccagaatgacatcggcttctacaccctgcaggtgatcaagagtgacctggtgaatgaggaggccaccggccagttccacgtgtacccagagctgcccaagcccagcatcagcagcaacaacagcaaccccaaggaggacaaggatgctgtggccttcacctgtgagcctgagatccacagcaccacctgcctgtag

SEQ ID NO: 32805 - DNA, 774 bp, Artificial Sequence
  Description of Artificial Sequence: Synthetic coding sequence
atggccgccccctgggccagcctgcggctggtggcccccatgtggaatggccgcatccggggcatccaccggctgggcgctgctgtggcccctgagggcaaccagaagaagaagaggaccatcctgcagttcctgaccaactacttctatgatgtggaggccctgcgggactacctgctgcagcgggagatgtacaaggtgcatgagaagaacagaagctacacctggctggagaagcagcacggcccctacggggccggggccttcttcatcctgaagcagggcggcgctgtgaagttccgggacaaggagtggatccggccagacaagtatggccacttcagccaggagttctggaacttctgtgaggtgcctgtggaggccgtggatgctggggactgtgacatcaactatgagggcctggacaacctgctgcggctgaaggagctgcagagcctgagcctgcagcgctgctgccacgtggatgactggtgcctgagccggctgtaccccctggccgacagcctgcaggagctgagcctggccggctgcccccgcatcagcgagcggggcctggcctgcctgcaccacctgcagaacctgcggcggctggacatcagtgacctgcctgctgtgagcaaccctggcctgacccagatcctggtggaggagatgctgcccaactgtgaggtggtgggcgtggactgggccgagggcctgaagagcggccctgaggagcagccccgggacacagccagccctgtgcctgcctag

SEQ ID NO: 32806 - DNA, 798 bp, Artificial Sequence
  Description of Artificial Sequence: Synthetic coding sequence
atgggcagccccagcgcctgcccctacagagtgtgcatcccctggcagggcctgctgctgacagccagcctgctgaccttctggaacctgcccaacagcgcccagaccaacattgatgtggtgcccttcaacgtggccgagggcaaggaggtgctgctggtggtgcacaatgaaagccagaacctgtatggctacaactggtacaagggggagcgggtgcacgccaactaccgcatcatcggctacgtgaagaacatcagccaggagaatgcccctggccctgcccacaacggccgggagaccatctacccaaatggcaccctgctgatccagaatgtgacccacaatgatgctggcttctacaccctgcacgtgatcaaggagaacctggtgaatgaggaggtgacccggcagttctacgtgttttctgagccccccaagcccagcatcaccagcaacaacttcaaccctgtggagaacaaggacatcgtggtgctgacctgccagcctgagacccagaacaccacctacctgtggtgggtgaacaaccagagcctgctggtgagcccccggctgctgctgagcacagacaacagaaccctggtgctgctgagcgccaccaagaatgacatcggcccctatgaatgtgagatccagaaccctgtgggcgccagcagaagtgaccctgtgaccctgaatgtgcgctatgagagcgtgcaggccagcagcccagacctgtctgctggaacagctgtgtccatcatgattggagtgctggccggcatggccctgatctag

SEQ ID NO: 32807 - DNA, 519 bp, Artificial Sequence
  Description of Artificial Sequence: Synthetic coding sequence
atgggcagccccagcgcctgcccctacagagtgtgcatcccctggcagggcctgctgctgacagccagcctgctgaccttctggaacctgcccaacagcgcccagaccaacattgatgtggtgcccttcaacgtggccgagggcaaggaggtgctgctggtggtgcacaatgaaagccagaacctgtatggctacaactggtacaagggggagcgggtgcacgccaactaccgcatcatcggctacgtgaagaacatcagccaggagaatgcccctggccctgcccacaacggccgggagaccatctacccaaatggcaccctgctgatccagaatgtgacccacaatgatgctggcttctacaccctgcacgtgatcaaggagaacctggtgaatgaggaggtgacccggcagttctacgtgttctatgaatctgtgcaggccagcagcccagacctgtctgctggaacagctgtgtccatcatgattggagtgctggccggcatggccctgatctag

SEQ ID NO: 32808 - DNA, 798 bp, Artificial Sequence; identical to SEQ ID NO: 32806
  Description of Artificial Sequence: Synthetic coding sequence

SEQ ID NO: 32809 - DNA, 735 bp, Artificial Sequence
  Description of Artificial Sequence: Synthetic coding sequence
atgggcagccccagcgcctgcccctacagagtgtgcatcccctggcagggcctgctgctgacagccagcctgctgaccttctggaacctgcccaacagcgcccagaccaacattgatgtggtgcccttcaacgtggccgagggcaaggaggtgctgctggtggtgcacaatgaaagccagaacctgtatggctacaactggtacaagggggagcgggtgcacgccaacggccgggagaccatctaccccaacggcaccctgctgatccagaatgtgacccacaatgatgctggcttctacaccctgcacgtgatcaaggagaacctggtgaatgaggaggtgacccggcagttctacgtgttcagcgagccccccaagcccagcatcaccagcaacaacttcaaccctgtggagaacaaggacatcgtggtgctgacctgccagcctgagacccagaacaccacctacctgtggtgggtgaacaaccagagcctgctggtgagcccccggctgctgctgagcacagacaacagaaccctggtgctgctgagcgccaccaagaatgacatcggcccctatgaatgtgagatccagaaccctgtgggcgccagcagaagtgaccctgtgaccctgaatgtgcgctatgaatctgtgcaggccagcagcccagacctgtctgctggaacagctgtgtccatcatgattggagtgctggccggcatggccctgatctag

SEQ ID NO: 32810 - DNA, 2361 bp, Artificial Sequence
  Description of Artificial Sequence: Synthetic coding sequence
atgaagggcaccggcatcatggactgtgcccccaaggccctgctggcccgggccctgtatgacaactgcccagactgcagtgatgagctggccttcagcagaggagacatcctgaccatcctggagcagcacgtgcctgagagcgagggctggtggaagtgcctgctgcacggccggcagggcctggccccagccaaccggctgcagatcctgacagaggtggccgctgaccggccctgcccccccttcctgcggggcctggaggaggccccagccagcagcgaggagacctaccaggtgcccaccctgccccggccccccaccccaggccctgtgtatgagcagatgaggtcctgggccgagggcccccagcccccaacagcccaggtgtatgagttcccagacccccccaccagcgcccgcatcatctgtgagaagaccctgtccttccccaagcaggccatcctgaccctgcccaggcctgtgcgggccagcctgcccaccctgcccagccaggtgtatgatgtgcccacccagcaccggggccctgtggtgctgaaggagcctgagaagcagcagctgtatgacatcccagccagccccaagaaggccggcctgcaccccccagacagccaggccagcggccagggcgtgcccctcatctctgtgaccaccctgcggcggggcggctacagcaccctgcccaacccccagaagtctgagtggatctatgacacccctgtgtcccctgggaaggcctctgtgaggaacacccccctgaccagctttgctgaggagagccggccccacgccctgcccagcagcagcagcaccttctacaacccccccagcggccgcagccgcagcctgaccccccagctgaacaacaacgtgcccatgcagaagaagctgagcctgcctgagatccccagctatggcttcctggtgccccggggcaccttccccctggatgaagatgtgtcctacaaggtgcccagcagcttcctgatcccccgggtggagcagcagaacaccaagcccaacatctatgacatccccaaggccaccagctctgtgtcccaggccggcaaggagctggagaaggccaaggaggtgtctgagaacagcgctggccacaacagctcctggttcagcaggaggaccaccagccccagccctgagccagaccggctgagcggcagcagcagtgacagccgggccagcatcgtgagcagctgcagcaccaccagcacagatgacagcagcagcagcagcagcgaggagagcgccaaggagctgagcctggacctggatgtggccaaggagaccgtgatggccctgcagcacaaggtggtgtcctctgtggccggcctgatgctgtttgtgtccaggaagtggaggttccgggactacctggaggccaacattgatgccatccacaggagcacagaccacatcgaggagagcgtgcgggagttcctggactttgcccggggcgtgcatggaacagcctgcaacctgacagacagcaacctgcagaaccgcatccgggaccagatgcagaccatcagcaacagctaccgcatcctgctggagaccaaggagagcctggacaacagaaactggcccctggaggtgctggtgacagattctgtgcagaacagcccagatgacctggagagatttgtgatggtggccaggatgctgcctgaggacatcaagagatttgccagcatcgtgattgccaacggccgcctgctcttcaagaggaactgtgagaaggaggagaccgtgcagctgaccccaaatgctgagttcaagtgtgagaagtacatccagcccccccagcgggagacagagagccaccagaagagcacccccagcaccaagcagagagaagatgagcacagcagcgagctgctgaagaagaacagagccaacatctgtggccagaaccctggccccctcatcccccagcccagcagccagcagaccccagagaggaagccccggctgtctgagcactgccgcctgtactttggagccctcttcaaggccatcagcgccttccacggcagcctgagcagcagccagcctgctgagatcatcacccagagcaagctggtgatcatggtgggccagaagctggtggacaccctgtgcatggagacccaggagagagatgtgagaaatgagatcctgcggggcagcagccacctgtgcagcctgctgaaggatgtggccctggccaccaagaatgctgtgctgacctaccccagccctgctgccctgggccacctgcaggccgaggccgagaagctggagcagcacacccggcagttccggggcaccctgggctag

SEQ ID NO: 32811 - DNA, 2361 bp, Artificial Sequence; identical to SEQ ID NO: 32810
  Description of Artificial Sequence: Synthetic coding sequence

SEQ ID NO: 32812 - DNA, 1050 bp, Artificial Sequence
  Description of Artificial Sequence: Synthetic coding sequence
atgaagggcaccggcatcatggactgtgcccccaaggccctgctggcccgggccctgtatgacaactgcccagactgcagtgatgagctggccttcagcagaggagacatcctgaccatcctggagcagcacgtgcctgagagcgagggctggtggaagtgcctgctgcacggccggcagggcctggccccagccaaccggctgcagatcctgacagaggtggccgctgaccggccctgcccccccttcctgcggggcctggaggaggccccagccagcagcgaggagacctaccaggtgcccaccctgccccggccccccaccccaggccctgtgtatgagcagatgaggtcctgggccgagggcccccagcccccaacagcccaggtgtatgagttcccagacccccccaccagcgcccgcatcatctgtgagaagaccctgtccttccccaagcaggccatcctgaccctgcccaggcctgtgcgggccagcctgcccaccctgcccagccaggtgtatgatgtgcccacccagcaccggggccctgtggtgctgaaggagcctgagaagcagcagctgtatgacatcccagccagccccaagaaggccggcctgcaccccccagacagccaggccagcaaccctggccccctcatcccccagcccagcagccagcagaccccagagaggaagccccggctgtctgagcactgccgcctgtactttggagccctcttcaaggccatcagcgccttccacggcagcctgagcagcagccagcctgctgagatcatcacccagagcaagctggtgatcatggtgggccagaagctggtggacaccctgtgcatggagacccaggagagagatgtgagaaatgagatcctgcggggcagcagccacctgtgcagcctgctgaaggatgtggccctggccaccaagaatgctgtgctgacctaccccagccctgctgccctgggccacctgcaggccgaggccgagaagctggagcagcacacccggcagttccggggcaccctgggctag

SEQ ID NO: 32813 - DNA, 687 bp, Artificial Sequence
  Description of Artificial Sequence: Synthetic coding sequence
atgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggcatcgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctactttggaacaggcttcccccacatgctgttcatggtgcaccctgagtaccggcccaagaggcctgccaaccagtttgtgcccagcagctgcagccgccacccagatgtgcccctgctgccccggcggcggcccttctgcaggatgcacttccggctgcgggaggtgtaccaccagcagctgatccctgtgcacggggaccaccacctgctgtag

SEQ ID NO: 32814 - DNA, 1182 bp, Artificial Sequence
  Description of Artificial Sequence: Synthetic coding sequence
atgtatgcctggttcttcctgcccagcttcagccagagcccccccaccttcggcttcctgctggacattgatggagtgctggtgcggggccacagggtcatcccagctgccctgaaggccttccggcggctggtgaacagccagggccagctgcgggtgcctgtggtgtttgtgaccaatgccggcaacatcctgcagcacagcaaggcccaggagctgagcgccctgctgggctgtgaggtggatgctgaccaggtgatcctgagccacagccccatgaagctgttcagcgagtaccacgagaagaggatgctggtgtctggccagggccctgtgatggagaatgcccagggcctgggcttcagaaatgtggtgacagtggatgagctgaggatggccttccccctgctggacatggtggacctggagcggcggctgaagaccacccccctgcccagaaatgacttccccagaattgaaggagtgctgctgctgggggagcctgtgcgctgggagaccagcctgcagctgatcatggatgtgctgctgagcaatggcagccctggggccggcctggccaccccaccctacccccacctgcctgtgctggccagcaacatggacctgctgtggatggccgaggccaagatgccccgcttcggccacggcaccttcctgctgtgcctggagaccatctaccagaaggtgacaggcaaggagctgcgctatgagggcctgatgggcaagcccagcatcctgacctaccagtatgcagaagatctcatccggcggcaggccgagcggcggggctgggccgcccccatcaggaagctgtatgctgtgggggacaaccccatgtctgatgtgtatggagccaacctcttccaccagtacctgcagaaggccacccatgatggagcccctgagctgggcgctgggggcacccggcagcagcagcccagcgccagccagagctgcatcagcatcctggtgtgcacaggagtgtacaaccccaggaacccccagagcacagagcctgtgctgggcggcggggagccccccttccacggccaccgggacctgtgcttcagccctggcctgatggaggccagccacgtggtgaatgatgtgaatgaggccgtgcagctggtgttcaggaaggagggctgggccctggagtag

SEQ ID NO: 32815 - DNA, 1272 bp, Artificial Sequence
  Description of Artificial Sequence: Synthetic coding sequence
atggccgcctggggctgtgtggccgccctgggcgccgcccggggcctgtgctggagggctgcccgggctgctgctggcctgcagggccgcccagcccggcgctgctatgctgtgggccctgcccagagcccccccaccttcggcttcctgctggacattgatggagtgctggtgcggggccacagggtcatcccagctgccctgaaggccttccggcggctggtgaacagccagggccagctgcgggtgcctgtggtgtttgtgaccaatgccggcaacatcctgcagcacagcaaggcccaggagctgagcgccctgctgggctgtgaggtggatgctgaccaggtgatcctgagccacagccccatgaagctgttcagcgagtaccacgagaagaggatgctggtgtctggccagggccctgtgatggagaatgcccagggcctgggcttcagaaatgtggtgacagtggatgagctgaggatggccttccccctgctggacatggtggacctggagcggcggctgaagaccacccccctgcccagaaatgacttccccagaattgaaggagtgctgctgctgggggagcctgtgcgctgggagaccagcctgcagctgatcatggatgtgctgctgagcaatggcagccctggggccggcctggccaccccaccctacccccacctgcctgtgctggccagcaacatggacctgctgtggatggccgaggccaagatgccccgcttcggccacggcaccttcctgctgtgcctggagaccatctaccagaaggtgacaggcaaggagctgcgctatgagggcctgatgggcaagcccagcatcctgacctaccagtatgcagaagatctcatccggcggcaggccgagcggcggggctgggccgcccccatcaggaagctgtatgctgtgggggacaaccccatgtctgatgtgtatggagccaacctcttccaccagtacctgcagaaggccacccatgatggagcccctgagctgggcgctgggggcacccggcagcagcagcccagcgccagccagagctgcatcagcatcctggtgtgcacaggagtgtacaaccccaggaacccccagagcacagagcctgtgctgggcggcggggagccccccttccacggccaccgggacctgtgcttcagccctggcctgatggaggccagccacgtggtgaatgatgtgaatgaggccgtgcagctggtgttcaggaaggagggctgggccctggagtag

SEQ ID NO: 32816 - DNA, 789 bp, Artificial Sequence
  Description of Artificial Sequence: Synthetic coding sequence
atgacccagcctgtgccccggctgtctgtgcctgctgccctggccctgggcagcgctgccctgggcgccgcctttgccaccggcctcttcctgggccgccgctgccccccctggagaggaagaagagagcagtgcctgctgcccccagaggacagccggctgtggcagtacctgctgagccgctccatgagggagcacccagccctgcggagcctgcggctgctgaccctggagcagccccagggcgacagcatgatgacctgtgagcaggcccagctgctggccaacctggcccggctcatccaggccaagaaggccctggacctgggcaccttcaccggctacagcgccctggccctggccctggccctgcctgcagatggccgggtggtgacctgtgaggtggatgcccagcccccagagctgggccggcccctgtggaggcaggccgaggccgagcacaagattgacctgcggctgaagccagccctggagaccctggatgagctgctggccgccggggaggccggcacctttgatgtggccgtggtggatgctgacaaggagaactgcagcgcctactatgagcgctgcctgcagctgctgcggcctgggggcatcctggccgtgctgcgggtgctgtggaggggcaaggtgctgcagccccccaagggagatgtggccgcagaatgtgtgaggaacctgaatgaaagaattagaagagatgtgcgggtgtacatcagcctgctgcccctgggagatggcctgaccctggccttcaagatctag

SEQ ID NO: 32817 - DNA, 864 bp, Artificial Sequence
  Description of Artificial Sequence: Synthetic coding sequence
atgacccagcctgtgccccggctgtctgtgcctgctgccctggccctgggcagcgctgccctgggcgccgcctttgccaccggcctcttcctgggccgccgctgccccccctggagaggaagaagagagcagtgcctgctgcccccagaggacagccggctgtggcagtacctgctgagccgctccatgagggagcacccagccctgcggagcctgcggctgctgaccctggagcagccccagggcgacagcatgatgacctgtgagcaggcccagctgctggccaacctggcccggctcatccaggccaagaaggccctggacctgggcaccttcaccggctacagcgccctggccctggccctggccctgcctgcagatggccgggtggtgacctgtgaggtggatgctggccggggcggggcccaggaccggcccccagctgaggcccggctgggggaccccggccgggctgctgggggcggccggggccgccacctgcggcggggccggggcggctgcggccagggcgagctgctgcggctgctgcgggccctgcctgctgctgctgccaccaggaggcacccccggcggccccagagccctgtggcccgggagggcgccgccaccagcgagcggggccggggcggccgggtgtgtgccaagcccaagaggacccaccctgctggccggcagggcctgcaccagcccccagcccctggccgctggacccacctgggcctgcaggacctgggcctggcccccagcgagtgggcccggggccgggtggcctgggagccccaggagctgaccctgtccttcaagtttgagaacaaggtgggcctgggccacaccaccagctag

SEQ ID NO: 32818 - DNA, 966 bp, Artificial Sequence
  Description of Artificial Sequence: Synthetic coding sequence
atggatgtgcgggccctgccctggctgccctggctgctgtggctgctgtgccggggcggcggagatgctgacagccgggcccccttcacccccacctggcccaggagccgggagcgggaggccgccgccttccgggagagcctgaacagacaccgctacctgaacagcctcttccccagcgagaacagcacagccttctacggcatcaaccagttctcctacctgtttcctgaggagttcaaggccatctacctgcggagcaagcccagcaagttcccccgctacagcgctgaggtgcacatgagcatccccaacgtgtccctgcccctgcgctttgactggagggacaagcaggtggtgacccaggtgaggaaccagcagatgtgtggcggctgctgggccttctctgtggtgggcgctgtggagagcgcctatgccatcaagggcaagcccctggaggacctgtctgtgcagcaggtgattgactgcagctacaacaactacggctgcaatggaggcagcaccctgaatgccctgaactggctgaacaagatgcaggtgaagctggtgaaggacagcgagtaccccttcaaggcccagaatggcctgtgccactacttcagcggcagccacagcggcttcagcatcaagggctacagcgcctatgacttcagtgaccaggaggatgagatggccaaggccctgctgaccttcggccccctggtggtgattgtggatgctgtgtcctggcaggactacctgggcggcatcatccagcaccactgcagcagcggggaggccaaccacgctgtgctgatcaccggctttgacaagacaggcagcaccccctactggatcgtgaggaacagctggggcagctcctggggcgtggatggctacgcccacgtgaagatgggcagcaatgtgtgtggcattgctgacagcgtgagcagcatctttgtgtag

SEQ ID NO: 32819 - DNA, 1593 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctggaccccagccggcagaagaagctggtgctgggggaccagcaccagctggtgcgcttcagcatcaagccccagagaattgagcagatcagccacgcccagaggctgctgagccggctgcacgtgcgctgcagccagaggcctcccctgagcctgtgggccggctgggtgctggagtgccccctcttcaagaacttcatcatcttcctggtgttcctgaacaccatcatcctgatggtggagattgagctgctggagagcaccaacaccaagctgtggcccctgaagctgaccctggaggtggccgcctggttcatcctgctgatcttcatcctggagatcctgctgaagtggctgagcaacttcagcgtcttctggaagagcgcctggaatgtgtttgattttgtggtgaccatgctgagcctgctgcctgaggtggtggtgctggtgggcgtgacaggccagagcgtgtggctgcagctgctgcgcatctgccgggtgctgcggagcctgaagctgctggcccagttccggcagatccagatcatcatcctggtgctggtgcgggccctgaagtccatgaccttcctgctgatgctgctgctgatcttcttctacatctttgctgtgactggagtgtatgtgttcagcgagtacaccaggagcccccggcaggacctggagtaccacgtgttcttcagtgacctgcccaacagcctggtgacagtgttcatcctcttcaccctggaccactggtacgccctgctgcaggatgtgtggaaggtgcctgaggtgagccgcatcttcagcagcatctacttcatcctgtggctgctgctgggcagcatcatcttccgcagcatcatcgtggccatgatggtgaccaacttccagaacatcaggaaggagctgaatgaggagatggcccggcgggaggtgcagctgaaggctgacatgttcaagaggcagatcatccagaggaggaagaacatgagccatgaggccctgaccagcagccacagcaagattgaggacagcagcagaggagccagccagcagcgggagagcctggacctgtctgaggtgtctgaggtggagagcaactacggggccacagaagaagatctcatcaccagcgccagcaagacagaggagaccctgagcaagaagcgggagtaccagagcagcagctgtgtgagcagcaccagcagcagctacagcagcagcagcgagagccgcttcagcgagagcatcggccgcctggactgggagaccctggtgcatgagaacctgcccggcctgatggagatggaccaggatgacagagtgtggccccgggacagcctcttccgctactttgagctgctggagaagctgcagtacaacctggaggagaggaagaagctgcaggagtttgctgtgcaggccctgatgaacctggaggacaagtag

SEQ ID NO: 32820 - DNA, 1593 bp, Artificial Sequence; identical to SEQ ID NO: 32819
  Description of Artificial Sequence: Synthetic coding sequence

SEQ ID NO: 32821 - DNA, 1587 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctggaccccagccggcagaagaagctggtgctgggggaccagcaccagctggtgcgcttcagcatcaagccccagagaattgagcagatcagccacgcccagaggctgctgagccggctgcacgtgcgctgcagccagaggcctcccctgagcctgtgggccggctgggtgctggagtgccccctcttcaagaacttcatcatcttcctggtgttcctgaacaccatcatcctgatggtggagattgagctgctggagagcaccaacaccaagctgtggcccctgaagctgaccctggaggtggccgcctggttcatcctgctgatcttcatcctggagatcctgctgaagtggctgagcaacttcagcgtcttctggaagagcgcctggaatgtgtttgattttgtggtgaccatgctgagcctgctgcctgaggtggtggtgctggtgggcgtgacaggccagagcgtgtggctgcagctgctgcgcatctgccgggtgctgcggagcctgaagctgctggcccagttccggcagatccagatcatcatcctggtgctggtgcgggccctgaagtccatgaccttcctgctgatgctgctgctgatcttcttctacatctttgctgtgactggagtgtatgtgttcagcgagtacaccaggagcccccggcaggacctggagtaccacgtgttcttcagtgacctgcccaacagcctggtgacagtgttcatcctcttcaccctggaccactggtacgccctgctgcaggatgtgtggaaggtgcctgaggtgagccgcatcttcagcagcatctacttcatcctgtggctgctgctgggcagcatcatcttccgcagcatcatcgtggccatgatggtgaccaacttccagaacatcaggaaggagctgaatgaggagatggcccggcgggaggtgcagctgaaggctgacatgttcaagaggcagatcatccagaggaggaagaacatgagccatgaggccctgaccagcagccacagcaagattgaagatagaggagccagccagcagcgggagagcctggacctgtctgaggtgtctgaggtggagagcaactacggggccacagaagaagatctcatcaccagcgccagcaagacagaggagaccctgagcaagaagcgggagtaccagagcagcagctgtgtgagcagcaccagcagcagctacagcagcagcagcgagagccgcttcagcgagagcatcggccgcctggactgggagaccctggtgcatgagaacctgcccggcctgatggagatggaccaggatgacagagtgtggccccgggacagcctcttccgctactttgagctgctggagaagctgcagtacaacctggaggagaggaagaagctgcaggagtttgctgtgcaggccctgatgaacctggaggacaagtag

SEQ ID NO: 32822 - DNA, 1245 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctggaccccagccggcagaagaagctggtgctgggggaccagcaccagctggtgcgcttcagcatcaagccccagagaattgagcagatcagccacgcccagaggctgctgagccggctgcacgtgcgctgcagccagaggcctcccctgagcctgtgggccggctgggtgctggagtgccccctcttcaagaacttcatcatcttcctggtgttcctgaacaccatcatcctgatggtggagattgagctgctggagagcaccaacaccaagctgtggcccctgaagctgaccctggaggtggccgcctggttcatcctgctgatcttcatcctggagatcctgctgaagtggctgagcaacttcagcgtcttctggaagagcgcctggaatgtgtttgattttgtggtgaccatgctgagcctgctgcctgaggtggtggtgctggtgggcgtgacaggccagagcgtgtggctgcagctgctgcgcatctgccgggtgctgcggagcctgaagctgctggcccagttccggcagatccagatcatcatcctggtgctggtgcgggccctgaagtccatgaccttcctgctgatgctgctgctgatcttcttctacatctttgctgtgactggagtgtatgtgttcagcgagtacaccaggagcccccggcaggacctggagtaccacgtgttcttcagtgacctgcccaacagcctggtgacagtgttcatcctcttcaccctggaccactggtacgccctgctgcaggatgtgtggaaggtgcctgaggtgagccgcatcttcagcagcatctacttcatcctgtggctgctgctgggcagcatcatcttccgcagcatcatcgtggccatgatggtgaccaacttccagaacatcaggaaggagctgaatgaggagatggcccggcgggaggtgcagctgaaggctgacatgttcaagaggcagatcatccagaggaggaagaacatgagccatgaggccctgaccagcagccacagcaagattgaagatagaagctttggcctgggggacagctgtgccaggaagagcgcccgggccaatggaaatggaagtggatag

SEQ ID NO: 32823 - DNA, 1587 bp, Artificial Sequence; identical to SEQ ID NO: 32821
  Description of Artificial Sequence: Synthetic coding sequence

SEQ ID NO: 32824 - DNA, 195 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctggaccccagccggcagaagaagctggtgctgggggaccagcaccagctgtag

SEQ ID NO: 32825 - DNA, 147 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctgtag

SEQ ID NO: 32826 - DNA, 243 bp, Artificial Sequence
  Description of Artificial Sequence: Synthetic coding sequence
atggccgcctaccagcaggaggagcagatgcagctgcccagggcagatgccatccgcagccggctgattgacaccttcagcctgattgagcacctgcagggcctgagccaggccgtgcccaggcacaccatccgggagctgctggaccccagccggcagaagaagctggtgctgggggaccagcaccagctggtgcgcttcagcatcaagccccagagaattgagcagatcagccacgcctag

SEQ ID NO: 32827 - DNA, 1449 bp, Artificial Sequence
  Description of Artificial Sequence: Synthetic coding sequence
atggctgctgctgctgctggggccggcagcggcccctgggccgcccaggagaagcagtttcctccagccctgctgtccttcttcatctacaacccccgcttcggcccccgggagggccaggaggagaacaagatcctcttctaccaccccaatgaggtggagaagaatgagaagatcagaaatgtgggcctgtgtgaggccatcgtgcagttcaccaggaccttcagccccagcaagccagccaagagcctgcacacccagaagaaccggcagttcttcaatgaacctgaggagaacttctggatggtgatggtggtgaggaaccccatcatcgagaagcagagcaaggatggcaagcctgtgattgagtaccaggaggaggagctgctggacaaggtgtacagctctgtgctgcggcagtgctacagcatgtacaagctgttcaacggcaccttcctgaaggccatggaggatggcggcgtgaagctgctgaaggagcggctggagaagttcttccaccgctacctgcagaccctgcacctgcagagctgtgacctgctggacatctttggaggcatctccttcttccccctggacaagatgacctacctgaagatccagagcttcatcaacaggatggaggagagcctgaacatcgtgaagtacacagccttcctgtacaatgaccagctgatctggagcggcctggagcaggatgacatgaggatcctgtacaagtacctgaccaccagcctcttccccaggcacatcgagcctgagctggccggccgggacagccccatccgggcagagatgcctggcaacctgcagcactacggccgcttcctgaccggccccctgaacctgaatgaccctgatgccaagtgccgcttccccaagatctttgtgaacacagatgacacctatgaggagctgcacctgattgtgtacaaggccatgtctgctgctgtgtgcttcatgattgatgcctctgtgcaccccaccctggacttctgccggcggctggacagcatcgtgggcccccagctgactgtgctggccagtgacatctgtgagcagttcaacatcaacaagaggatgagcggcagcgagaaggagccccagttcaagttcatctacttcaaccacatgaacctggccgagaagagcacagtgcacatgaggaagaccccatctgtgtccctgacctctgtgcacccagacctgatgaagatcctgggggacatcaacagcgacttcaccagggtggatgaagatgaggagatcatcgtgaaggccatgtctgactactgggtggtgggcaagaagagtgaccggcgggagctgtatgtgatcctgaaccagaagaatgccaacctgattgaggtgaatgaggaggtgaagaagctgtgtgccacccagttcaacaacatcttcttcctggactag

SEQ ID NO: 32828 - DNA, 1020 bp, Artificial Sequence
  Description of Artificial Sequence: Synthetic coding sequence
atgtacaagctgttcaacggcaccttcctgaaggccatggaggatggaggagtgaagctgctgaaggagcggctggagaagttcttccaccgctacctgcagaccctgcacctgcagagctgtgacctgctggacatctttggaggcatctccttcttccccctggacaagatgacctacctgaagatccagagcttcatcaacaggatggaggagagcctgaacatcgtgaagtacacagccttcctgtacaatgaccagctgatctggagcggcctggagcaggatgacatgaggatcctgtacaagtacctgaccaccagcctcttccccaggcacatcgagcctgagctggccggccgggacagccccatccgggcagagatgcctggcaacctgcagcactacggccgcttcctgaccggccccctgaacctgaatgaccctgatgccaagtgccgcttccccaagatctttgtgaacacagatgacacctatgaggagctgcacctgattgtgtacaaggccatgtctgctgctgtgtgcttcatgattgatgcctctgtgcaccccaccctggacttctgccggcggctggacagcatcgtgggcccccagctgactgtgctggccagtgacatctgtgagcagttcaacatcaacaagaggatgagcggcagcgagaaggagccccagttcaagttcatctacttcaaccacatgaacctggccgagaagagcacagtgcacatgaggaagacccccagcgtgtccctgacctctgtgcacccagacctgatgaagatcctgggggacatcaacagcgacttcaccagggtggatgaagatgaggagatcatcgtgaaggccatgtctgactactgggtggtgggcaagaagagtgacagaagagagctgtatgtgatcctgaaccagaagaatgccaacctgattgaggtgaatgaggaggtgaagaagctgtgtgccacccagttcaacaacatcttcttcctggactag

SEQ ID NO: 32829 - DNA, 1449 bp, Artificial Sequence; identical to SEQ ID NO: 32827
  Description of Artificial Sequence: Synthetic coding sequence

SEQ ID NO: 32830 - DNA, 1020 bp, Artificial Sequence; identical to SEQ ID NO: 32828
  Description of Artificial Sequence: Synthetic coding sequence

SEQ ID NO: 32831 - DNA, 3066 bp, Artificial Sequence
  Description of Artificial Sequence: Synthetic coding sequence
atggccggcatctcctatgtggccagcttcttcctgctgctgaccaagctgagcatcggccagcgggaggtgacagtgcagaagggccccctcttccgggcagagggctaccctgtgtccatcggctgcaatgtgacaggccaccagggccccagcgagcagcacttccagtggagcgtgtacctgcccaccaaccccacccaggaggtgcagatcatcagcaccaaggatgctgccttctcctatgctgtgtacacccagagggtgcgctctggagatgtgtatgtggagcgggtgcagggcaacagcgtgctgctgcacatcagcaagctgcagatgaaggatgctggggagtatgagtgccacacccccaacacagatgagaagtactacggcagctacagcgccaagaccaacctgattgtcatcccagacaccctgagcgccaccatgagcagccagaccctgggcaaggaggagggggagcccctggccctgacctgtgaggccagcaaggccacagcccagcacacccacctgtctgtgacctggtacctgacccaggacggcggcggcagccaggccacagagatcatcagcctgagcaaggacttcatcctggtgcccggccccctgtacacagaaagatttgctgccagtgatgtgcagctgaacaagctgggccccaccaccttccggctgagcattgaaaggctgcagagcagtgaccagggccagctgttctgtgaggccacagagtggatccaggaccctgatgagacctggatgttcatcaccaagaagcagacagaccagaccaccctgcgcatccagcctgctgtgaaggacttccaggtgaacatcacagctgacagcctgtttgctgagggcaagcccctggagctggtgtgcctggtggtgagcagcggccgggacccccagctgcagggcatctggttcttcaacggcacagagatcgcccacattgatgctggaggagtgctgggcctgaagaatgactacaaggagcgggccagccagggcgagctgcaggtgtccaagctgggccccaaggccttcagcctgaagatcttcagcctgggcccagaagatgaaggagcctaccgctgtgtggtggccgaggtgatgaagaccaggacaggctcctggcaggtgctgcagaggaagcagagcccagacagccacgtgcacctgaggaagccagctgcccggtctgtggtgatgagcaccaagaacaagcagcaggtggtgtgggagggggagaccctggccttcctgtgcaaggccggcggcgctgagagccccctgtctgtgtcctggtggcacatcccccgggaccagacccagcctgagtttgtggccggcatgggccaggacggcatcgtgcagctgggcgccagctatggagtgcccagctaccacggcaacacccggctggagaagatggactgggccaccttccagctggagatcaccttcaccgccatcacagacagcggcacctatgagtgccgggtgtctgagaagagcaggaaccaggcccgggacctgtcctggacccagaagatctctgtgacagtgaagagcctggagagcagcctgcaggtgtccctgatgagccggcagccccaggtgatgctgaccaacacctttgacctgagctgtgtggtgcgggccggctacagcgacctgaaggtgcccctgactgtgacctggcagttccagcctgccagcagccacatcttccaccagctgatccgcatcacccacaacggcaccatcgagtggggcaacttcctgagccgcttccagaagaagaccaaggtgtcccagagcctcttccgcagccagctgctggtgcatgatgccacagaggaggagactggagtgtaccagtgtgaggtggaggtgtatgacaggaacagcctgtacaacaacagaccaccccgggccagcgccatcagccaccccctgagaattgctgtgaccctgcctgagagcaagctgaaggtgaacagccgcagccaggtgcaggagctgagcatcaacagcaacacagacatcgagtgcagcatcctgagccgcagcaatggaaacctgcagctggccatcatctggtacttcagccctgtgtccaccaatgcctcctggctgaagatcctggagatggaccagaccaacgtcatcaagacaggagatgagttccacaccccccagaggaagcagaagttccacacagagaaggtgtcccaggacctcttccagctgcacatcctgaatgtggaggacagcgaccggggcaagtaccactgtgctgtggaggagtggctgctgagcaccaacggcacctggcacaagctgggggagaagaagagcggcctgacagagctgaagctgaagcccaccggcagcaaggtgcgggtgtccaaggtgtactggacagaaaatgtgacagagcaccgggaggtggccatccgctgcagcctggagagcgtgggcagcagcgccaccctgtacagcgtgatgtggtactggaacagagaaaattctggcagcaagctgctggtgcacctgcagcatgatggcctgctggagtatggagaggagggcctgcggcggcacctgcactgctaccgcagcagcagcacagactttgtgctgaagctgcaccaggtggagatggaggatgctggcatgtactggtgccgggtggccgagtggcagctgcacggccaccccagcaagtggatcaaccaggccagtgatgagagccagaggatggtgctgactgtgctgcccagcgagcccaccctgcccagccgcatctgcagcagcgcccccctgctgtacttcctgttcatctgcccctttgtgctgctgctgctgctgctgatcagcctgctgtgcctgtactggaaggccaggaagctgagcaccctgcggagcaacaccaggaaggagaaggccctgtgggtggacctgaaggaggccggcggcgtgaccaccaacagaagagaagatgaggaggaggatgagggcaactag

SEQ ID NO: 32832 - DNA, 3066 bp, Artificial Sequence; identical to SEQ ID NO: 32831
  Description of Artificial Sequence: Synthetic coding sequence

SEQ ID NO: 32833 - DNA, 546 bp, Artificial Sequence
  Description of Artificial Sequence: Synthetic coding sequence
atgctgctggagcccggccggggctgctgtgccctggccatcctgctggccatcgtggacatccagagcggcggctgcatcaacatcaccagcagcgccagccaggagggcacccggctgaacctgatctgcaccgtgtggcacaagaaggaggaggccgagggctttgtggtgttcctgtgcaaggacagaagtggggactgcagccctgagaccagcctgaagcagctgcggctgaagagggaccccggcattgatggagtgggggagatcagcagccagctgatgttcaccatcagccaggtgacccccctgcacagcggcacctaccagtgctgtgcccggagccagaagagcggcatccggctgcagggccacttcttcagcatcctcttcacagaaacaggcaactacacagtgacaggcctgaagcagaggcagcacctggagttcagccacaatgaaggcaccctgagcagcggcttcctgcaggagaaggtgtgggtgatgctggtgaccagcctggtggccctgcaggccctgtag

SEQ ID NO: 32834 - DNA, 546 bp, Artificial Sequence; identical to SEQ ID NO: 32833
  Description of Artificial Sequence: Synthetic coding sequence

SEQ ID NO: 32835 - DNA, 378 bp, Artificial Sequence
  Description of Artificial Sequence: Synthetic coding sequence
atgctgctggagcccggccggggctgctgtgccctggccatcctgctggccatcgtggacatccagagcggggagaccggcaactacacagtgacaggcctgaagcagaggcagcacctggagttcagccacaatgaaggcaccctgagcagcggcttcctgcaggagaaggtgtgggtgatgctggtgaccagcctggtggccctgcagggcatgagcaagagagctgtgtccacccccagcaatgaaggagccatcatcttcctgcccccctggctgttcagcagaagaagaaggctggagaggatgagccggggccgggagaagtgctacagcagccctggctacccccaggagagcagcaaccagttccactag

SEQ ID NO: 32836 - DNA, 546 bp, Artificial Sequence; identical to SEQ ID NO: 32833
  Description of Artificial Sequence: Synthetic coding sequence

SEQ ID NO: 32837 - DNA, 516 bp, Artificial Sequence
  Description of Artificial Sequence: Synthetic coding sequence
atggaggcccctggcccccgggccctgaggacagccctgtgtggcggctgctgctgcctgctgctgtgtgcccagctggccgtggccgggaaaggagcccggggcttcggccgcggggccctgatccggctgaacatctggccagctgtgcagggcgcctgcaagcagctggaggtgtgtgagcactgtgtggagggggaccgggccaggaacctgagcagctgcatgtgggagcagtgcaggcctgaggagcccggccactgtgtggcccagagcgaggtggtgaaggagggctgcagcatctacaacagaagtgaggcctgccctggaaaaggagtgctggcccccaagcccagctgcatgggcctgcccagccacagcctgccccccaggaggaagcagcccctgagcggcggcggcttctgcagccccatccctggccctggcatcagcagcgccttcagcagcctgcggagccccctgctgagcctgcccatcagcagcagcgagaactag

SEQ ID NO: 32838 - DNA, 522 bp, Artificial Sequence
  Description of Artificial Sequence: Synthetic coding sequence
atggaggcccctggcccccgggccctgaggacagccctgtgtggcggctgctgctgcctgctgctgtgtgcccagctggccgtggccgggaaaggagcccggggcttcggccgcggggccctgatccggctgaacatctggccagctgtgcagggcgcctgcaagcagctggaggtgtgtgagcactgtgtggagggggaccgggccaggaacctgagcagctgcatgtgggagcagtgcaggcctgaggagcccggccactgtgtggcccagagcgaggtggtgaaggagggctgcagcatctacaacagaagtgaggcctgcccagctgcccaccaccaccccacctatgagcccaagacagtgaccaccggcagcccccctgtgcctgaggcccacagccctggctttgatggagccagcttcatcggcggcgtggtgctggtgctgagcctgcaggccgtggccttctttgtgctgcacttcctgaaggccaaggacagcacctaccagaccctgtag

SEQ ID NO: 32839 - DNA, 525 bp, Artificial Sequence
  Description of Artificial Sequence: Synthetic coding sequence
atggaggcccctggcccccgggccctgaggacagccctgtgtggcggctgctgctgcctgctgctgtgtgcccagctggccgtggccgggaaaggagcccggggcttcggccgcggggccctgatccggctgaacatctggccagctgtgcagggcgcctgcaagcagctggaggtgtgtgagcactgtgtggagggggaccgggccaggaacctgagcagctgcatgtgggagcagtgcaggcctgaggagcccggccactgtgtggcccagagcgaggtggtgaaggagggctgcagcatctacaacagaagtgaggcctgcccagctgcccaccaccaccccacctatgagcccaagacagtgaccaccggcagcccccctgtgcctgaggcccacagccctggctttgatggagccagcttcatcggcggcgtggtgctggtgctgagcctgcaggccgtggccttctttgtgctgcacttcctgaaggccaaggacagcacctaccagaccctcatctag

SEQ ID NO: 32840 - DNA, 1986 bp, Artificial Sequence
  Description of Artificial Sequence: Synthetic coding sequence
atggcctttgatgtgtcctgcttcttctgggtggtgctcttctctgctggctgcaaggtgatcacctcctgggaccagatgtgcatcgagaaggaggccaacaagacctacaactgtgagaacctgggcctgtctgagatcccagacaccctgcccaacaccacagagttcctggagttctccttcaacttcctgcccaccatccacaacagaaccttcagccggctgatgaacctgaccttcctggacctgacccgctgccagatcaactggattcatgaggacaccttccagagccaccaccagctgagcaccctggtgctgactggaaaccccctcatcttcatggccgagaccagcctgaatggccccaagagcctgaagcacctgttcctgatccagacaggcatcagcaacctggagttcatccctgtgcacaacctggagaacctggagagcctgtacctgggcagcaaccacatcagcagcatcaagttccccaaggacttccctgccaggaacctgaaggtgctggacttccagaacaatgccatccactacatcagccgggaggacatgaggagcctggagcaggccatcaacctgagcctgaacttcaatggaaacaacgtgaagggcatcgagctgggcgcctttgacagcaccatcttccagagcctgaactttggaggcacccccaacctgagcgtcatcttcaacggcctgcagaacagcaccacccagagcctgtggctgggcacctttgaggacattgatgatgaggacatcagcagcgccatgctgaagggcctgtgtgagatgtctgtggagagcctgaacctgcaggagcaccgcttcagtgacatcagcagcaccaccttccagtgcttcacccagctgcaggagctggacctgacagccacccacctgaagggcctgcccagcggcatgaagggcctgaacctgctgaagaagctggtgctgtctgtgaaccactttgaccagctgtgccagatctctgctgccaacttccccagcctgacccacctgtacatcagaggaaatgtgaagaagctgcacctgggcgtgggctgcctggagaagctgggcaacctgcagaccctggacctgagccacaatgacatcgaggccagtgactgctgcagcctgcagctgaagaacctgagccacctgcagaccctgaacctgagccacaatgagcccctgggcctgcagagccaggccttcaaggagtgcccccagctggagctgctggacctggccttcacccggctgcacatcaatgccccccagagccccttccagaacctgcacttcctgcaggtgctgaacctgacctactgcttcctggacaccagcaaccagcacctgctggccggcctgcctgtgctgcggcacctgaacctgaagggcaaccacttccaggacggcaccatcaccaagaccaacctgctgcagacagtgggcagcctggaggtgctgatcctgagcagctgtggcctgctgagcattgaccagcaggccttccacagcctgggcaagatgagccacgtggacctgagccacaacagcctgacctgtgacagcattgacagcctgagccacctgaagggcatctacctgaacctggccgccaacagcatcaacatcatcagcccccggctgctgcccatcctgagccagcagagcaccatcaacctgagccacaaccccctggactgcacctgcagcaacatccacttcctgacctggtacaaggagaacctgcacaagctggagggcagcgaggagaccacctgtgccaacccccccagcctgcggggcgtgaagctgagtgatgtgaagctgagctgtggcatcacagccatcggcatcttcttcctgattgtgttcctgctgctgctggccatcctgctcttctttgctgtgaagtacctgctgcgctggaagtaccagcacatctag

SEQ ID NO: 32841 - DNA, 816 bp, Artificial Sequence
  Description of Artificial Sequence: Synthetic coding sequence
atgtctgccccccggctgctgatcagcatcatcatcatggtgtctgccagcagcagcagctgcatgggcggcaagcagatgacccagaactacagcaccatctttgctgagggcaacatcagccagcctgtgctgatggacatcaatgctgtgctgtgctgcccccccatcgccctgaggaacctgatcatcatcacctgggagatcatcctgcggggccagcccagctgcaccaaggcctacaagaaggagaccaatgagaccaaggagaccaactgcaccgtggagcgcatcacctgggtgtccaggccagaccagaacagcgacctgcagatccggcctgtggacaccacccatgatggctactaccggggcatcgtggtgaccccagatggcaacttccaccggggctaccacctgcaggtgctggtgaccccagaggtgaacctcttccagagcaggaacatcacagctgtgtgcaaggctgtgacaggcaagccagctgcccagatctcctggatccctgagggcagcatcctggccaccaagcaggagtactggggcaatggaacagtgacagtgaagagcacctgcccctgggagggccacaagagcacagtgacctgccacgtgagccacctgactggaaacaagagcctgtctgtgaagctgaacagcggcctgcggaccagcggcagccctgccctgagcctgctgatcatcctgtatgtgaagctgagcctgtttgtggtgatcctggtgaccaccggctttgtgttcttccagaggatcaaccacgtgaggaaggtgctgtag

SEQ ID NO: 32842 - DNA, 753 bp, Artificial Sequence
  Description of Artificial Sequence: Synthetic coding sequence
atgggcggcaagcagatgacccagaactacagcaccatctttgctgagggcaacatcagccagcctgtgctgatggacatcaatgctgtgctgtgctgcccccccatcgccctgaggaacctgatcatcatcacctgggagatcatcctgcggggccagcccagctgcaccaaggcctacaagaaggagaccaatgagaccaaggagaccaactgcaccgtggagcgcatcacctgggtgtccaggccagaccagaacagcgacctgcagatccggcctgtggacaccacccatgatggctactaccggggcatcgtggtgaccccagatggcaacttccaccggggctaccacctgcaggtgctggtgaccccagaggtgaacctcttccagagcaggaacatcacagctgtgtgcaaggctgtgacaggcaagccagctgcccagatctcctggatccctgagggcagcatcctggccaccaagcaggagtactggggcaatggcaccgtgacagtgaagagcacctgcccctgggagggccacaagagcacagtgacctgccacgtgagccacctgaccggcaacaagagcctgtctgtgaagctgaacagcggcctgcggaccagcggcagccctgccctgagcctgctgatcatcctgtatgtgaagctgagcctgtttgtggtgatcctggtgaccactggatttgtgttcttccagaggatcaaccacgtgaggaaggtgctgtag

SEQ ID NO: 32843 - DNA, 753 bp, Artificial Sequence; identical to SEQ ID NO: 32842
  Description of Artificial Sequence: Synthetic coding sequence

SEQ ID NO: 32844 - DNA, 531 bp, Artificial Sequence
  Description of Artificial Sequence: Synthetic coding sequence
atgaggatctttgctgtgttcatcttcatgacctactggcacctgctgaatgccccctacaacaagatcaaccagaggatcctggtggtggaccctgtgaccagcgagcacgagctgacctgccaggccgagggctaccccaaggccgaggtgatctggaccagcagtgaccaccaggtgctgagcggcaagaccaccaccaccaacagcaagcgggaggagaagctgttcaacgtgaccagcaccctgcgcatcaacaccaccaccaatgagatcttctactgcaccttccggcggctggaccctgaggagaaccacacagctgagctggtgattcctgagctgcccctggcccaccccccaaatgaaagaacccacctggtgatcctgggcgccatcctgctgtgcctgggcgtggccctgaccttcatcttccggctgaggaaaggaaggatgatggatgtgaagaagtgtggcatccaggacaccaacagcaagaagcagagcgacacccacctggaggagacctag

SEQ ID NO: 32845 - DNA, 873 bp, Artificial Sequence
  Description of Artificial Sequence: Synthetic coding sequence
atgaggatctttgctgtgttcatcttcatgacctactggcacctgctgaatgccttcaccgtgacagtgcccaaggacctgtatgtggtggagtatggcagcaacatgaccatcgagtgcaagtttcctgtggagaagcagctggacctggccgccctgattgtgtactgggagatggaggacaagaacatcatccagtttgtgcatggagaggaggacctgaaggtgcagcacagcagctaccggcagagggcccggctgctgaaggaccagctgagcctgggcaatgctgccctgcagatcacagatgtgaagctgcaggatgctggggtgtaccgctgcatgatctcctatggaggagctgactacaagaggatcaccgtgaaggtgaatgccccctacaacaagatcaaccagaggatcctggtggtggaccctgtgaccagcgagcacgagctgacctgccaggccgagggctaccccaaggccgaggtgatctggaccagcagtgaccaccaggtgctgagcggcaagaccaccaccaccaacagcaagcgggaggagaagctgttcaacgtgaccagcaccctgcgcatcaacaccaccaccaatgagatcttctactgcaccttccggcggctggaccctgaggagaaccacacagctgagctggtgattcctgagctgcccctggcccaccccccaaatgaaagaacccacctggtgatcctgggcgccatcctgctgtgcctgggcgtggccctgaccttcatcttccggctgaggaaaggaaggatgatggatgtgaagaagtgtggcatccaggacaccaacagcaagaagcagagcgacacccacctggaggagacctag

SEQ ID NO: 32846 - DNA, 585 bp, Artificial Sequence
  Description of Artificial Sequence: Synthetic coding sequence
atgtggctgagccccagcctgctgctgctgatcctgcccggctacagcattgctgccaagatcaccggccccaccaccgtgaatggcagcgagcagggcagcctgactgtgcagtgtgcctacggcagcggctgggagacctacctgaagtggcgctgccagggcgctgactggaactactgcaacatcctggtgaagaccaacggcagcgagcaggaggtgaagaagaacagagtgtccatccgggacaaccagaagaaccacgtgttcaccgtgaccatggagaacctgaagagagatgatgctgacagctactggtgtggcacagagcggcccggcatcgacctgggcgtgaaggtgcaggtgaccatcaaccctggcacccagacagctgtgtctgagtggaccaccaccacagccagcctggccttcaccgctgctgccacccagaagaccagcagccccctgaccaggagccccctgaagagcacccacttcctgttcctgttcctgctggagctgcccctgctgctgtccatgctgggcaccgtgctgtgggtgaaccggccccagaggaggagctag

SEQ ID NO: 32847 - DNA, 702 bp, Artificial Sequence
  Description of Artificial Sequence: Synthetic coding sequence
atgaggctgctggtgctgctgtggggctgcctgctgctgcccggctatgaggccctggagggccctgaggagatcagcggctttgaaggagacacagtgtccctgcagtgcacctaccgggaggagctgcgggaccacaggaagtactggtgcaggaaaggaggcatcctcttcagccgctgcagcggcaccatctatgcagaggaggagggccaggagaccatgaagggccgggtgtccatccgggacagccggcaggagctgagcctgattgtgaccctgtggaacctgaccctgcaggatgctggggagtactggtgtggggtggagaagaggggcccagatgagagcctgctgatcagcctgtttgtgtttcctggcagcagcaggcctcccatgcagctggacagcaccagcgctgaggacaccagccctgccctgagcagcggcagcagcaagccccgggtgtccatccccatggtgcgcatcctggcccctgtgctggtgctgctgagcctgctgtctgctgctggcctcatcgccttctgcagccacctgctgctgtggaggaaggaggcccagcaggccacagagacccagagaaatgagaagttctgcctgagccggctgaaccacaggaccagcgagctggaccctgatgaggcctttgagatcagcagcctgaccttcctgtctgtgtag

SEQ ID NO: 32848 - DNA, 999 bp, Artificial Sequence
  Description of Artificial Sequence: Synthetic coding sequence
atgaggctgctggtgctgctgtggggctgcctgctgctgcccggctatgaggccctggagggccctgaggagatcagcggctttgaaggagacacagtgtccctgcagtgcacctaccgggaggagctgcgggaccacaggaagtactggtgcaggaaaggaggcatcctcttcagccgctgcagcggcaccatctatgcagaggaggagggccaggagaccatgaagggccgggtgtccatccgggacagccggcaggagctgagcctgattgtgaccctgtggaacctgaccctgcaggatgctggggagtactggtgtggggtggagaagaggggcccagatgagagcctgctgatcagcctgtttgtgtttcctggcccctgctgcccccccagccccagccccaccttccagcccctggccaccacccggctgcagcccaaggccaaggcccagcagacccagcccccaggcctgaccagccctggcctgtacccagctgccaccacagccaagcagggcaagacaggagctgaggccccacccctgcccggcaccagccagtatggccacgagaggaccagccagtacacaggcaccagcccccacccagccaccagccccccagctggcagcagccggccccccatgcagctggacagcaccagcgctgaggacaccagccctgccctgagcagcggcagcagcaagccccgggtgtccatccccatggtgcgcatcctggcccctgtgctggtgctgctgagcctgctgtctgctgctggcctgattgccttctgcagccacctgctgctgtggaggaaggaggcccagcaggccacagagacccagagaaatgagaagttctgcctgagccggctgacagctgaggagaaggaggcccccagccaggccccagaaggagatgtgatctccatgccacccctgcacaccagcgaggaggagctgggcttcagcaagtttgtgtctgcctag

SEQ ID NO: 32849 - DNA, 822 bp, Artificial Sequence
  Description of Artificial Sequence: Synthetic coding sequence
atgaggctgctggtgctgctgtggggctgcctgctgctgcccggctatgaggccctggagggccctgaggagatcagcggctttgaaggagacacagtgtccctgcagtgcacctaccgggaggagctgcgggaccacaggaagtactggtgcaggaaaggaggcatcctcttcagccgctgcagcggcaccatctatgcagaggaggagggccaggagaccatgaagggccgggtgtccatccgggacagccggcaggagctgagcctgattgtgaccctgtggaacctgaccctgcaggatgctggggagtactggtgtggggtggagaagaggggcccagatgagagcctgctgatcagcctgtttgtgtttcctgccagccctggcctgtacccagctgccaccacagccaagcagggcaagacaggagctgaggccccacccctgcccggcaccagccagtatggccacgagaggaccagccagtacacaggcaccagcccccacccagccaccagccccccagctggcagcagccggccccccatgcagctggacagcaccagcgctgaggacaccagccctgccctgagcagcggcagcagcaagccccgggtgtccatccccatggtgcgcatcctggcccctgtgctggtgctgctgagcctgctgtctgctgctggcctgattgccttctgcagccacctgctgctgtggaggaaggaggcccagcaggccacagagacccagagaaatgagaagttctgcctgagccggctgaacagcctgatgttcagcctgagcctgccctggctgtag

SEQ ID NO: 32850 - DNA, 924 bp, Artificial Sequence
  Description of Artificial Sequence: Synthetic coding sequence
atgaggctgctggtgctgctgtggggctgcctgctgctgcccggctatgaggccctggagggccctgaggagatcagcggctttgaaggagacacagtgtccctgcagtgcacctaccgggaggagctgcgggaccacaggaagtactggtgcaggaaaggaggcatcctcttcagccgctgcagcggcaccatctatgcagaggaggagggccaggagaccatgaagggccgggtgtccatccgggacagccggcaggagctgagcctgattgtgaccctgtggaacctgaccctgcaggatgctggggagtactggtgtggggtggagaagaggggcccagatgagagcctgctgatcagcctgtttgtgtttcctggcccctgctgcccccccagccccagccccaccttccagcccctggccaccacccggctgcagcccaaggccaaggcccagcagacccagcccccaggcctgaccagccctggcctgtacccagctgccaccacagccaagcagggcaagacaggagctgaggccccacccctgcccggcaccagccagtatggccacgagaggaccagccagtacacaggcaccagcccccacccagccaccagccccccagctggcagcagccggccccccatgcagctggacagcaccagcgctgaggacaccagccctgccctgagcagcggcagcagcaagccccgggtgtccatccccatggtgcgcatcctggcccctgtgctggtgctgctgagcctgctgtctgctgctggcctgattgccttctgcagccacctgctgctgtggaggaaggaggcccagcaggccacagagacccagagaaatgagaagttctgcctgagccggctgaacagcctgatgttcagcctgagcctgccctggctgtag

SEQ ID NO: 32851 - DNA, 561 bp, Artificial Sequence
  Description of Artificial Sequence: Synthetic coding sequence
atgtggctgccctgggccctgctgctgctgtgggtgcctgccagcacctccatgaccccagccagcatcacagctgccaagaccagcaccatcaccacagccttcccccctgtgagcagcaccaccctgtttgctgtgggcgccacccacagcgccagcatccaggaggagacagaggaggtggtgaacagccagctgcccctgctgctgagcctgctggccctgctgctgctgctgctggtgggcgccagcctgctggcctggaggatgttccagaagtggatcaaggccggggaccacagcgagctgagccagaaccccaagcaggccgccacccagagcgagctgcactacgccaacctggagctgctgatgtggcccctgcaggagaagccagccccaccccgggaggtggaggtggagtacagcacagtggccagcccccgggaggagctgcactacgcctctgtggtgtttgacagcaacaccaacagaattgctgcccagaggccccgggaggaggagccagacagcgactacagcgtcatcaggaagacctag

SEQ ID NO: 32852 - DNA, 900 bp, Artificial Sequence
  Description of Artificial Sequence: Synthetic coding sequence
atgtggctgccctgggccctgctgctgctgtgggtgcccggctgctttgccctgagcaagtgcaggacagtggccggccctgtgggcggcagcctgtctgtgcagtgcccctatgagaaggagcacaggaccctgaacaagtactggtgccggcccccccagatcttcctgtgtgacaagatcgtggagaccaagggcagcgctgggaagagaaatggccgggtgtccatccgggacagccctgccaacctgtccttcaccgtgaccctggagaacctgacagaggaggatgctggcacctactggtgtggggtggacaccccctggctgcgggacttccatgaccctgtggtggaggtggaggtgtctgtgtttcctgccagcacctccatgaccccagccagcatcacagctgccaagaccagcaccatcaccacagccttcccccctgtgagcagcaccaccctgtttgctgtgggcgccacccacagcgccagcatccaggaggagacagaggaggtggtgaacagccagctgcccctgctgctgagcctgctggccctgctgctgctgctgctggtgggcgccagcctgctggcctggaggatgttccagaagtggatcaaggccggggaccacagcgagctgagccagaaccccaagcaggccgccacccagagcgagctgcactacgccaacctggagctgctgatgtggcccctgcaggagaagccagccccaccccgggaggtggaggtggagtacagcacagtggccagcccccgggaggagctgcactacgcctctgtggtgtttgacagcaacaccaacagaattgctgcccagaggccccgggaggaggagccagacagcgactacagcgtcatcaggaagacctag

SEQ ID NO: 32853 - DNA, 312 bp, Artificial Sequence
  Description of Artificial Sequence: Synthetic coding sequence
atgtggctgccctgggccctgctgctgctgtgggtgcctgctggggaccacagcgagctgagccagaaccccaagcaggccgccacccagagcgagctgcactacgccaacctggagctgctgatgtggcccctgcaggagaagccagccccaccccgggaggtggaggtggagtacagcacagtggccagcccccgggaggagctgcactacgcctctgtggtgtttgacagcaacaccaacagaattgctgcccagaggccccgggaggaggagccagacagcgactacagcgtcatcaggaagacctag

SEQ ID NO: 32854 - DNA, 453 bp, Artificial Sequence
  Description of Artificial Sequence: Synthetic coding sequence
atgtggctgccctgggccctgctgctgctgtgggtgcctgccagcacctccatgaccccagccagcatcacagctgccaagaccagcaccatcaccacagccttcccccctgtgagcagcaccaccctgtttgctgtgggcgccacccacagcgccagcatccaggaggagacagaggaggtggtgaacagccagctgcccctgctgctgagcctgctggccctgctgctgctgctgctggtgggcgccagcctgctggcctggaggatgttccagaagtggatcaaggccggggaccacagcgagctgagccagaaccccaagcaggccagcccccgggaggagctgcactacgcctctgtggtgtttgacagcaacaccaacagaattgctgcccagaggccccgggaggaggagccagacagcgactacagcgtcatcaggaagacctag

SEQ ID NO: 32855 - DNA, 675 bp, Artificial Sequence
  Description of Artificial Sequence: Synthetic coding sequence
atgacagcccgggcctgggcctcctggaggagcagcgccctgctgctgctgctggtgcccggctacttccccctgagccaccccatgacagtggccggccctgtgggcggcagcctgtctgtgcagtgccgctatgagaaggagcacaggaccctgaacaagttctggtgcaggcctccccagatcctgcgctgtgacaagatcgtggagaccaagggcagcgctgggaagagaaatggccgggtgtccatccgggacagccctgccaacctgtccttcaccgtgaccctggagaacctgacagaagaagatgctggcacctactggtgtggggtggacaccccctggctgcgggacttccatgaccccatcgtggaggtggaggtgtctgtgtttcctgctggcaccaccacagccagcagcccccagagctccatgggcaccagcggcccccccaccaagctgcctgtgcacacctggcccagcgtgaccaggaaggacagccctgagcccagcccccaccctggcagcctcttcagcaatgtgcgcttcctgctgctggtgctgctggagctgcccctgctgctgtccatgctgggcgctgtgctgtgggtgaaccggccccagaggagcagccgcagccggcagaactggcccaagggggagaaccagtag

SEQ ID NO: 32856 - DNA, 618 bp, Artificial Sequence
  Description of Artificial Sequence: Synthetic coding sequence
atgtggctgctgcctgccctgctgctgctgtgcctgagcggctgcctgagcctgaagggccctggctctgtgactggaacagctggggacagcctgactgtgtggtgccagtatgagagcatgtacaagggctacaacaagtactggtgccggggccagtatgacaccagctgtgagagcatcgtggagaccaagggggaggagaaggtggagagaaatggccgggtgtccatccgggaccaccctgaggccctggccttcaccgtgaccatgcagaacctgaatgaagatgatgctggcagctactggtgcaagatccagacagtgtgggtgctggacagctggagccgggaccccagcgacctggtgcgggtgtatgtgtccccagccatcaccacccccaggaggaccacccacccagccaccccacccatcttcctggtggtgaaccctggaagaaacctgagcactggagaggtgctgacccagaacagcggcttccggctgagcagcccccacttcctgctggtggtgctgctgaagctgcccctgctgctgtccatgctgggcgctgtgttctgggtgaaccggccccagtgggcccctcctggaagatag

SEQ ID NO: 32857 - DNA, 699 bp, Artificial Sequence
  Description of Artificial Sequence: Synthetic coding sequence
atgacccaggcccccctgcacatcctgggcttccagctgggccccaggtttgctgaagatggcagccagggcgacaggaacatgtggctgctgcctgccctgctgctgctgtgcctgagcggctgcctgagcctgaagggccctggctctgtgactggaacagctggggacagcctgactgtgtggtgccagtatgaatccatgtacaagggctacaacaagtactggtgccggggccagtatgacaccagctgtgagagcatcgtggagaccaagggggaggagaaggtggagagaaatggccgggtgtccatccgggaccaccctgaggccctggccttcaccgtgaccatgcagaacctgaatgaagatgatgctggcagctactggtgcaagatccagacagtgtgggtgctggacagctggagccgggaccccagcgacctggtgcgggtgtatgtgtccccagccatcaccacccccaggaggaccacccacccagccaccccacccatcttcctggtggtgaaccctggcaggaacctgagcactggagaggtgctgacccagaacagcggcttccggctgagcagcccccacttcctgctggtggtgctgctgaagctgcccctgctgctgtccatgctgggcgctgtgttctgggtgaaccggccccagtgggcccctcctggccgctag

SEQ ID NO: 32858 - DNA, 369 bp, Artificial Sequence
  Description of Artificial Sequence: Synthetic coding sequence
atgtgccacctgcaggaggaggccggcggccgctggaagggcggcggctgcctgagcctgaagggccctggctctgtgactggaacagctggggacagcctgactgtgtggtgccagtatgagagcatgtacaagggctacaacaagtactggtgccggggccagtatgacaccagctgtgagagcatcgtggagaccaagggggaggagaaggtggagagaaatggccgggtgtccatccgggaccaccctgaggccctggccttcaccgtgaccatgcagaacctgaatgaagatgatgctggcagctactggtgcaagatccagacagtgtgggtgctggacagctggagccgggaccccagctag

SEQ ID NO: 32859 - DNA, 741 bp, Artificial Sequence
  Description of Artificial Sequence: Synthetic coding sequence
atgtctgagaacaccaaggagacctggaccagcaggaagtggatgacccaggcccccctgcacatcctgggcttccagctgggccccaggtttgctgaagatggcagccagggcgacaggaacatgtggctgctgcctgccctgctgctgctgtgcctgagcggctgcctgagcctgaagggccctggctctgtgactggaacagctggggacagcctgactgtgtggtgccagtatgaatccatgtacaagggctacaacaagtactggtgccggggccagtatgacaccagctgtgagagcatcgtggagaccaagggggaggagaaggtggagagaaatggccgggtgtccatccgggaccaccctgaggccctggccttcaccgtgaccatgcagaacctgaatgaagatgatgctggcagctactggtgcaagatccagacagtgtgggtgctggacagctggagccgggaccccagcgacctggtgcgggtgtatgtgtccccagccatcaccacccccaggaggaccacccacccagccaccccacccatcttcctggtggtgaaccctggcaggaacctgagcactggagaggtgctgacccagaacagcggcttccggctgagcagcccccacttcctgctggtggtgctgctgaagctgcccctgctgctgtccatgctgggcgctgtgttctgggtgaaccggccccagtgggcccctcctggccgctag

SEQ ID NO: 32860 - DNA, 300 bp, Artificial Sequence
  Description of Artificial Sequence: Synthetic coding sequence
atgggctgtgacaggaactgtggcctgattgctggagctgtgattggagctgtgctggccgtgtttggaggcatcctgatgcctgtgggggacctgctgatccagaagaccatcaagaagcaggtggtgctggaggagggcaccatcgccttcaagaactgggtgaagacaggaacagaggtgtaccggcagttctggatctttgatgtgcagaacccccaggaggtgatgatgaacagcagctgcatcccctacctgagcaagagcatctgcagcaatgacccccagttcacctactag

SEQ ID NO: 32861 - DNA, 186 bp, Artificial Sequence
  Description of Artificial Sequence: Synthetic coding sequence
atgaagcgcttcctgttcctgctgctgaccatcagcctgctggtgatggtgcagatccagacaggcctgagcggccagaatgacaccagccagaccagcagccccagcgccagcagcaacatcagcggcggcatcttcctgttctttgtggccaatgccatcatccacctgttctgcttctcctag

SEQ ID NO: 32862 - DNA, 1038 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggccgcatcttccctgagggcagctgcctgaacaccttcaccaagaacccctatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgaaattgtcatctag

SEQ ID NO: 32863 - DNA, 843 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggccgcatcttccctgagggcaagatgtggaagctgaccttcagccccccaggcacagaggccatctacccccgcttctcctag

SEQ ID NO: 32864 - DNA, 726 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccggcaaccagctgtgccccagcctgctggtgtccctgcgggaccacagcgaggagctgcagggcctgaatgtgggccacatcctgtag

SEQ ID NO: 32865 - DNA, 1020 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggcagctgcctgaacaccttcaccaagaacccctatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgaaattgtcatctag

SEQ ID NO: 32866 - DNA, 819 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggcgccagcctgcagggccgggccagcgagcacagcctcttccgctctgctgtgtgctag

SEQ ID NO: 32867 - DNA, 987 bp, Artificial Sequence
  Description of Artificial Sequence: Synthetic coding sequence
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcaggatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgagatcgtcatctag

SEQ ID NO: 32868 - DNA, 645 bp, Artificial Sequence
  Description of Artificial Sequence: Synthetic coding sequence
atggcccagcaccacctgtggatcctgctgctgtgcctgcagacctgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcaggatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgagatcgtcatctag

SEQ ID NO: 32869 - DNA, 1959 bp, Artificial Sequence
  Description of Artificial Sequence: Synthetic coding sequence
atggccacctccatgggcctgctgctgctgctgctgctgctgctgacccagcccggggccggcaccggggctgacacagaggccgtggtgtgtgtgggcacagcctgctacacagcccacagcggcaagctgtctgctgctgaggcccagaaccactgcaaccagaatggaggcaacctggccaccgtgaagagcaaggaggaggcccagcacgtgcagagggtgctggcccagctgctgcggcgggaggccgccctgacagccaggatgagcaagttctggattggcctgcagcgggagaagggcaagtgcctggaccccagcctgcccctgaagggcttctcctgggtgggcggcggggaggacaccccctacagcaactggcacaaggagctgaggaacagctgcatcagcaagagatgtgtgtccctgctgctggacctgagccagcccctgctgcccagccggctgcccaagtggagcgagggcccctgtggcagccctggcagccctggcagcaacatcgagggctttgtgtgcaagttctccttcaagggcatgtgccggcccctggccctgggcggccctggccaggtgacctacaccacccccttccagaccaccagcagcagcctggaggccgtgccctttgccagcgctgccaacgtggcctgtggggagggggacaaggatgagacccagagccactacttcctgtgcaaggagaaggccccagatgtgtttgactggggcagcagcggccccctgtgtgtgagccccaagtatggctgcaacttcaacaacggcggctgccaccaggactgctttgagggcggagatggcagcttcctgtgtggctgcaggcctggcttccggctgctggatgacctggtgacctgtgccagcaggaacccctgcagcagcagcccctgccggggcggggccacctgtgtgctgggcccccacggcaagaactacacctgccgctgcccccagggctaccagctggacagcagccagctggactgtgtggatgtggatgagtgccaggacagcccctgtgcccaggagtgtgtgaacacccctgggggcttccgctgtgagtgctgggtgggctatgagcccggcggccctggagagggcgcctgccaggatgtggatgaatgtgccctgggccgcagcccctgtgcccagggctgcaccaacacagatggcagcttccactgcagctgtgaggagggctacgtgctggccggggaggatggcacccagtgccaggatgtggatgaatgtgtgggccctgggggccccctgtgtgacagcctgtgcttcaacacccagggcagcttccactgcggctgcctgcccggctgggtgctggccccaaatggagtgtcctgcaccatgggccctgtgtccctgggcccccccagcggccccccagatgaggaggacaagggggagaaggagggcagcacagtgcccagggctgccacagccagccccacccggggccctgagggcacccccaaggccacccccaccaccagccggcccagcctgagcagtgatgcccccatcaccagcgcccccctgaagatgctggcccccagcggcagccctggggtgtggagggagcccagcatccaccacgccacagctgccagcggcccccaggagcctgctggaggagacagctctgtggccacccagaacaatgatggaacagatggccagaagctgctgctcttctacatcctgggcaccgtggtggccatcctgctgctgctggccctggccctgggcctgctggtgtacaggaagagaagagccaagcgggaggagaagaaggagaagaagccccagaatgctgctgacagctacagctgggtgcctgagagagctgagagccgggccatggagaaccagtacagccccaccccaggcacagactgctag

SEQ ID NO: 32870 - DNA, 1044 bp, Artificial Sequence
  Description of Artificial Sequence: Synthetic coding sequence
atggccacctccatgggcctgctgctgctgctgctgctgctgctgacccagcccggggccggcaccggggctgacacagaggccgtggtgtgtgtgggcacagcctgctacacagcccacagcggcaagctgtctgctgctgaggcccagaaccactgcaaccagaatggaggcaacctggccaccgtgaagagcaaggaggaggcccagcacgtgcagagggtgctggcccagctgctgcggcgggaggccgccctgacagccaggatgagcaagttctggattggcctgcagcgggagaagggcaagtgcctggaccccagcctgcccctgaagggcttctcctgggtgggcggcggggaggacaccccctacagcaactggcacaaggagctgaggaacagctgcatcagcaagagatgtgtgtccctgctgctggacctgagccagcccctgctgcccagccggctgcccaagtggagcgagggcccctgtggcagccctggcagccctggcagcaacatcgagggctttgtgtgcaagttctccttcaagggcatgtgccggcccctggccctgggcggccctggccaggtgacctacaccacccccttccagaccaccagcagcagcctggaggccgtgccctttgccagcgctgccaacgtggcctgtggggagggggacaaggatgagacccagagccactacttcctgtgcaaggagaaggccccagatgtgtttgactggggcagcagcggccccctgtgtgtgagccccaagtatggctgcaacttcaacaacggcggctgccaccaggactgctttgagggcggagatggcagcttcctgtgtggctgcaggcctggcttccggctgctggatgacctggtgacctgtgccagcaggaacccctgcagcagcagcccctgccggggcggggccaccggcctgagccaggccgagagcgaggagggcggggaggagggggaggaggccccagaatgtggccggcagctgctgctgggcagccgggccagctag

SEQ ID NO: 32871 - DNA, 447 bp, Artificial Sequence
  Description of Artificial Sequence: Synthetic coding sequence
atgcctgtgctgaagcagctgggccctgcccagcccaagaagaggccagacagaggagccctgagcatcagcgcccccctgggggacttccgccacaccctgcacgtgggcagaggaggagatgcctttggagacaccagcttcctgagccgccacggcggcggccccccacctgagccccgggcccctcctgctggggcccccaggagccccccacctcctgctgtgccccagagcgctgcccccagccctgctgaccccctgctgtccttccacctggacctgggccccagcatgctggatgctgtgctgggcgtgatggatgctgcccggcctgaggccgccgccgccaagccagatgctgagcccaggcctggcacccagcccccccaggcccgctgccggcccaatgctgacctggagctgaatgatgtgattggcctgtag

SEQ ID NO: 32872 - DNA, 240 bp, Artificial Sequence
  Description of Artificial Sequence: Synthetic coding sequence
atgtctgagttctggcacaagctgggctgctgcgtggtggagaagccccagcccaagaagaagagaagaagaattgacaggaccatgattggagagcccatgaactttgtgcacctgacccacatcggcagcggggagatgggcgctggagatggcctggccatgaccggggctgtgcaggagcagatgaggagcaagggcaacagagaccggccctggagcaacagccggggcctgtag

SEQ ID NO: 32873 - DNA, 240 bp, Artificial Sequence; identical to SEQ ID NO: 32872
  Description of Artificial Sequence: Synthetic coding sequence

SEQ ID NO: 32874 - DNA, 255 bp, Artificial Sequence
  Description of Artificial Sequence: Synthetic coding sequence
atgtctgagttctggctgtgcttcaactgctgcatcgccgagcagccccagcccaagagaagaagaagaattgaccgctccatgattggagagcccaccaactttgtgcacacagcccacgtgggcagcggggacctcttcagcggcatgaacagcgtgagcagcatccagaaccagatgcagagcaaaggaggctacggcggcggcatgcctgccaacgtgcagatgcagctggtggacaccaaggccggctag

SEQ ID NO: 32875 - DNA, 255 bp, Artificial Sequence; identical to SEQ ID NO: 32874
  Description of Artificial Sequence: Synthetic coding sequence

SEQ ID NO: 32876 - DNA, 255 bp, Artificial Sequence; identical to SEQ ID NO: 32874
  Description of Artificial Sequence: Synthetic coding sequence

SEQ ID NO: 32877 - DNA, 1482 bp, Artificial Sequence
  Description of Artificial Sequence: Synthetic coding sequence
atgtttcctgtgttcccctgcaccctgctggccccacccttccctgtgctgggcctggacagcagaggagtgggcggcctgatgaacagcttccccccaccccagggccacgcccagaaccccctgcaggtgggcgctgagctgcagagccgcttctttgccagccagggctgtgcccagagccccttccaggccgccccagcccccccacccaccccccaggccccagctgctgagcccctgcaggtggacctgctgcctgtgctggccgccgcccaggagagcgctgctgctgctgctgctgctgctgctgctgctgctgctgtggccgccgcccccccagccccagctgctgccagcacagtggacacagctgccctgaagcagcccccagcccctcctcctcctcctcctcctgtgtctgccccagctgctgaggccgcccccccagccagcgctgccaccatcgctgctgctgctgccacagctgtggtggcccccaccagcacagtggccgtggcccctgtggccagcgccctggagaagaagaccaagagcaagggcccctacatctgtgccctgtgtgccaaggagttcaagaatggctacaacctgcggagacatgaggccatccacactggagccaaggccggccgggtgcccagcggggccatgaagatgcccaccatggtgcccctgagcctgctgtctgtgccccagctgagcggggccggcggcggcggcggggaggccggggccggcggcggcgctgctgctgtggccgccggcggcgtggtgaccaccacagccagcggcaagaggatcaggaagaaccacgcctgtgagatgtgtgggaaggccttcagagatgtgtaccacctgaacagacacaagctgagccacagtgatgagaagccctaccagtgccctgtgtgccagcagcgcttcaagaggaaggacaggatgagctaccacgtgcgcagccatgatggagctgtgcacaagccctacaactgcagccactgtgggaagagcttcagcaggccagaccacctgaacagccacgtgcggcaggtgcacagcacagagcggcccttcaagtgtgagaagtgtgaggccgcctttgccaccaaggaccggctgcgggcccacacagtgagacatgaggagaaggtgccctgccacgtgtgtgggaagatgctgagcagcgcctacatcagtgaccacatgaaggtgcacagccagggcccccaccacgtgtgtgagctgtgcaacaagggcttcaccacagctgcctacctgcgcatccatgctgtgaaggaccacggcctgcaggcccccagggctgaccgcatcctgtgcaagctgtgcagcgtgcactgcaagaccccagcccagctggccggccacatgcagacccacctgggcggggccgcccctcctgtgcctggagatgccccccagccccagcccacctgctag

SEQ ID NO: 32878 - DNA, 549 bp, Artificial Sequence
  Description of Artificial Sequence: Synthetic coding sequence
atgctgcccacagctgctggcttcagcatctggggccagcccggggccgcccgggaggccccccgctgccagaccaagatcagcagctgcagctgccccaccagctctgtgtctgctgcccacggccctggccccaatgaaagagcccggggcctgggcggcctgcctgaccctgccctgagcccccgggtgcccttccagggctacgcccgcatcgtgtttgccatcatctccttctacttcatgccctgctgccccctgacagccagcagcttctacctgctgagcggcctgctggatgcctttgatggccacgccgcccgggccctgaaccagggcaccaggtttggagccatgctggacatgctgacagaccgctgcagcaccatgtgcctgctggtgaacctggccctgctgtacccaggggccaccctcttcttccagatctccatgagcctggatgtggccagccactggctgcacctgcacaggtctgctgccatcctgggcgcctgggccacctggaggcactacagcggcgtgggctag

SEQ ID NO: 32879 - DNA, 1215 bp, Artificial Sequence
  Description of Artificial Sequence: Synthetic coding sequence
atgatctggaagaggtctgctgtgctgcgcttctacagcgtgtgtggcctgctgctgcaggccgccgccagcaagaacaaggtgaagggcagccagggccagttccccctgacccagaatgtgacagtggtggagggcggcacagccatcctgacctgccgggtggaccagaatgacaacaccagcctgcagtggagcaacccagcccagcagaccctgtactttgatgacaagaaggccctgcgggacaaccgcatcgagctggtgcgggcctcctggcatgagctgagcatctctgtgtctgatgtgtccctgagtgatgagggccagtacacctgcagcctcttcaccatgcctgtgaagaccagcaaggcctacctgactgtgctgggcgtgcctgagaagccccagatcagcggcttcagcagccctgtgatggagggggacctgatgcagctgacctgcaagaccagcggcagcaagccagctgctgacatccgctggttcaagaatgacaaggagatcaaggatgtgaagtacctgaaggaggaggatgccaacaggaagaccttcaccgtgagcagcaccctggacttccgggtggacagaagtgatgatggagtggccgtcatctgccgggtggaccacgagagcctgaatgccaccccccaggtggccatgcaggtgctggagatccactacaccccatctgtgaagatcatccccagcacccccttcccccaggagggccagcccctcatcctgacctgtgagagcaagggcaagcccctgcctgagcctgtgctgtggaccaaggatggaggagagctgcctgaccctgacaggatggtggtgtctggccgggagctgaacatcctcttcctgaacaagacagacaatggcacctaccgctgtgaggccaccaacaccatcggccagagcagcgcagaatatgtgctgattgtgcatgaccccaatgccctggccggccagaatggaccagaccacgccctgattggaggcatcgtggccgtggtggtgtttgtgaccctgtgcagcatcttcctgctgggccgctacctggcccggcacaagggcacctacctgaccaatgaggccaagggagcagaagatgccccagatgctgacacagccatcatcaatgctgagggcagccaggtgaatgctgaggagaagaaggagtacttcatctag

SEQ ID NO: 32880 - DNA, 1314 bp, Artificial Sequence
  Description of Artificial Sequence: Synthetic coding sequence
atgtttgtgctcttcctgtgcaacctgagcctggtgcctgctgctgccagcaagaacaaggtgaagggcagccagggccagttccccctgacccagaatgtgacagtggtggagggcggcacagccatcctgacctgccgggtggaccagaatgacaacaccagcctgcagtggagcaacccagcccagcagaccctgtactttgatgacaagaaggccctgcgggacaacagaattgagctggtgcgggcctcctggcatgagctgagcatctctgtgtctgatgtgtccctgagtgatgagggccagtacacctgcagcctcttcaccatgcctgtgaagaccagcaaggcctacctgactgtgctgggcgtgcctgagaagccccagatcagcggcttcagcagccctgtgatggagggggacctgatgcagctgacctgcaagaccagcggcagcaagccagctgctgacatccgctggttcaagaatgacaaggagatcaaggatgtgaagtacctgaaggaggaggatgccaacaggaagaccttcaccgtgagcagcaccctggacttccgggtggacagaagtgatgatggagtggccgtcatctgccgggtggaccacgagagcctgaatgccaccccccaggtggccatgcaggtgctggagatccactacacccccagcgtgaagatcatccccagcacccccttcccccaggagggccagcccctcatcctgacctgtgagagcaagggcaagcccctgcctgagcctgtgctgtggaccaaggatggaggagagctgcctgaccctgacaggatggtggtgtctggccgggagctgaacatcctcttcctgaacaagacagacaatggcacctaccgctgtgaggccaccaacaccatcggccagagcagcgcagaatatgtgctgattgtgcatgatgtgcccaacaccctgctgcccaccaccatcatccccagcctgaccacagccaccgtgaccaccaccgtggccatcaccaccagccccaccaccagcgccaccaccagcagcatccgggaccccaatgccctggccggccagaatggaccagaccacgccctgattggaggcatcgtggccgtggtggtgtttgtgaccctgtgcagcatcttcctgctgggccgctacctggcccggcacaagggcacctacctgaccaatgaggccaagggagcagaagatgccccagatgctgacacagccatcatcaatgctgagggcagccaggtgaatgctgaggagaagaaggagtacttcatctag

SEQ ID NO: 32881 - DNA, 1308 bp, Artificial Sequence
  Description of Artificial Sequence: Synthetic coding sequence
atgatctggaagaggtctgctgtgctgcgcttctacagcgtgtgtggcctgctgctgcagggcagccagggccagttccccctgacccagaatgtgacagtggtggagggcggcacagccatcctgacctgccgggtggaccagaatgacaacaccagcctgcagtggagcaacccagcccagcagaccctgtactttgatgacaagaaggccctgcgggacaacagaattgagctggtgcgggcctcctggcatgagctgagcatctctgtgtctgatgtgtccctgagtgatgagggccagtacacctgcagcctcttcaccatgcctgtgaagaccagcaaggcctacctgactgtgctgggcgtgcctgagaagccccagatcagcggcttcagcagccctgtgatggagggggacctgatgcagctgacctgcaagaccagcggcagcaagccagctgctgacatccgctggttcaagaatgacaaggagatcaaggatgtgaagtacctgaaggaggaggatgccaacaggaagaccttcaccgtgagcagcaccctggacttccgggtggacagaagtgatgatggagtggccgtcatctgccgggtggaccacgagagcctgaatgccaccccccaggtggccatgcaggtgctggagatccactacacccccagcgtgaagatcatccccagcacccccttcccccaggagggccagcccctcatcctgacctgtgagagcaagggcaagcccctgcctgagcctgtgctgtggaccaaggatggaggagagctgcctgaccctgacaggatggtggtgtctggccgggagctgaacatcctcttcctgaacaagacagacaatggcacctaccgctgtgaggccaccaacaccatcggccagagcagcgcagaatatgtgctgattgtgcatgatgtgcccaacaccctgctgcccaccaccatcatccccagcctgaccacagccaccgtgaccaccaccgtggccatcaccaccagccccaccaccagcgccaccaccagcagcatccgggaccccaatgccctggccggccagaatggaccagaccacgccctgattggaggcatcgtggccgtggtggtgtttgtgaccctgtgcagcatcttcctgctgggccgctacctggcccggcacaagggcacctacctgaccaatgaggccaagggagcagaagatgccccagatgctgacacagccatcatcaatgctgagggcagccaggtgaatgctgaggagaagaaggagtacttcatctag

SEQ ID NO: 32882 - DNA, 1299 bp, Artificial Sequence
  Description of Artificial Sequence: Synthetic coding sequence
atgggcgccccagctgccagcctgctgctgctgctgctgctgtttgcctgctgctgggcccctggaggagccaacctgagccaggacggctactggcaggagcaggacctggagctgggcaccctggcccccctggatgaggccatcagcagcacagtgtggagcagcccagacatgctggccagccaggacagccagccctggaccagtgatgaaacagtggtggccggcggcaccgtggtgctgaagtgccaggtgaaggaccacgaggacagcagcctgcagtggagcaacccagcccagcagaccctgtactttggagagaagagggccctgcgggacaaccgcatccagctggtgaccagcacccctcatgagctgagcatcagcatcagcaatgtggccctggctgatgaaggagagtacacctgcagcatcttcaccatgcctgtgaggacagccaagagcctggtgacagtgctgggcatcccccagaagcccatcatcaccggctacaagagcagcctgcgggagaaggacacagccaccctgaactgccagagcagcggcagcaagccagctgcccggctgacctggaggaaaggagaccaggagctgcatggagagcccacccgcatccaggaggaccccaacgggaagaccttcaccgtgagcagctctgtgaccttccaggtgaccagagaagatgatggagccagcatcgtgtgcagcgtgaaccacgagagcctgaagggagctgacaggagcaccagccagagaattgaggtgctgtacacccccacagccatgatccggccagaccccccccacccccgggagggccagaagctgctgctgcactgtgagggccggggcaaccctgtgccccagcagtacctgtgggagaaggagggctctgtgccccccctgaagatgacccaggagagcgccctgatcttccccttcctgaacaagagtgacagcggcacctacggctgcacagccaccagcaacatgggcagctacaaggcctactacaccctgaatgtgaatgaccccagccctgtgcccagcagcagcagcacctaccacgccatcattggaggcatcgtggccttcatcgtgttcctgctgctgatcatgctgatcttcctgggccactacctgatccgccacaagggcacctacctgacccatgaggccaagggcagtgatgatgccccagatgctgacacagccatcatcaatgctgagggcggccagagcggaggagatgacaagaaggagtacttcatctag

SEQ ID NO: 32883 - DNA, 1197 bp, Artificial Sequence
  Description of Artificial Sequence: Synthetic coding sequence
atgggcgccccagctgccagcctgctgctgctgctgctgctgtttgcctgctgctgggcccctggaggagccaacctgagccaggatgacagccagccctggaccagtgatgaaacagtggtggccggcggcaccgtggtgctgaagtgccaggtgaaggaccacgaggacagcagcctgcagtggagcaacccagcccagcagaccctgtactttggagagaagagggccctgcgggacaaccgcatccagctggtgaccagcacccctcatgagctgagcatcagcatcagcaatgtggccctggctgatgaaggagagtacacctgcagcatcttcaccatgcctgtgaggacagccaagagcctggtgacagtgctgggcatcccccagaagcccatcatcaccggctacaagagcagcctgcgggagaaggacacagccaccctgaactgccagagcagcggcagcaagccagctgcccggctgacctggaggaaaggagaccaggagctgcatggagagcccacccgcatccaggaggaccccaacgggaagaccttcaccgtgagcagctctgtgaccttccaggtgaccagagaagatgatggagccagcatcgtgtgcagcgtgaaccacgagagcctgaagggagctgacaggagcaccagccagagaattgaggtgctgtacacccccacagccatgatccggccagaccccccccacccccgggagggccagaagctgctgctgcactgtgagggccggggcaaccctgtgccccagcagtacctgtgggagaaggagggctctgtgccccccctgaagatgacccaggagagcgccctgatcttccccttcctgaacaagagtgacagcggcacctacggctgcacagccaccagcaacatgggcagctacaaggcctactacaccctgaatgtgaatgaccccagccctgtgcccagcagcagcagcacctaccacgccatcattggaggcatcgtggccttcatcgtgttcctgctgctgatcatgctgatcttcctgggccactacctgatccgccacaagggcacctacctgacccatgaggccaagggcagtgatgatgccccagatgctgacacagccatcatcaatgctgagggcggccagagcggaggagatgacaagaaggagtacttcatctag

SEQ ID NO: 32884 - DNA, 705 bp, Artificial Sequence
  Description of Artificial Sequence: Synthetic coding sequence
atgggcgccccagctgccagcctgctgctgctgctgctgctgtttgcctgctgctgggcccctggaggagccaacctgagccaggatgacagccagccctggaccagtgatgaaacagtggtggccggcggcaccgtggtgctgaagtgccaggtgaaggaccacgaggacagcagcctgcagtggagcaacccagcccagcagaccctgtactttggagagaagagggccctgcgggacaaccgcatccagctggtgaccagcacccctcatgagctgagcatcagcatcagcaatgtggccctggctgatgaaggagagtacacctgcagcatcttcaccatgcctgtgaggacagccaagagcctggtgacagtgctgggcatcccccagaagcccatcatcaccggctacaagagcagcctgcgggagaaggacacagccaccctgaactgccagagcagcggcagcaagccagctgcccggctgacctggaggaaaggagaccaggagctgcatggagagcccacccgcatccaggaggaccccaatgacacccccacagccatgatccggccagaccccccccacccccgggagggccagaagctgctgctgcactgtgagggccggggcaaccctgtgccccagcagtacctgtgggagaaggagggctctgtgccccccctgaagatgacccagtag

SEQ ID NO: 32885 - DNA, 2130 bp, Artificial Sequence
  Description of Artificial Sequence: Synthetic coding sequence
atgcccagcgccaccagccacagcggcagcggcagcaagagcagcggccccccacctccttctggcagcagcggcagcgaggccgccgccggggccggggctgctgccccagccagccagcacccagccaccggcaccggggctgtgcagacagaggccatgaagcagatcctgggcgtgattgacaagaagctgaggaacctggagaagaagaagggcaagctggatgactaccaggagaggatgaacaagggggagcggctgaaccaggaccagctggatgctgtgtccaagtaccaggaggtgaccaacaacctggagtttgccaaggagctgcagaggagcttcatggccctgagccaggacatccagaagaccatcaagaagacagcccggcgggagcagctgatgagggaggaggccgagcagaagaggctgaagacagtgctggagctgcagtatgtgctggacaagctgggagatgatgaggtgaggacagacctgaagcagggcctgaatggagtgcccatcctgtctgaggaggagctgagcctgctggatgagttctacaagctggtggaccctgagcgggacatgagcctgcggctgaatgagcagtatgaacatgccagcatccacctgtgggacctgctggagggcaaggagaagcctgtgtgtggcaccacctacaaggtgctgaaggagatcgtggagagggtcttccagagcaactactttgacagcacccacaaccaccagaatggcctgtgtgaggaggaggaggccgccagcgccccagctgtggaggaccaggtgcctgaggccgagcctgagcctgctgaggagtacacagagcagagcgaggtggagagcacagaatatgtgaaccggcagttcatggccgagacccagttcaccagcggggagaaggagcaggtggatgagtggacagtggagaccgtggaggtggtgaacagcctgcagcagcagccccaggccgccagccccagcgtgcctgagccccacagcctgacccctgtggcccaggccgaccccctggtgcggcggcagagggtgcaggacctgatggcccagatgcagggcccctacaacttcatccaggacagcatgctggactttgagaaccagaccctggaccctgccatcgtgtctgcccagcccatgaaccccacccagaacatggacatgccccagctggtgtgcccccctgtgcacagcgagagccggctggcccagcccaaccaggtgcctgtgcagcctgaggccacccaggtgcccctggtgagcagcaccagcgagggctacacagccagccagcccctgtaccagcccagccacgccacagagcagaggccccagaaggagcccatcgaccagatccaggccaccatcagcctgaacacagaccagaccacagccagcagcagcctgcctgctgccagccagccccaggtgttccaggccggcaccagcaagcccctgcacagcagcggcatcaacgtgaatgctgcccccttccagagcatgcagaccgtcttcaacatgaatgcccctgtgccccctgtgaatgaacctgagaccctgaagcagcagaaccagtaccaggccagctacaaccagagcttcagcagccagccccaccaggtggagcagacagagctgcagcaggagcagctgcagacagtggtgggcacctaccacggcagcccagaccagagccaccaggtgacaggcaaccaccagcagcccccccagcagaacacaggcttccccaggagcaaccagccctactacaacagcagaggagtgtccagaggaggcagcagaggagcccggggcctgatgaatggctaccggggccctgccaacggcttccggggcggctatgatggctaccggcccagcttcagcaacacccccaacagcggctacacccagagccagttcagcgccccccgggactacagcggctaccagagagatggctaccagcagaacttcaagaggggcagcggccagagcggccccaggggggccccccggggccggggcggccccccccggcccaacagaggcatgccccagatgaacacccagcaggtgaactag

SEQ ID NO: 32886 - DNA, 2130 bp, Artificial Sequence; identical to SEQ ID NO: 32885
  Description of Artificial Sequence: Synthetic coding sequence

SEQ ID NO: 32887 - DNA, 2085 bp, Artificial Sequence
  Description of Artificial Sequence: Synthetic coding sequence
atgcccagcgccaccagccacagcggcagcggcagcaagagcagcggccccccacctccttctggcagcagcggcagcgaggccgccgccggggccggggctgctgccccagccagccagcacccagccaccggcaccggggctgtgcagacagaggccatgaagcagatcctgggcgtgattgacaagaagctgaggaacctggagaagaagaagggcaagctggatgactaccaggagaggatgaacaagggggagcggctgaaccaggaccagctggatgctgtgtccaagtaccaggaggtgaccaacaacctggagtttgccaaggagctgcagaggagcttcatggccctgagccaggacatccagaagaccatcaagaagacagcccggcgggagcagctgatgagggaggaggccgagcagaagaggctgaagacagtgctggagctgcagtatgtgctggacaagctgggagatgatgaggtgaggacagacctgaagcagggcctgaatggagtgcccatcctgtctgaggaggagctgagcctgctggatgagttctacaagctggtggaccctgagcgggacatgagcctgcggctgaatgagcagtatgaacatgccagcatccacctgtgggacctgctggagggcaaggagaagcctgtgtgtggcaccacctacaaggtgctgaaggagatcgtggagagggtcttccagagcaactactttgacagcacccacaaccaccagaatggcctgtgtgaggaggaggaggccgccagcgccccagctgtggaggaccaggtgcctgaggccgagcctgagcctgctgaggagtacacagagcagagcgaggtggagagcacagaatatgtgaaccggcagttcatggccgagacccagttcaccagcggggagaaggagcaggtggatgagtggacagtggagaccgtggaggtggtgaacagcctgcagcagcagccccaggccgccagccccagcgtgcctgagccccacagcctgacccctgtggcccaggccgaccccctggtgcggcggcagagggtgcaggacctgatggcccagatgcagggcccctacaacttcatccaggacagcatgctggactttgagaaccagaccctggaccctgccatcgtgtctgcccagcccatgaaccccacccagaacatggacatgccccagctggtgtgcccccctgtgcacagcgagagccggctggcccagcccaaccaggtgcctgtgcagcctgaggccacccaggtgcccctggtgagcagcaccagcgagggctacacagccagccagcccctgtaccagcccagccacgccacagagcagaggccccagaaggagcccatcgaccagatccaggccaccatcagcctgaacacagaccagaccacagccagcagcagcctgcctgctgccagccagccccaggtgttccaggccggcaccagcaagcccctgcacagcagcggcatcaacgtgaatgctgcccccttccagagcatgcagaccgtcttcaacatgaatgcccctgtgccccctgtgaatgaacctgagaccctgaagcagcagaaccagtaccaggccagctacaaccagagcttcagcagccagccccaccaggtggagcagacagagctgcagcaggagcagctgcagacagtggtgggcacctaccacggcagcccagaccagagccaccaggtgacaggcaaccaccagcagcccccccagcagaacacaggcttccccaggagcaaccagccctactacaacagcagaggagtgtccagaggaggcagcagaggagcccggggcctgatgaatggctaccggggccctgccaacggcttccggggcggctatgatggctaccggcccagcttcagcaacacccccaacagcggctacacccagagccagttcagcgccccccgggactacagcggctaccagagagatggctaccagcagaacttcaagaggggcagcggccagagcggccccaggggggccccccggggcaacatcctgtggtggtag

SEQ ID NO: 32888 - DNA, 2274 bp, Artificial Sequence
  Description of Artificial Sequence: Synthetic coding sequence
atgtctgagaacagcagtgacagcgacagcagctgtggctggacagtcatcagccatgagggcagtgacatcgagatgctgaacagcgtgacccccacagacagctgtgagcccgccccagaatgtagcagcctggagcaggaggagctgcaggccctgcagatcgagcagggcgagagcagccagaatggaacagtgctgatggaggagacagcctacccagccctggaggagaccagcagcaccattgaagctgaggagcagaagatccctgaggacagcatctacatcggcacagccagtgatgacagcgacatcgtgaccctggagccccccaagctggaggagatcggcaaccaggaggtggtgattgtggaggaggcccagagcagcgaggacttcaacatgggcagcagcagcagcagccagtacaccttctgccagcctgagaccgtcttcagcagccagcccagtgatgatgagagcagcagtgatgagaccagcaaccagcccagccctgccttcagaagaagaagagccaggaagaagacagtgtctgccagcgagagtgaagatcggctggtggccgagcaggagacagagcccagcaaggagctgagcaagaggcagttcagcagcggcctgaacaagtgtgtgatcctggccctggtgattgccatctccatgggcttcggccacttctacggcaccatccagatccagaagaggcagcagctggtgaggaagatccatgaagatgagctgaatgacatgaaggactacctgagccagtgccagcaggagcaggagagcttcatcgactacaagagcctgaaggagaacctggcccgctgctggaccctgacagaagctgagaagatgagctttgagacccagaagaccaacctggccacagagaaccagtacctgcgggtgtccctggagaaggaggagaaggccctgagcagcctgcaggaggagctgaacaagctgcgggagcagatccgcatcctggaggacaagggcaccagcacagagctggtgaaggagaaccagaagctgaagcagcacctggaggaggagaagcagaagaagcacagcttcctgagccagcgggagaccctgctgacagaggccaagatgctgaagcgggagctggagcgggagcggctggtgaccacagccctgcggggggagctgcagcagctgagcggcagccagctgcacggcaagagtgacagccccaacgtgtacacagagaagaaggagatcgccatcctgcgggagcggctgacagagctggagaggaagctgacctttgagcagcagaggagtgacctgtgggagcggctgtatgtggaggccaaggaccagaatggcaagcagggcacagatggcaagaagaagggcggccggggcagccaccgggccaagaacaagagcaaggagaccttcctgggctctgtgaaggagacctttgatgccatgaagaacagcaccaaggagtttgtgcgccaccacaaggagaagatcaagcaggccaaggaggccgtgaaggagaacctgaagaagttcagtgacagcgtgaagagcaccttccgccacttcaaggacaccaccaagaacatctttgatgagaagggcaacaagagatttggagccaccaaggaggccgctgagaagcccaggacagtgttcagtgactacctgcacccccagtacaaggcccccacagagaaccaccacaacagaggccccaccatgcagaatgatggcaggaaggagaagcctgtgcacttcaaggagttcaggaagaacaccaacagcaagaagtgcagccctggccatgactgccgggagaacagccacagcttcaggaaggcctgcagcggcgtgtttgactgtgcccagcaggagagcatgagcctcttcaacacagtggtgaaccccatccgcatggatgagttccggcagatcatccagcgctacatgctgaaggagctggacaccttctgccactggaatgagctggaccagttcatcaacaagttcttcctgaatggagtcttcatccatgaccagaagctgttcacagactttgtgaatgatgtgaaggactacctgaggaacatgaaggagtatgaggtggacaatgatggagtgtttgagaagctggatgagtacatctaccgccacttcttcggccacaccttcagccccccctacggccccaggtctgtgtacatcaagccctgccactacagcagcctgtag

SEQ ID NO: 32889 - DNA, 1275 bp, Artificial Sequence
  Description of Artificial Sequence: Synthetic coding sequence
atgtctgagaacagcagtgacagcgacagcagctgtggctggacagtcatcagccatgagggcagtgacatcgagatgctgaacagcgtgacccccacagacagctgtgagcccgccccagaatgtagcagcctggagcaggaggagctgcaggccctgcagatcgagcagggcgagagcagccagaatggaacagtgctgatggaggagacagcctacccagccctggaggagaccagcagcaccattgaagctgaggagcagaagatccctgaggacagcatctacatcggcacagccagtgatgacagcgacatcgtgaccctggagccccccaagctggaggagatcggcaaccaggaggtggtgattgtggaggaggcccagagcagcgaggacttcaacatgggcagcagcagcagcagccagtacaccttctgccagcctgagaccgtcttcagcagccagcccagtgatgatgagagcagcagtgatgagaccagcaaccagcccagccctgccttcagaagaagaagagccaggaagaagacagtgtctgccagcgagagtgaagatcggctggtggccgagcaggagacagagcccagcaaggagctgagcaagaggcagttcagcagcggcctgaacaagtgtgtgatcctggccctggtgattgccatctccatgggcttcggccacttctacggcaccatccagatccagaagaggcagcagctggtgaggaagatccatgaagatgagctgaatgacatgaaggactacctgagccagtgccagcaggagcaggagagcttcatcgactacaagagcctgaaggagaacctggcccgctgctggaccctgacagaagctgagaagatgagctttgagacccagaagaccaacctggccacagagaaccagtacctgaggaagctgttcacagactttgtgaatgatgtgaaggactacctgaggaacatgaaggagtatgaggtggacaatgatggagtgtttgagaagctggatgagtacatctaccgccacttcttcggccacaccttcagccccccctacggccccagcaggccagacaagaagcagaggatggtgaacatcgagaacagccgccacaggaagcaggagcagaagcacctgcagccccagccctacaagcgggagggcaagtggcacaagtatggccgcaccaacggccggcagatggccaacctggagattgagctgggccagctgccctttgacccccagtactag

SEQ ID NO: 32890 - DNA, 2424 bp, Artificial Sequence
  Description of Artificial Sequence: Synthetic coding sequence
atgtctgagaacagcagtgacagcgacagcagctgtggctggacagtcatcagccatgagggcagtgacatcgagatgctgaacagcgtgacccccacagacagctgtgagcccgccccagaatgtagcagcctggagcaggaggagctgcaggccctgcagatcgagcagggcgagagcagccagaatggaacagtgctgatggaggagacagcctacccagccctggaggagaccagcagcaccattgaagctgaggagcagaagatccctgaggacagcatctacatcggcacagccagtgatgacagcgacatcgtgaccctggagccccccaagctggaggagatcggcaaccaggaggtggtgattgtggaggaggcccagagcagcgaggacttcaacatgggcagcagcagcagcagccagtacaccttctgccagcctgagaccgtcttcagcagccagcccagtgatgatgagagcagcagtgatgagaccagcaaccagcccagccctgccttcagaagaagaagagccaggaagaagacagtgtctgccagcgagagtgaagatcggctggtggccgagcaggagacagagcccagcaaggagctgagcaagaggcagttcagcagcggcctgaacaagtgtgtgatcctggccctggtgattgccatctccatgggcttcggccacttctacggcaccatccagatccagaagaggcagcagctggtgaggaagatccatgaagatgagctgaatgacatgaaggactacctgagccagtgccagcaggagcaggagagcttcatcgactacaagagcctgaaggagaacctggcccgctgctggaccctgacagaagctgagaagatgagctttgagacccagaagaccaacctggccacagagaaccagtacctgcgggtgtccctggagaaggaggagaaggccctgagcagcctgcaggaggagctgaacaagctgcgggagcagatccgcatcctggaggacaagggcaccagcacagagctggtgaaggagaaccagaagctgaagcagcacctggaggaggagaagcagaagaagcacagcttcctgagccagcgggagaccctgctgacagaggccaagatgctgaagcgggagctggagcgggagcggctggtgaccacagccctgcggggggagctgcagcagctgagcggcagccagctgcacggcaagagtgacagccccaacgtgtacacagagaagaaggagatcgccatcctgcgggagcggctgacagagctggagaggaagctgacctttgagcagcagaggagtgacctgtgggagcggctgtatgtggaggccaaggaccagaatggcaagcagggcacagatggcaagaagaagggcggccggggcagccaccgggccaagaacaagagcaaggagaccttcctgggctctgtgaaggagacctttgatgccatgaagaacagcaccaaggagtttgtgcgccaccacaaggagaagatcaagcaggccaaggaggccgtgaaggagaacctgaagaagttcagtgacagcgtgaagagcaccttccgccacttcaaggacaccaccaagaacatctttgatgagaagggcaacaagagatttggagccaccaaggaggccgctgagaagcccaggacagtgttcagtgactacctgcacccccagtacaaggcccccacagagaaccaccacaacagaggccccaccatgcagaatgatggcaggaaggagaagcctgtgcacttcaaggagttcaggaagaacaccaacagcaagaagtgcagccctggccatgactgccgggagaacagccacagcttcaggaaggcctgcagcggcgtgtttgactgtgcccagcaggagagcatgagcctcttcaacacagtggtgaaccccatccgcatggatgagttccggcagatcatccagcgctacatgctgaaggagctggacaccttctgccactggaatgagctggaccagttcatcaacaagttcttcctgaatggagtcttcatccatgaccagaagctgttcacagactttgtgaatgatgtgaaggactacctgaggaacatgaaggagtatgaggtggacaatgatggagtgtttgagaagctggatgagtacatctaccgccacttcttcggccacaccttcagccccccctacggccccagcaggccagacaagaagcagaggatggtgaacatcgagaacagccgccacaggaagcaggagcagaagcacctgcagccccagccctacaagcgggagggcaagtggcacaagtatggccgcaccaacggccggcagatggccaacctggagattgagctgggccagctgccctttgacccccagtactag

SEQ ID NO: 32891 - DNA, 717 bp, Artificial Sequence
  Description of Artificial Sequence: Synthetic coding sequence
atggagtatgccatgaagagcctgagcctgctgtaccccaagagcctgagcagacatgtgtctgtgaggacctctgtggtgacccagcagctgctgtctgagcccagccccaaggccccccgggcccggccctgccgggtgtccacagctgacagatctgtgaggaagggcatcatggcctacagcctggaggacctgctgctgaaggtgcgggacaccctgatgctggccgacaagcccttcttcctggtgctggaggaggatggcaccaccgtggagacagaggagtacttccaggccctggccggggacacagtgttcatggtgctgcagaagggccagaagtggcagccccccagcgagcagggcaccaggcaccccctgagcctgagccacaagccagccaagaagattgatgtggcccgggtgacctttgacctgtacaagctgaacccccaggacttcatcggctgcctgaatgtgaaggccaccttctatgacacctacagcctgtcctatgacctgcactgctgcggggccaagaggatcatgaaggaggccttccgctgggccctcttctccatgcaggccaccggccacgtgctgctgggcaccagctgctacctgcagcagctgctggatgccacagaggagggccagccccccaagggcaaggccagcagcctcatccccacctgcctgaagatcctgcagtag

SEQ ID NO: 32892 - DNA, 402 bp, Artificial Sequence
  Description of Artificial Sequence: Synthetic coding sequence
atggagtatgccatgaagagcctgagcctgctgtaccccaagagcctgagcagacatgtgtctgtgaggacctctgtggtgacccagcagctgctgtctgagcccagccccaaggccccccgggcccggccctgccgggtgtccacagctgacagatctgtgaggaagggcatcatggcctacagcctggaggacctgctgctgaagggcagcttccccctgggccccctgcagcacgccggccaccggcccaggacagcctggcacctgctgctgcctgctgctgccccccgctgctacggcggccgggccgccccccagggccagggcctcatcccctacccagacctgtctgaggacacagctgtgaaggcccaggtgctgggcagcttcccccagtag

SEQ ID NO: 32893 - DNA, 495 bp, Artificial Sequence
  Description of Artificial Sequence: Synthetic coding sequence
atgctggccgacaagcccttcttcctggtgctggaggaggatggcaccaccgtggagacagaggagtacttccaggccctggccggggacacagtgttcatggtgctgcagaagggccagaagtggcagccccccagcgagcagggcaccaggcaccccctgagcctgagccacaagccagccaagaagattgatgtggcccgggtgacctttgacctgtacaagctgaacccccaggacttcatcggctgcctgaatgtgaaggccaccttctatgacacctacagcctgtcctatgacctgcactgctgcggggccaagaggatcatgaaggaggccttccgctgggccctcttctccatgcaggccaccggccacgtgctgctgggcaccagctgctacctgcagcagctgctggatgccacagaggagggccagccccccaagggcaaggccagcagcctcatccccacctgcctgaagatcctgcagtag

SEQ ID NO: 32894 - DNA, 495 bp, Artificial Sequence; identical to SEQ ID NO: 32893
  Description of Artificial Sequence: Synthetic coding sequence

SEQ ID NO: 32895 - DNA, 747 bp, Artificial Sequence
  Description of Artificial Sequence: Synthetic coding sequence
atggagtatgccatgaagagcctgagcctgctgtaccccaagagcctgagcagacatgtgtctgtgaggacctctgtggtgacccagcagctgctgtctgagcccagccccaaggccccccgggcccggccctgccgggtgtccacagctgacagatctgtgaggaagggcatcatggcctacagcctggaggacctgctgctgaagaccagaaatcctgaggcccggagccaggaggtgcgggacaccctgatgctggccgacaagcccttcttcctggtgctggaggaggatggcaccaccgtggagacagaggagtacttccaggccctggccggggacacagtgttcatggtgctgcagaagggccagaagtggcagccccccagcgagcagggcaccaggcaccccctgagcctgagccacaagccagccaagaagattgatgtggcccgggtgacctttgacctgtacaagctgaacccccaggacttcatcggctgcctgaatgtgaaggccaccttctatgacacctacagcctgtcctatgacctgcactgctgcggggccaagaggatcatgaaggaggccttccgctgggccctcttctccatgcaggccaccggccacgtgctgctgggcaccagctgctacctgcagcagctgctggatgccacagaggagggccagccccccaagggcaaggccagcagcctcatccccacctgcctgaagatcctgcagtag

SEQ ID NO: 32896 - DNA, 987 bp, Artificial Sequence
  Description of Artificial Sequence: Synthetic coding sequence
atggccaacagcgccagccctgagcagaaccagaaccactgcagcgccatcaacaacagcatccccctgatgcagggcaacctgcccaccctgaccctgagcggcaagatccgggtgacagtgaccttcttcctgttcctgctgagcgccaccttcaatgccagcttcctgctgaagctgcagaagtggacccagaagaaggagaagggcaagaagctgagcaggatgaagctgctgctgaagcacctgaccctggccaacctgctggagaccctgattgtgatgcccctggatggcatgtggaacatcaccgtgcagtggtacgccggggagctgctgtgcaaggtgctgagctacctgaagctgttctccatgtatgccccagccttcatgatggtggtgatcagcctggacaggagcctggccatcacccggcccctggccctgaagagcaacagcaaggtgggccagagcatggtgggcctggcctggatcctgagctctgtgtttgctggcccccagctgtacatcttcaggatgatccacctggccgacagcagcggccagaccaaggtgttcagccagtgtgtgacccactgcagcttcagccagtggtggcaccaggccttctacaacttcttcaccttcagctgcctcttcatcatccccctcttcatcatgctgatctgcaatgccaagatcatcttcaccctgaccagggtgctgcaccaggacccccatgagctgcagctgaaccagagcaagaacaacatcccccgggcccggctgaagaccctgaagatgacagtggcctttgccaccagcttcaccgtgtgctggaccccctactacgtgctgggcatctggtactggtttgatcctgagatgctgaaccggctgagtgaccctgtgaaccacttcttcttcctgtttgccttcctgaacccctgctttgaccccctcatctacggctacttcagcctgtag

SEQ ID NO: 32897 - DNA, 504 bp, Artificial Sequence
  Description of Artificial Sequence: Synthetic coding sequence
atgagcctggccctgcggtctgagctggtggtggacaagaccaagaggaagaagagaagagagctgtctgaggagcagaagcaggagatcaaggatgcctttgagctgtttgacacagacaaggatgaggccatcgactaccacgagctgaaggtggccatgagggccctgggctttgatgtgaagaaggcagatgtgctgaagatcctgaaggactatgaccgggaggccaccgggaagatcacctttgaggacttcaatgaggtggtgacagactggatcctggagcgggacccccatgaggagatcctgaaggccttcaagctgtttgatgatgatgattctgggaagatcagcctgaggaacctgcggcgggtggcccgggagctgggggagaacatgtctgatgaggagctgcgggccatgattgaggagtttgacaaggatggagatggagagatcaaccaggaggagttcatcgccatcatgaccggggacatctag

SEQ ID NO: 32898 - DNA, 789 bp, Artificial Sequence
  Description of Artificial Sequence: Synthetic coding sequence
atggctgtgacagcccaggccgcccggaggaaggagcgggtgctgtgcctgtttgatgtggatggcaccctgaccccagcccggcagaagattgatcctgaggtggccgccttcctgcagaagctgcggagccgggtgcagatcggcgtggtgggcggcagtgactactgcaagattgctgagcagctgggagatggagatgaagtcatcgagaagtttgattatgtgtttgctgaaaatggcaccgtgcagtacaagcacggccgcctgctgagcaagcagaccatccagaaccacctgggggaggagctgctgcaggacctgatcaacttctgcctgagctacatggccctgctgcggctgcccaagaagaggggcaccttcatcgagttcagaaatggcatgctgaacatcagccccatcggccgcagctgcaccctggaggagagaattgagttcagcgagctggacaagaaggagaagatccgggagaagtttgtggaggccctgaagacagaatttgctgggaagggcctgcgcttcagccggggcggcatgatcagctttgatgtgtttcctgagggctgggacaagcgctactgcctggacagcctggaccaggacagctttgacaccatccacttctttggaaatgagaccagccctggaggaaatgactttgagatctttgctgaccccaggacagtgggccacagcgtggtgagcccccaggacacagtgcagcgctgccgggagatcttcttccctgagacagcccacgaggcctag

SEQ ID NO: 32899 - DNA, 1020 bp, Artificial Sequence
  Description of Artificial Sequence: Synthetic coding sequence
atgttttctgaggtgctgcacggcctcatcggccgcacccagaggtctgctggggtggaccagaaccaccccagggctgtgctggtgcccagcagcctgagaattggcatcatcccagctggcagcacagactgtgtgtgctacagcacagtgggcaccagtgatgctgagaccagcgccctgcacatcgtggtgggggacagcctggccatggatgtgtcctctgtgcaccacaacagcaccctgctgcgctacagcgtgtccctgctgggctacggcttctatggagacatcatcaaggacagcgagaagaagcgctggctgggcctggcccgctatgacttcagcggcctgaagaccttcctgagccaccactgctatgagggcaccgtgtccttcctgcctgcccagcacacagtgggcagcccccgggacaggaagccctgcagagctggctgctttgtgtgccggcagagcaagcagcagctggaggaggagcagaagaaggccctgtatggcctggaggccgcagaagatgtggaggagtggcaggtggtgtgtgggaagttcctggccatcaatgccaccaacatgagctgtgcctgcagaagaagcccccggggcctgagccctgctgcccacctgggagatggcagcagtgacctgatcctgatcaggaagtgcagccgcttcaacttcctgcgcttcctgatccgccacaccaaccagcaggaccagtttgacttcacctttgtggaggtgtacagagtgaagaagttccagttcaccagcaagcacatggaggatgaggacagcgacctgaaggagggcggcaagaagcgcttcggccacatctgcagcagccaccccagctgctgctgcaccgtgagcaacagctcctggaactgtgatggagaggtgctgcacagccctgccatcgaggtgcgggtgcactgccagctggtgcggctgtttgcccggggcatcgaggagaaccccaagccagacagccacagctag

SEQ ID NO: 32900 - DNA, 1053 bp, Artificial Sequence
  Description of Artificial Sequence: Synthetic coding sequence
atggctgctgctggccctgctgctggccccactggacctgagcccatgcccagctatgcccagctggtgcagaggggctggggcagcgccctggccgccgcccggggctgcacagactgtggctggggcctggcccggcggggcctggccgagcacgcccacctggcccctcctgagctgctgctgctggccctgggcgccctgggctggacagccctgcggtctgctgccacagcccggctcttccggcccctggccaagcgctgctgcctgcagcccagagatgctgccaagatgcctgagagcgcctggaagttcctgttctacctgggctcctggagctacagcgcctacctgctgtttggaacagactaccccttcttccatgaccccccatctgtgttctatgactggaccccaggcatggctgtgccccgggacattgctgctgcctacctgctgcagggcagcttctacggccacagcatctatgccaccctgtacatggacacctggaggaaggacagcgtggtgatgctgctgcaccacgtggtgaccctcatcctgattgtgtcctcctatgccttccgctaccacaacgtgggcatcctggtgctcttcctgcatgacatcagtgatgtgcagctggagttcaccaagctgaacatctacttcaagagcagaggaggcagctaccaccggctgcacgccctggccgctgacctgggctgcctgagctttggcttctcctggttctggttccggctgtactggttccccctgaaggtgctgtatgccaccagccactgcagcctgaggacagtgcctgacatccccttctacttcttcttcaatgccctgctgctgctgctgaccctgatgaacctgtactggttcctgtacatcgtggcctttgctgccaaggtgctgaccggccaggtgcatgagctgaaggacctgcgggagtatgacacagctgaggcccagagcctgaagcccagcaaggccgagaagcccctgagaaatggcctggtgaaggacaagcgcttctag

SEQ ID NO: 32901 - DNA, 1014 bp, Artificial Sequence
  Description of Artificial Sequence: Synthetic coding sequence
atggctgctgctggccctgctgctggccccactggacctgagcccatgcccagctatgcccagctggtgcagaggggctggggcagcgccctggccgccgcccggggctgcacagactgtggctggggcctggcccggcggggcctggccgagcacgcccacctggcccctcctgagctgctgctgctggccctgggcgccctgggctggacagccctgcggtctgctgccacagcccggctcttccggcccctggccaagcgctgctgcctgcagcccagagatgctgccaagatgcctgagagcgcctggaagttcctgttctacctgggctcctggagctacagcgcctacctgctgtttggaacagactaccccttcttccatgaccccccatctgtgttctatgactggaccccaggcatggctgtgccccgggacattgctgctgcctacctgctgcagggcagcttctacggccacagcatctatgccaccctgtacatggacacctggaggaaggacagcgtggtgatgctgctgcaccacgtggtgaccctcatcctgattgtgtcctcctatgccttccgctaccacaacgtgggcatcctggtgctcttcctgcatgacatcagtgatgtgcagctggagttcaccaagctgaacatctacttcaagagcagaggaggcagctaccaccggctgcacgccctggccgctgacctgggctgcctgagctttggcttctcctggttctggttccggctgtactggttccccctgaaggtgctgtatgccaccagccactgcagcctgaggacagtgcctgacatccccttctacttcttcttcaatgccctgctgctgctgctgaccctgatgaacctgtactggttcctgtacatcgtggcctttgctgccaaggtgctgaccggccaggtgcatgagctgaaggacctgcgggagtatgacacagctgaggcccagagcctgaagcccagcaaggccgagtag

SEQ ID NO: 32902 - DNA, 720 bp, Artificial Sequence
  Description of Artificial Sequence: Synthetic coding sequence
atgcctgagagcgcctggaagttcctgttctacctgggctcctggagctacagcgcctacctgctgtttggaacagactaccccttcttccatgaccccccatctgtgttctatgactggaccccaggcatggctgtgccccgggacattgctgctgcctacctgctgcagggcagcttctacggccacagcatctatgccaccctgtacatggacacctggaggaaggacagcgtggtgatgctgctgcaccacgtggtgaccctcatcctgattgtgtcctcctatgccttccgctaccacaacgtgggcatcctggtgctcttcctgcatgacatcagtgatgtgcagctggagttcaccaagctgaacatctacttcaagagcagaggaggcagctaccaccggctgcacgccctggccgctgacctgggctgcctgagctttggcttctcctggttctggttccggctgtactggttccccctgaaggtgctgtatgccaccagccactgcagcctgaggacagtgcctgacatccccttctacttcttcttcaatgccctgctgctgctgctgaccctgatgaacctgtactggttcctgtacatcgtggcctttgctgccaaggtgctgaccggccaggtgcatgagctgaaggacctgcgggagtatgacacagctgaggcccagagcctgaagcccagcaaggccgagtag

SEQ ID NO: 32903 - DNA, 1143 bp, Artificial Sequence
  Description of Artificial Sequence: Synthetic coding sequence
atgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgctgaagaagttccgggaggcctcctggaggttcaccttctacctgattgccttcatcgccggcatggccgtcatcgtggacaagccctggttctatgacatgaagaaggtgtgggagggctaccccatccagagcaccatccccagccagtactggtactacatgattgagctgtccttctactggagcctgctcttcagcatcgccagtgatgtgaagaggaaggacttcaaggagcagatcatccaccacgtggccaccatcatcctgatctccttctcctggtttgccaactacatccgggccggcaccctcatcatggccctgcatgacagcagtgactacctgctggagagcgccaagatgttcaactatgccggctggaagaacacctgcaacaacatcttcatcgtgtttgccatcgtgttcatcatcacccggctggtgatcctgcccttctggatcctgcactgcaccctggtgtaccccctggagctgtacccagccttcttcggctactacttcttcaacagcatgatgggcgtgctgcagctgctgcacatcttctgggcctacctgatcctgaggatggcccacaagttcatcaccgggaagctggtggaggatgagaggagtgaccgggaggagacagagagcagcgagggggaggaggccgccgccggcggcggggccaagagccggcccctggccaacggccaccccatcctgaacaacaaccacaggaagaatgactag

SEQ ID NO: 32904 - DNA, 693 bp, Artificial Sequence
  Description of Artificial Sequence: Synthetic coding sequence
atggccgtcatcgtggacaagccctggttctatgacatgaagaaggtgtgggagggctaccccatccagagcaccatccccagccagtactggtactacatgattgagctgtccttctactggagcctgctcttcagcatcgccagtgatgtgaagaggaaggacttcaaggagcagatcatccaccacgtggccaccatcatcctgatctccttctcctggtttgccaactacatccgggccggcaccctcatcatggccctgcatgacagcagtgactacctgctggagagcgccaagatgttcaactatgccggctggaagaacacctgcaacaacatcttcatcgtgtttgccatcgtgttcatcatcacccggctggtgatcctgcccttctggatcctgcactgcaccctggtgtaccccctggagctgtacccagccttcttcggctactacttcttcaacagcatgatgggcgtgctgcagctgctgcacatcttctgggcctacctgatcctgaggatggcccacaagttcatcaccgggaagctggtggaggatgagaggagtgaccgggaggagacagagagcagcgagggggaggaggccgccgccggcggcggggccaagagccggcccctggccaacggccaccccatcctgaacaacaaccacaggaagaatgactag

SEQ ID NO: 32905 - DNA, 750 bp, Artificial Sequence
  Description of Artificial Sequence: Synthetic coding sequence
atgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgctgaagaagttccgggaggcctcctggaggttcaccttctacctgattgccttcatcgccggcatggccgtcatcgtggacaagccctggttctatgacatgaagaaggtgtgggagggctaccccatccagagcaccatccccagccagtactggtactacatgattgagctgtccttctactggagcctgctcttcagcatcgccagtgatgtgaagaggaaggacttcaaggagcagatcatccaccacgtggccaccatcatcctgatctccttctcctggtttgccaactacatccgggccggcaccctcatcatggccctgcatgacagcagtgactacctgctggaggtgaggtag

SEQ ID NO: 32906 - DNA, 975 bp, Artificial Sequence
  Description of Artificial Sequence: Synthetic coding sequence
atggtgcccctggccctgcacttccctggagaggtgggcctgcaggagacagctgtgaggatgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgctgaagaagttccgggaggcctcctggaggttcaccttctacctgattgccttcatcgccggcatggccgtcatcgtggacaagccctggttctatgacatgaagaaggtgtgggagggctaccccatccagagcaccatccccagccagtactggtactacatgattgagctgtccttctactggagcctgctcttcagcatcgccagtgatgtgaagaggaaggacttcaaggagcagatcatccaccacgtggccaccatcatcctgatctccttctcctggtttgccaactacatccgggccggcaccctcatcatggccctgcatgacagcagtgactacctgctggagagcgccaagatgttcaactatgccggctggaagaacacctgcaacaacatcttcatcgtgtttgccatcgtgttcatcatcacccggctggtgatcctgcccttctggatcctgcactgcaccctggtgtaccccctggagctgtacccagccttcttcggctactacttctag

SEQ ID NO: 32907 - DNA, 1143 bp, Artificial Sequence; identical to SEQ ID NO: 32903
  Description of Artificial Sequence: Synthetic coding sequence

SEQ ID NO: 32908 - DNA, 579 bp, Artificial Sequence
  Description of Artificial Sequence: Synthetic coding sequence
atgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgctgaagaagttccgggaggcctcctggaggttcaccttctacctgattgccttcatcgccggcatggccgtcatcgtggacaagccctggttctatgacatgaagaaggtgtgggagggctaccccatccagagcaccatccccagccagtactggtactacatgattgagctgtccttctactggagctag

SEQ ID NO: 32909 - DNA, 390 bp, Artificial Sequence
  Description of Artificial Sequence: Synthetic coding sequence
atgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgtag

SEQ ID NO: 32910 - DNA, 672 bp, Artificial Sequence
  Description of Artificial Sequence: Synthetic coding sequence
atgctgcagaccctgtatgactacttctggtgggagcggctgtggctgcctgtgaacctgacctgggccgacctggaggacagagatggccgggtgtatgccaaggccagtgacctgtacatcaccctgcccctggccctgctcttcctgattgtgcgctacttctttgagctgtatgtggccacccccctggccgccctgctgaacatcaaggagaagacccggctgcgggcccccccaaatgccaccctggagcacttctacctgaccagcggcaagcagcccaagcaggtggaggtggagctgctgagccggcagagcggcctgagcggccggcaggtggagcgctggttcagaagaagaagaaaccaggaccggcccagcctgctgaagaagttccgggaggcctcctggaggttcaccttctacctgattgccttcatcgccggcatggccgtcatcgtggacaagccctggttctatgacatgaagaaggtgtgggagggctaccccatccagagcaccatccccagccagtactggtactacatgattgagctgtccttctactggagcctgctcttcagcatcgccagtgatgtgaagaggaaggacttcaaggagcagatcatccaccacgtggccaccatcatcctgatctccttctcctag

SEQ ID NO: 32911 - DNA, 1152 bp, Artificial Sequence
  Description of Artificial Sequence: Synthetic coding sequence
atgttctggaccttcaaggagtggttctggctggagcgcttctggctgccccccaccatcaagtggagcgacctggaggaccatgatggcctggtgtttgtgaagcccagccacctgtatgtgaccatcccctatgccttcctgctgctgatcatcagaagagtgtttgagaagtttgtggccagccccctggccaagagctttggcatcaaggagaccgtgaggaaggtgacccccaacacagtgctggagaacttcttcaagcacagcacccggcagcccctgcagacagacatctacggcctggccaagaagtgcaacctgacagagcggcaggtggagcgctggttccgcagcagaagaaaccaggagcggcccagccggctgaagaagttccaggaggcctgctggaggtttgccttctacctgatgatcaccgtggccggcatcgccttcctgtatgacaagccctggctgtatgacctgtgggaggtgtggaatggctaccccaagcagcccctgctgcccagccagtactggtactacatcctggagatgtccttctactggagcctgctcttccggctgggctttgatgtgaagaggaaggacttcctggcccacatcatccaccacctggccgccatcagcctgatgtccttctcctggtgtgccaactacatccgcagcggcaccctggtgatgattgtgcatgatgtggccgacatctggctggagagcgccaagatgttctcctatgccggctggacccagacctgcaacaccctcttcttcatcttcagcaccatcttcttcatcagccggctgattgtgttccccttctggatcctgtactgcaccctcatcctgcccatgtaccacctggagcccttcttctcctacatcttcctgaacctgcagctgatgatcctgcaggtgctgcacctgtactggggctactacatcctgaagatgctgaaccgctgcatcttcatgaagagcatccaggatgtgcggagtgatgatgaagattatgaggaggaggaggaggaggaggaggaggaggccaccaagggcaaggagatggactgcctgaagaatggcctgcgggcagagcggcacctgatccccaacggccagcacggccactag

SEQ ID NO: 32912 - DNA, 1152 bp, Artificial Sequence; identical to SEQ ID NO: 32911
  Description of Artificial Sequence: Synthetic coding sequence

SEQ ID NO: 32913 - DNA, 1152 bp, Artificial Sequence; identical to SEQ ID NO: 32911
  Description of Artificial Sequence: Synthetic coding sequence

SEQ ID NO: 32914 - DNA, 468 bp, Artificial Sequence
  Description of Artificial Sequence: Synthetic coding sequence
atgttctggaccttcaaggagtggttctggctggagcgcttctggctgccccccaccatcaagtggagcgacctggaggaccatgatggcctggtgtttgtgaagcccagccacctgtatgtgaccatcccctatgccttcctgctgctgatcatcagaagagtgtttgagaagtttgtggccagccccctggccaagagctttggcatcaaggagaccgtgaggaaggtgacccccaacacagtgctggagaacttcttcaagcacagcacccggcagcccctgcagacagacatctacggcctggccaagaagtgcaacctgacagagcggcaggtggagcgctggttccgcagcagaagaaaccaggagcggcccagccggctgaagaagttccaggaggcctgctggaggtttgccttctacctgatgatcaccgtggccggcatcgccttcctgtatgactag

SEQ ID NO: 32915 - DNA, 48 bp, Artificial Sequence
  Description of Artificial Sequence: Synthetic coding sequence
atgttctggaccttcaaggagtggttctggctggagcgcttctggtag

SEQ ID NO: 32916 - DNA, 174 bp, Artificial Sequence
  Description of Artificial Sequence: Synthetic coding sequence
atgttctggaccttcaaggagtggttctggctggagcgcttctggctgccccccaccatcaagtggagcgacctggaggaccatgatggcctggtgtttgtgaagcccagccacctgtatgtgaccatcccctatgccttcctgctgctgatcatcagaagagtgtttgaatag

SEQ ID NO: 32917 - DNA, 1185 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtacccccacccccaggacctgctggccgccctgcccctggccctggtgctgctggccatgaggctggcctttgagcgcttcatcggcctgcccctgagccgctggctgggcgtgcgggaccagacccggcggcaggtgaagcccaatgccaccctggagaagcacttcctgacagagggccaccggcccaaggagccccagctgagcctgctggccgcccagtgtggcctgaccctgcagcagacccagcgctggttcagaagaagaagaaaccaggaccggccccagctgaccaagaagttctgtgaggcctcctggaggttcctgttctacctgagcagctttgtgggcggcctgtctgtgctgtaccacgagagctggctgtgggcccctgtgatgtgctgggaccgctaccccaaccagaccctgaagcccagcctgtactggtggtacctgctggagctgggcttctacctgagcctgctgatccggctgccctttgatgtgaagaggaaggacttcaaggagcaggtgatccaccactttgtggccgtcatcctgatgaccttctcctacagcgccaacctgctgagaattggcagcctggtgctgctgctgcatgacagcagtgactacctgctggaggcctgcaagatggtgaactacatgcagtaccagcaggtgtgtgatgccctcttcctgatcttctcctttgtgttcttctacacccggctggtgctcttccccacccagatcctgtacaccacctactatgagagcatcagcaacagaggccccttcttcggctactacttcttcaacggcctgctgatgctgctgcagctgctgcacgtgttctggagctgcctgatcctgaggatgctgtacagcttcatgaagaagggccagatggagaaggacatccgcagtgatgtggaggagagtgacagcagcgaggaggccgctgctgcccaggagcccctgcagctgaagaatggagctgctgggggccccaggcctgcccccacagatggccccaggagccgggtggccggccgcctgaccaacagacacaccacagccacctag

SEQ ID NO: 32918 - DNA, 342 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtacccccacccccaggacctgctggccgccctgcccctggccctggtgctgctggccatgaggctggcctttgagcgcttcatcggcctgcccctgagccgctggctgggcgtgcgggaccagacccggcggcaggtgaagcccaatgccaccctggagaagcacttcctgacagagggccaccggcccaaggagccccagctgagcctgctggccgcccagtgtggcctgaccctgcagcagtag

SEQ ID NO: 32919 - DNA, 579 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtacccccacccccaggacctgctggccgccctgcccctggccctggtgctgctggccatgaggctggcctttgagcgcttcatcggcctgcccctgagccgctggctgggcgtgcgggaccagacccggcggcaggtgaagcccaatgccaccctggagaagcacttcctgacagagggccaccggcccaaggagccccagctgagcctgctggccgcccagtgtggcctgaccctgcagcagacccagcgctggttcagaagaagaagaaaccaggaccggccccagctgaccaagaagttctgtgaggcctcctggaggttcctgttctacctgagcagctttgtgggcggcctgtctgtgctgtaccacgagagctggctgtgggcccctgtgatgtgctgggaccgctaccccaaccagaccctgaagcccagcctgtactggtggtacctgctggagctgggcttctacctgtcctag

SEQ ID NO: 32920 - DNA, 1185 bp, Artificial Sequence; identical to SEQ ID NO: 32917
  Description of Artificial Sequence: Synthetic coding sequence

SEQ ID NO: 32921 - DNA, 99 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtag

SEQ ID NO: 32922 - DNA, 279 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtacccccacccccaggacctgctggccgccctgcccctggccctggtgctgctggccatgaggctggcctttgagcgcttcatcggcctgcccctgagccgctggctgggcgtgcgggaccagacccggcggcaggtgaagcccaatgccaccctggagaagcacttcctgacagagggctag

SEQ ID NO: 32923 - DNA, 1179 bp, Artificial Sequence
  Description of Artificial Sequence: Synthetic coding sequence
atggccacagctgcccagggccccctgagcctgctgtggggctggctgtggagcgagcgcttctggctgcctgaaaatgtgtcctgggccgacctggagggccctgcagatggctacggctacccccggggccgccacatcctgtctgtgttccccctggccgccggcatcttctttgtgcggctgctgtttgagcgcttcatcgccaagccctgtgccctgtgcatcggcattgaagattctggcccctaccaggcccagcccaatgccatcctggagaaggtgttcatcagcatcaccaagtacccagacaagaagaggctggagggcctgagcaagcagctggactggaatgtgaggaagatccagtgctggttccgccacagaagaaaccaggacaagccacccaccctgaccaagttctgtgagagcatgtggaggttcaccttctacctgtgcatcttctgctacggcatccgcttcctgtggagcagcccctggttctgggacatccggcagtgctggcacaactaccccttccagcccctgagcagcggcctgtaccactactacatcatggagctggccttctactggagcctgatgttcagccagttcacagacatcaagaggaaggacttcctgatcatgtttgtgcaccacctggtgaccatcggcctcatctccttctcctacatcaacaacatggtgcgggtgggcaccctcatcatgtgcctgcatgatgtgtctgacttcctgctggaggccgccaagctggccaactatgccaagtaccagaggctgtgtgacaccctgtttgtgatcttctctgctgtgttcatggtgacccggctgggcatctaccccttctggatcctgaacaccaccctgtttgagagctgggagatcatcggcccctatgcctcctggtggctgctgaatggcctgctgctgaccctgcagctgctgcacgtgatctggagctacctgattgcccgcatcgccctgaaggccctgatccggggcaaggtgtccaaggatgacagaagtgatgtggagagcagcagcgaggaggaggatgtgaccacctgcaccaagagcccctgtgacagcagcagcagcaatggagccaacagagtgaatggccacatgggcggcagctactgggccgaggagtag

SEQ ID NO: 32924 - DNA, 588 bp, Artificial Sequence
  Description of Artificial Sequence: Synthetic coding sequence
atggccacagctgcccagggccccctgagcctgctgtggggctggctgtggagcgagcgcttctggctgcctgaaaatgtgtcctgggccgacctggagggccctgcagatggctacggctacccccggggccgccacatcctgtctgtgttccccctggccgccggcatcttctttgtgcggctgctgtttgagcgcttcatcgccaagccctgtgccctgtgcatcggcattgaagattctggcccctaccaggcccagcccaatgccatcctggagaaggtgttcatcagcatcaccaagtacccagacaagaagaggctggagggcctgagcaagcagctggactggaatgtgaggaagatccagtgctggttccgccacagaagaaaccaggacaagccacccaccctgaccaagttctgtgagagcatccacctgggcagcggcaccagtgacagcgctggcatcaccatccacttcagcctcttccaggtgggcttcatcaccatcatctcctggaactggcccagcatcggccccctgtgcttcctgagcctgcagaccctgaaggagaggaccagctag

SEQ ID NO: 32925 - DNA, 1005 bp, Artificial Sequence
  Description of Artificial Sequence: Synthetic coding sequence
atgatgaagccccggcccaagcgcttcatcgccaagccctgtgccctgtgcatcggcattgaagattctggcccctaccaggcccagcccaatgccatcctggagaaggtgttcatcagcatcaccaagtacccagacaagaagaggctggagggcctgagcaagcagctggactggaatgtgaggaagatccagtgctggttccgccacagaagaaaccaggacaagccacccaccctgaccaagttctgtgagagcatgtggaggttcaccttctacctgtgcatcttctgctacggcatccgcttcctgtggagcagcccctggttctgggacatccggcagtgctggcacaactaccccttccagcccctgagcagcggcctgtaccactactacatcatggagctggccttctactggagcctgatgttcagccagttcacagacatcaagaggaaggacttcctgatcatgtttgtgcaccacctggtgaccatcggcctcatctccttctcctacatcaacaacatggtgcgggtgggcaccctcatcatgtgcctgcatgatgtgtctgacttcctgctggaggccgccaagctggccaactatgccaagtaccagaggctgtgtgacaccctgtttgtgatcttctctgctgtgttcatggtgacccggctgggcatctaccccttctggatcctgaacaccaccctgtttgagagctgggagatcatcggcccctatgcctcctggtggctgctgaatggcctgctgctgaccctgcagctgctgcacgtgatctggagctacctgattgcccgcatcgccctgaaggccctgatccggggcaaggtgtccaaggatgacagaagtgatgtggagagcagcagcgaggaggaggatgtgaccacctgcaccaagagcccctgtgacagcagcagcagcaatggagccaacagagtgaatggccacatgggcggcagctactgggccgaggagtag

SEQ ID NO: 32926 - DNA, 588 bp, Artificial Sequence; identical to SEQ ID NO: 32924
  Description of Artificial Sequence: Synthetic coding sequence

SEQ ID NO: 32927 - DNA, 1155 bp, Artificial Sequence
  Description of Artificial Sequence: Synthetic coding sequence
atggccggcatcctggcctggttctggaatgaacgcttctggctgccccacaacgtgacctgggccgacctgaagaacacagaggaggccaccttcccccaggccgaggacctgtacctggccttccccctggccttctgcatcttcatggtgcggctcatctttgaaagatttgtggccaagccctgtgccatcgccctgaacatccaggccaacggcccccagatcgcccccccaaatgccatcctggagaaggtgttcaccgccatcaccaagcacccagatgagaagaggctggagggcctgagcaagcagctggactgggatgtgcgcagcatccagcgctggttccggcagaggaggaaccaggagaagcccagcaccctgacccgcttctgtgagagcatgtggaggttctccttctacctgtatgtgttcacctacggcgtgcgcttcctgaagaagaccccctggctgtggaacaccaggcactgctggtacaactacccctaccagcccctgaccacagacctgcactactactacatcctggagctgtccttctactggagcctgatgttcagccagttcacagacatcaagaggaaggactttggcatcatgttcctgcaccacctggtgtccatcttcctgatcaccttctcctatgtgaacaacatggcccgggtgggcaccctggtgctgtgcctgcatgacagcgcagatgccctgctggaggccgccaagatggccaactatgccaagttccagaagatgtgtgacctgctgtttgtgatgtttgctgtggtgttcatcaccacccggctgggcatcttccccctgtgggtgctgaacaccaccctgtttgagagctgggagatcgtgggcccctaccccagctggtgggtgttcaacctgctgctgctgctggtgcagggcctgaactgcttctggagctacctgattgtgaagatcgcctgcaaggctgtgtcccggggcaaggtgtccaaggatgacagaagtgacatcgagagcagcagtgatgaggaggacagcgagcccccaggcaagaacccccacacagccaccaccaccaacggcaccagcggcaccaacggctacctgctgaccggcagctgcagcatggatgactag

SEQ ID NO: 32928 - DNA, 1179 bp, Artificial Sequence
  Description of Artificial Sequence: Synthetic coding sequence
atggccggcatcctggcctggttctggaatgaacgcttctggctgccccacaacgtgacctgggccgacctgaagaacacagaggaggccaccttcccccaggccgaggacctgtacctggccttccccctggccttctgcatcttcatggtgcggctcatctttgaaagatttgtggccaagccctgtgccatcgccctgaacatccaggccaacggcccccagatcgcccccccaaatgccatcctggagaaggtgttcaccgccatcaccaagcacccagatgagaagaggctggagggcctgagcaagcagctggactgggatgtgcgcagcatccagcgctggttccggcagaggaggaaccaggagaagcccagcaccctgacccgcttctgtgagagcatgtggaggttctccttctacctgtatgtgttcacctacggcgtgcgcttcctgaagaagaccccctggctgtggaacaccaggcactgctggtacaactacccctaccagcccctgaccacagacctgcactactactacatcctggagctgtccttctactggagcctgatgttcagccagttcacagacatcaagaggaaggactttggcatcatgttcctgcaccacctggtgtccatcttcctgatcaccttctcctatgtgaacaacatggcccgggtgggcaccctggtgctgtgcctgcatgacagcgcagatgccctgctggaggccgccaagatggccaactatgccaagttccagaagatgtgtgacctgctgtttgtgatgtttgctgtggtgttcatcaccacccggctgggcatcttccccctgtgggtgctgaacaccaccctgtttgagagctgggagatcgtgggcccctaccccagctggtgggtgttcaacctgctgctgctgctggtgcagggcctgaactgcttctggagctacctgattgtgaagatcgcctgcaaggctgtgtcccggggcaaggccggcaagtggaaccccctgcacgtgtccaaggatgacagaagtgacatcgagagcagcagtgatgaggaggacagcgagcccccaggcaagaacccccacacagccaccaccaccaacggcaccagcggcaccaacggctacctgctgaccggcagctgcagcatggatgactag

SEQ ID NO: 32929 - DNA, 675 bp, Artificial Sequence
  Description of Artificial Sequence: Synthetic coding sequence
atgcaggcccctggccggggccccctgggcctgcggctgatgatgcctggccggcggggggccctgcgggagcccggcggctgcggcagctgcctgggcgtggccctggccctgctgctgctgctgctgcctgcctgctgccctgtgcgggcccagaatgacacagagcccatcgtgctggagggcaagtgcctggtggtgtgtgacagcagccccagcgcagatggagctgtgaccagcagcctgggcatctctgtgcgcagcggcagcgccaaggtggccttcagcgccaccaggagcaccaaccacgagcccagcgagatgagcaacagaaccatgaccatctactttgaccaggtgctggtgaacatcggcaaccactttgacctggccagcagcatctttgtggcccccaggaagggcatctacagcttctccttccacgtggtgaaggtgtacaaccggcagaccatccaggtgtccctgatgcagaatggctaccctgtgatcagcgcctttgctggggaccaggatgtgacccgggaggccgccagcaatggagtgctgctgctgatggagcgggaggacaaggtgcacctgaagctggagcggggcaacctgatgggcggctggaagtacagcaccttcagcggcttcctggtgttccccctgtag

SEQ ID NO: 32930 - DNA, 1788 bp, Artificial Sequence
  Description of Artificial Sequence: Synthetic coding sequence
atgagagctgcccgggccgcccccctgctgcagctgctgctgctgctgggcccctggctggaggccgccggcgtggccgagagccccctgcctgctgtggtgctggccatcctggccagaaatgctgagcacagcctgccccactacctgggcgccctggagcggctggactacccccgggccaggatggccctgtggtgtgccacagaccacaacgtggacaacaccacagagatgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgcggctgctgatgggccagggcctgcctgtggtggcccccatgctggacagccagacctactacagcaacttctggtgtggcatcaccccccagggctactacagaagaacagctgagtacttccccaccaagaaccggcagaggcggggctgcttccgggtgcccatggtgcacagcaccttcctggccagcctgcgggcagagggcgctgaccagctggccttctacccaccccaccccaactacacctggccctttgatgacatcatcgtgtttgcctatgcctgccaggccgccggcgtgtctgtgcacgtgtgcaatgagcacagatatggctacatgaatgtgcctgtgaagagccaccagggcctggaggatgagcgggtgaacttcatccacctgatcctggaggccctggtggatggccccaggatgcaggccagcgcccacgtgacccggcccagcaagaggcccagcaagattggatttgatgaggtgtttgtgatcagcctggcccggcggccagacagaagagagaggatgctggccagcctgtgggagatggagatcagcggccgggtggtggatgctgtggatggctggatgctgaacagcagcgccatccggaacctgggcgtggacctgctgcccggctaccaggacccctacagcggccgcaccctgaccaagggggaggtgggctgcttcctgagccactacagcatctgggaggaggtggtggcccggggcctggcccgggtgctggtgtttgaagatgatgtgcgctttgagagcaacttccggggccgcctggagcggctgatggaggatgtggaggccgagaagctgtcctgggacctgatctacctgggcaggaagcaggtgaaccctgagaaggagacagctgtggagggcctgcccggcctggtggtggccggctacagctactggaccctggcctatgccctgcggctggccggggccaggaagctgctggccagccagcccctgcggaggatgctgcctgtggatgagttcctgcccatcatgtttgaccagcaccccaatgagcagtacaaggcccacttctggccccgggacctggtggccttcagcgcccagcccctgctggccgcccccacccactatgctggagatgctgagtggctgagtgacacagagaccagcagcccctgggatgatgattctggccgcctcatctcctggagcggcagccagaagaccctgcggagcccccggctggacctgaccggcagcagcggccacagcctgcagccccagcccagagatgagctgtag

SEQ ID NO: 32931 - DNA, 1554 bp, Artificial Sequence
  Description of Artificial Sequence: Synthetic coding sequence
atgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgcggctgctgatgggccagggcctgcctgtggtggcccccatgctggacagccagacctactacagcaacttctggtgtggcatcaccccccagggctactacagaagaacagctgagtacttccccaccaagaaccggcagaggcggggctgcttccgggtgcccatggtgcacagcaccttcctggccagcctgcgggcagagggcgctgaccagctggccttctacccaccccaccccaactacacctggccctttgatgacatcatcgtgtttgcctatgcctgccaggccgccggcgtgtctgtgcacgtgtgcaatgagcacagatatggctacatgaatgtgcctgtgaagagccaccagggcctggaggatgagcgggtgaacttcatccacctgatcctggaggccctggtggatggccccaggatgcaggccagcgcccacgtgacccggcccagcaagaggcccagcaagattggatttgatgaggtgtttgtgatcagcctggcccggcggccagacagaagagagaggatgctggccagcctgtgggagatggagatcagcggccgggtggtggatgctgtggatggctggatgctgaacagcagcgccatccggaacctgggcgtggacctgctgcccggctaccaggacccctacagcggccgcaccctgaccaagggggaggtgggctgcttcctgagccactacagcatctgggaggaggtggtggcccggggcctggcccgggtgctggtgtttgaagatgatgtgcgctttgagagcaacttccggggccgcctggagcggctgatggaggatgtggaggccgagaagctgtcctgggacctgatctacctgggcaggaagcaggtgaaccctgagaaggagacagctgtggagggcctgcccggcctggtggtggccggctacagctactggaccctggcctatgccctgcggctggccggggccaggaagctgctggccagccagcccctgcggaggatgctgcctgtggatgagttcctgcccatcatgtttgaccagcaccccaatgagcagtacaaggcccacttctggccccgggacctggtggccttcagcgcccagcccctgctggccgcccccacccactatgctggagatgctgagtggctgagtgacacagagaccagcagcccctgggatgatgattctggccgcctcatctcctggagcggcagccagaagaccctgcggagcccccggctggacctgaccggcagcagcggccacagcctgcagccccagcccagagatgagctgtag

SEQ ID NO: 32932 - DNA, 240 bp, Artificial Sequence
  Description of Artificial Sequence: Synthetic coding sequence
atgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgaggtag

SEQ ID NO: 32933 - DNA, 1647 bp, Artificial Sequence
  Description of Artificial Sequence: Synthetic coding sequence
atgagagctgcccgggccgcccccctgctgcagctgctgctgctgctgggcccctggctggaggccgccggcgtggccgagagccccctgcctgctgtggtgctggccatcctggccagaaatgctgagcacagcctgccccactacctgggcgccctggagcggctggactacccccatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgcggctgctgatgggccagggcctgcctgtggtggcccccatgctggacagccagacctactacagcaacttctggtgtggcatcaccccccagggctactacagaagaacagctgagtacttccccaccaagaaccggcagaggcggggctgcttccgggtgcccatggtgcacagcaccttcctggccagcctgcgggcagagggcgctgaccagctggccttctacccaccccaccccaactacacctggccctttgatgacatcatcgtgtttgcctatgcctgccaggccgccggcgtgtctgtgcacgtgtgcaatgagcacagatatggctacatgaatgtgcctgtgaagagccaccagggcctggaggatgagcgggtgaacttcatccacctgatcctggaggccctggtggatggccccaggatgcaggccagcgcccacgtgacccggcccagcaagaggcccagcaagattggatttgatgaggtgtttgtgatcagcctggcccggcggccagaccggcgggagaggatgctggccagcctgtgggagatggagatcagcggccgggtggtggatgctgtggatggctggatgctgaacagcagcgccatccggaacctgggcgtggacctgctgcccggctaccaggacccctacagcggccgcaccctgaccaagggggaggtgggctgcttcctgagccactacagcatctgggaggaggtggtggcccggggcctggcccgggtgctggtgtttgaagatgatgtgcgctttgagagcaacttccggggccgcctggagcggctgatggaggatgtggaggccgagaagctgtcctgggacctgatctacctgggcaggaagcaggtgaaccctgagaaggagacagctgtggagggcctgcccggcctggtggtggccggctacagctactggaccctggcctatgccctgcggctggccggggccaggaagctgctggccagccagcccctgcggaggatgctgcctgtggatgagttcctgcccatcatgtttgaccagcaccccaatgagcagtacaaggcccacttctggccccgggacctggtggccttcagcgcccagcccctgctggccgcccccacccactatgctggagatgctgagtggctgagtgacacagagaccagcagcccctgggatgatgacagcggccgcctcatctcctggagcggcagccagaagaccctgcggagcccccggctggacctgaccggcagcagcggccacagcctgcagccccagcccagagatgagctgtag

SEQ ID NO: 32934 - DNA, 195 bp, Artificial Sequence
  Description of Artificial Sequence: Synthetic coding sequence
atgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtag

SEQ ID NO: 32935 - DNA, 657 bp, Artificial Sequence
  Description of Artificial Sequence: Synthetic coding sequence
atgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgcggctgctgatgggccagggcctgcctgtggtggcccccatgctggacagccagacctactacagcaacttctggtgtggcatcaccccccagggctactacagaagaacagctgagtacttccccaccaagaaccggcagaggcggggctgcttccgggtgcccatggtgcacagcaccttcctggccagcctgcgggcagagggcgctgaccagctggccttctacccaccccaccccaactacacctggccctttgatgacatcatcgtgtttgcctatgcctgccaggccgccggcgtgtctgtgcacgtgtgcaatgagcacagatatggctacatgaatgtgcctgtgaagagccaccagggcctggaggatgagcgggtgaacttcatccacctgatcctggaggccctgggctag

SEQ ID NO: 32936 - DNA, 330 bp, Artificial Sequence
  Description of Artificial Sequence: Synthetic coding sequence
atgctgcaggagtggctggccgctgtgggagatgattatgctgctgtggtgtggaggcctgagggggagccccgcttctacccagatgaggagggccccaagcactggaccaaggagcggcaccagttcctgatggagctgaagcaggaggccctgacctttgccaggaactggggcgctgactacatcctgtttgctgacacagacaacatcctgaccaacaaccagaccctgcggctgctgatgggccagggcctgcctgtggtggcccccatgctggacagccagacctactacagcaacttctggtgtggcatcaccccccagtag

SEQ ID NO: 32937 - DNA, 348 bp, Artificial Sequence
  Description of Artificial Sequence: Synthetic coding sequence
atggaggtgaaggatgccaacagcgccctgctgagcaactatgagaccctgaagtacatcagcaagaccccctgccgccaccagagccctgagatcgtgcgggagttcctgacagccctgaagagccacaagctgaccaaggccgagaagctgcagctgctgaaccacaggcctgtgacagctgtggagatccagctgatggtggaggagagcgaggagcggctgacagaggagcagatcgaggccctgctgcacacagtgaccagcatcctgcctgctgagcctgaggccgagcagaagaagaacaccaacagcaatgtggccatggatgaggaggaccctgcctag

SEQ ID NO: 32938 - DNA, 447 bp, Artificial Sequence
  Description of Artificial Sequence: Synthetic coding sequence
atggaggtgaaggatgccaacagcgccctgctgagcaactatgaggtgttccagctgctgacagacctgaaggagcagaggaaggagagcggcaagaacaagcacagcagcggccagcagaacctgaacaccatcacctatgagaccctgaagtacatcagcaagaccccctgccgccaccagagccctgagatcgtgcgggagttcctgacagccctgaagagccacaagctgaccaaggccgagaagctgcagctgctgaaccacaggcctgtgacagctgtggagatccagctgatggtggaggagagcgaggagcggctgacagaggagcagatcgaggccctgctgcacacagtgaccagcatcctgcctgctgagcctgaggccgagcagaagaagaacaccaacagcaatgtggccatggatgaagaagatcctgcctag

SEQ ID NO: 32939 - DNA, 216 bp, Artificial Sequence
  Description of Artificial Sequence: Synthetic coding sequence
atggaggtggccgagaagctgcagctgctgaaccacaggcctgtgacagctgtggagatccagctgatggtggaggagagcgaggagcggctgacagaggagcagatcgaggccctgctgcacacagtgaccagcatcctgcctgctgagcctgaggccgagcagaagaagaacaccaacagcaatgtggccatggatgaggaggaccctgcctag

SEQ ID NO: 32940 - DNA, 348 bp, Artificial Sequence
  Description of Artificial Sequence: Synthetic coding sequence
atggagatgaaggatgccaacagcgccctgctgagcaactatgagaccctgaagtacatcagcaagaccccctgccgccaccagagccctgagatcgtgcgggagttcctgacagccctgaagagccacaagctgaccaaggccgagaagctgcagctgctgaaccacaggcctgtgacagctgtggagatccagctgatggtggaggagagcgaggagcggctgacagaggagcagatcgaggccctgctgcacacagtgaccagcatcctgcctgctgagcctgaggccgagcagaagaagaacaccaacagcaatgtggccatggatgaggaggaccctgcctag

SEQ ID NO: 32941 - DNA, 426 bp, Artificial Sequence
  Description of Artificial Sequence: Synthetic coding sequence
atgcagagaggagaccccggggagcacctgggcgcccgctcctggcacctgggcgctgtgggcggcggcggggacagctgtgaggtgaaggatgccaacagcgccctgctgagcaactatgagaccctgaagtacatcagcaagaccccctgccgccaccagagccctgagatcgtgcgggagttcctgacagccctgaagagccacaagctgaccaaggccgagaagctgcagctgctgaaccacaggcctgtgacagctgtggagatccagctgatggtggaggagagcgaggagcggctgacagaggagcagatcgaggccctgctgcacacagtgaccagcatcctgcctgctgagcctgaggccgagcagaagaagaacaccaacagcaatgtggccatggatgaggaggaccctgcctag

SEQ ID NO: 32942 - DNA, 702 bp, Artificial Sequence
  Description of Artificial Sequence: Synthetic coding sequence
atgagcaagctgggcaagttcttcaagggcggcggcagcagcaagagccgggccgcccccagcccccaggaggccctggtgcggctgcgggagacagaggagatgctgggcaagaagcaggagtacctggagaaccgcatccagcgggagatcgccctggccaagaagcacggcacccagaacaagagagctgccctgcaggccctgaagaggaagaagagatttgagaagcagctgacccagattgatggcaccctgagcaccatcgagttccagcgggaggccctggagaacagccacaccaacacagaggtgctgaggaacatgggctttgctgccaaggccatgaagtctgtgcatgagaacatggacctgaacaagattgatgacctgatgcaggagatcacagagcagcaggacatcgcccaggagatcagcgaggccttcagccagagggtgggctttggagatgactttgatgaagatgagctgatggccgagctggaggagctggagcaggaggagctgaacaagaagatgaccaacatccggctgcccaacgtgcccagcagcagcctgcctgcccagcccaacaggaagccaggcatgagcagcacagcccggcgcagccgggccgccagcagccagagagctgaggaggaggatgatgacatcaagcagctggccgcctgggccacctag

SEQ ID NO: 32943 - DNA, 1293 bp, Artificial Sequence
  Description of Artificial Sequence: Synthetic coding sequence
atgctgtgcagcctgctgctgtgtgaatgtctgctgctggtggccggctacgcccatgatgatgactggattgaccccacagacatgctgaactatgatgctgccagcggcaccatgaggaagagccaggccaagtatggcatctctggagagaaggatgtgtccccagacctgagctgtgctgatgagatcagcgagtgctaccacaagctggacagcctgacctacaagattgatgaatgtgagaagaagaagagagaagattatgagagccagagcaaccctgtgttccgccgctacctgaacaagatcctgattgaggccggcaagctgggcctgctggcctttgcccagcaccaggccgaggtggccaagatggagcccctgaacaacgtgtgtgccaagaagatggactggacaggcagcatctgggagtggttccgcagctcctggacctacaaggatgacccctgccagaagtactatgagctgctgctggtgaaccccatctggctggtgccccccaccaaggccctggccgtgaccttcaccacctttgtgacagagcccctgaagcacatcggcaagggcaccggggagttcatcaaggccctgatgaaggagatcccagccctgctgcacctgcctgtgctgatcatcatggccctggccatcctgtccttctgctacggggccggcaagtctgtgcacgtgctgcggcacatcggcggccctgagagcgagcccccccaggccctgcggccccgggacagaagacggcaggaggagattgactacagaccagatggaggagctggagatgctgacttccactaccggggccagatgggccccacagagcagggcccctatgccaagacctatgagggccggcgggagatcctgcgggagagagatgtggacctgcgcttccagacaggcaacaagagccctgaggtgctgcgggcctttgatgtgcctgatgctgaggcccgggagcaccccaccgtggtgcccagccacaagagccctgtgctggacaccaagcccaaggagactggaggcatcctgggggagggcacccccaaggagagcagcacagagagcagccagagcgccaagcctgtgtctggccaggacaccagcggcaacacagagggcagccctgctgctgagaaggcccagctgaagtctgaggccgccggcagcccagaccagggcagcacctacagccctgcccggggcgtggccggcccccggggccaggaccctgtgagcagcccctgtggctag

SEQ ID NO: 32944 - DNA, 1101 bp, Artificial Sequence
  Description of Artificial Sequence: Synthetic coding sequence
atgctgtgcagcctgctgctgtgtgaatgtctgctgctggtggccggctacgcccatgatgatgactggattgaccccacagacatgctgaactatgatgctgccagcggcaccatgaggaagagccaggccaagtatggcatctctggagagaaggatgtgtccccagacctgagctgtgctgatgagatcagcgagtgctaccacaagctggacagcctgacctacaagattgatgaatgtgagaagaagaagagagaagattatgagagccagagcaaccctgtgttccgccgctacctgaacaagatcctgattgaggccggcaagctgggcctggccctggccgtgaccttcaccacctttgtgacagagcccctgaagcacatcggcaagggcaccggggagttcatcaaggccctgatgaaggagatcccagccctgctgcacctgcctgtgctgatcatcatggccctggccatcctgtccttctgctacggggccggcaagtctgtgcacgtgctgcggcacatcggcggccctgagagcgagcccccccaggccctgcggccccgggacagaagacggcaggaggagattgactacagaccagatggaggagctggagatgctgacttccactaccggggccagatgggccccacagagcagggcccctatgccaagacctatgagggccggcgggagatcctgcgggagagagatgtggacctgcgcttccagacaggcaacaagagccctgaggtgctgcgggcctttgatgtgcctgatgctgaggcccgggagcaccccaccgtggtgcccagccacaagagccctgtgctggacaccaagcccaaggagactggaggcatcctgggggagggcacccccaaggagagcagcacagagagcagccagagcgccaagcctgtgtctggccaggacaccagcggcaacacagagggcagccctgctgctgagaaggcccagctgaagtctgaggccgccggcagcccagaccagggcagcacctacagccctgcccggggcgtggccggcccccggggccaggaccctgtgagcagcccctgtggctag

SEQ ID NO: 32945 - DNA, 1656 bp, Artificial Sequence
  Description of Artificial Sequence: Synthetic coding sequence
atgctgtgcagcctgctgctgtgtgaatgtctgctgctggtggccggctacgcccatgatgatgactggattgaccccacagacatgctgaactatgatgctgccagcggcaccatgaggaagagccaggccaagtatggcatctctggagagaaggatgtgtccccagacctgagctgtgctgatgagatcagcgagtgctaccacaagctggacagcctgacctacaagattgatgaatgtgagaagaagaagagagaagattatgagagccagagcaaccctgtgttccgccgctacctgaacaagatcctgattgaggccggcaagctgggcctgcctgatgagaacaagggggacatgcactatgatgctgagatcatcctgaagcgggagaccctgctggagatccagaagttcctgaatggagaggactggaagccaggggccctggatgatgccctgagtgacatcctgatcaacttcaagttccatgactttgagacctggaagtggaggtttgaagattcttttggagtggacccctacaacgtgctgatggtgctgctgtgcctgctgtgcatcgtggtgctggtggccacagagctgtggacctacgtgcgctggtacacccagctgcggcgggtgctgatcatctccttcctgttcagcctgggctggaactggatgtacctgtacaagctggcctttgcccagcaccaggccgaggtggccaagatggagcccctgaacaacgtgtgtgccaagaagatggactggacaggcagcatctgggagtggttccgcagctcctggacctacaaggatgacccctgccagaagtactatgagctgctgctggtgaaccccatctggctggtgccccccaccaaggccctggccgtgaccttcaccacctttgtgacagagcccctgaagcacatcggcaaaggaactggagagttcatcaaggccctgatgaaggagatcccagccctgctgcacctgcctgtgctgatcatcatggccctggccatcctgtccttctgctatggagctgggaagtctgtgcacgtgctgcggcacatcggcggccctgagagcgagcccccccaggccctgcggccccgggacagaagacggcaggaggagattgactacagaccagatggaggagctggagatgctgacttccactaccggggccagatgggccccacagagcagggcccctatgccaagacctatgagggcagaagagagatcctgcgggagagagatgtggacctgcgcttccagacaggcaacaagagccctgaggtgctgcgggcctttgatgtgcctgatgctgaggcccgggagcaccccaccgtggtgcccagccacaagagccctgtgctggacaccaagcccaaggagaccggcggcatcctgggggagggcacccccaaggagagcagcacagagagcagccagagcgccaagcctgtgtctggccaggacaccagcggcaacacagagggcagccctgctgctgagaaggcccagctgaagtctgaggccgccggcagcccagaccagggcagcacctacagccctgcccggggcgtggccggcccccggggccaggaccctgtgagcagcccctgtggctag

SEQ ID NO: 32946 - DNA, 1101 bp, Artificial Sequence; identical to SEQ ID NO: 32944
  Description of Artificial Sequence: Synthetic coding sequence

SEQ ID NO: 32947 - DNA, 1293 bp, Artificial Sequence; identical to SEQ ID NO: 32943
  Description of Artificial Sequence: Synthetic coding sequence

SEQ ID NO: 32948 - DNA, 1506 bp, Artificial Sequence
  Description of Artificial Sequence: Synthetic coding sequence
atgctgtgcagcctgctgctgtgtgaatgtctgctgctggtggccggctacgcccatgatgatgactggattgaccccacagacatgctgaactatgatgctgccagcggcaccatgaggaagagccaggccaagtatggcatctctggagagaaggatgtgtccccagacctgagctgtgctgatgagatcagcgagtgctaccacaagctggacagcctgacctacaagattgatgaatgtgagaagaagaagagagaagattatgagagccagagcaaccctgtgttccgccgctacctgaacaagatcctgattgaggccggcaagctgggcctcttccatgactttgagacctggaagtggaggtttgaagattcttttggagtggacccctacaacgtgctgatggtgctgctgtgcctgctgtgcatcgtggtgctggtggccacagagctgtggacctacgtgcgctggtacacccagctgcggcgggtgctgatcatctccttcctgttcagcctgggctggaactggatgtacctgtacaagctggcctttgcccagcaccaggccgaggtggccaagatggagcccctgaacaacgtgtgtgccaagaagatggactggacaggcagcatctgggagtggttccgcagctcctggacctacaaggatgacccctgccagaagtactatgagctgctgctggtgaaccccatctggctggtgccccccaccaaggccctggccgtgaccttcaccacctttgtgacagagcccctgaagcacatcggcaaaggaactggagagttcatcaaggccctgatgaaggagatcccagccctgctgcacctgcctgtgctgatcatcatggccctggccatcctgtccttctgctatggagctgggaagtctgtgcacgtgctgcggcacatcggcggccctgagagcgagcccccccaggccctgcggccccgggacagaagacggcaggaggagattgactacagaccagatggaggagctggagatgctgacttccactaccggggccagatgggccccacagagcagggcccctatgccaagacctatgagggcagaagagagatcctgcgggagagagatgtggacctgcgcttccagacaggcaacaagagccctgaggtgctgcgggcctttgatgtgcctgatgctgaggcccgggagcaccccaccgtggtgcccagccacaagagccctgtgctggacaccaagcccaaggagaccggcggcatcctgggggagggcacccccaaggagagcagcacagagagcagccagagcgccaagcctgtgtctggccaggacaccagcggcaacacagagggcagccctgctgctgagaaggcccagctgaagtctgaggccgccggcagcccagaccagggcagcacctacagccctgcccggggcgtggccggcccccggggccaggaccctgtgagcagcccctgtggctag

SEQ ID NO: 32949 - DNA, 1656 bp, Artificial Sequence; identical to SEQ ID NO: 32945
  Description of Artificial Sequence: Synthetic coding sequence

SEQ ID NO: 32950 - DNA, 789 bp, Artificial Sequence
  Description of Artificial Sequence: Synthetic coding sequence
atgctgtgcagcctgctgctgtgtgaatgtctgctgctggtggccggctacgcccatgatgatgactggattgaccccacagacatgctgaactatgatgctgccagcggcaccatgaggaagagccaggccaagtatggcatctctggagagaaggatgtgtccccagacctgagctgtgctgatgagatcagcgagtgctaccacaagctggacagcctgacctacaagattgatgaatgtgagaagaagaagagagaagattatgagagccagagcaaccctgtgttccgccgctacctgaacaagatcctgattgaggccggcaagctgggcctgcctgatgagaacaagggggacatgcactatgatgctgagatcatcctgaagcgggagaccctgctggagatccagaagttcctgaatggagaggactggaagccaggggccctggatgatgccctgagtgacatcctgatcaacttcaagttccatgactttgagacctggaagtggaggtttgaagattcttttggagtggacccctacaacgtgctgatggtgctgctgtgcctgctgtgcatcgtggtgctggtggccacagagctgtggacctacgtgcgctggtacacccagctgcggcgggtgctgatcatcagctgtgcccagagcgaggccagccgggtgaagcaggtgggcaacctcttccaggcctgggcctttgctgtgtgtgaccctgtgctgctgcaggtgcctgtgtgccccatcctggtgttctgctacagctag

SEQ ID NO: 32951 - DNA, 1506 bp, Artificial Sequence; identical to SEQ ID NO: 32948
  Description of Artificial Sequence: Synthetic coding sequence

SEQ ID NO: 32952 - DNA, 726 bp, Artificial Sequence
  Description of Artificial Sequence: Synthetic coding sequence
atggccgaggagcagccccaggtggagctgtttgtgaaggccggcagtgatggagccaagattggcaactgccccttcagccagaggctcttcatggtgctgtggctgaagggcgtgaccttcaacgtgaccaccgtggacaccaagagaagaacagagaccgtgcagaagctgtgccctgggggccagctgcccttcctgctgtatggaacagaggtgcacacagacaccaacaagattgaggagttcctggaggccgtgctgtgccccccacgctaccccaagctggccgccctgaaccctgagagcaacacagctggcctggacatctttgccaagttcagcgcctacatcaagaacagcaacccagccctgaatgacaacctggagaagggcctgctgaaggccctgaaggtgctggacaactacctgaccagccccctgcctgaggaggtggatgagaccagcgcagaagatgaaggagtgtcccagaggaagttcctggatggaaatgagctgaccctggccgactgcaacctgctgcccaagctgcacatcgtgcaggtggtgtgcaagaagtaccggggcttcaccatccctgaggccttccggggcgtgcaccgctacctgagcaatgcctatgcccgggaggagtttgccagcacctgcccagatgatgaggagattgagctggcctatgagcaggtggccaaggccctgaagtag

SEQ ID NO: 32953 - DNA, 726 bp, Artificial Sequence; identical to SEQ ID NO: 32952
  Description of Artificial Sequence: Synthetic coding sequence

SEQ ID NO: 32954 - DNA, 726 bp, Artificial Sequence; identical to SEQ ID NO: 32952
  Description of Artificial Sequence: Synthetic coding sequence

SEQ ID NO: 32955 - DNA, 726 bp, Artificial Sequence; identical to SEQ ID NO: 32952
  Description of Artificial Sequence: Synthetic coding sequence

SEQ ID NO: 32956 - DNA, 726 bp, Artificial Sequence; identical to SEQ ID NO: 32952
  Description of Artificial Sequence: Synthetic coding sequence

SEQ ID NO: 32957 - DNA, 726 bp, Artificial Sequence; identical to SEQ ID NO: 32952
  Description of Artificial Sequence: Synthetic coding sequence

SEQ ID NO: 32958 - DNA, 726 bp, Artificial Sequence; identical to SEQ ID NO: 32952
  Description of Artificial Sequence: Synthetic coding sequence

SEQ ID NO: 32959 - DNA, 726 bp, Artificial Sequence; identical to SEQ ID NO: 32952
  Description of Artificial Sequence: Synthetic coding sequence

SEQ ID NO: 32960 - DNA, 726 bp, Artificial Sequence; identical to SEQ ID NO: 32952
  Description of Artificial Sequence: Synthetic coding sequence

SEQ ID NO: 32961 - DNA, 726 bp, Artificial Sequence; identical to SEQ ID NO: 32952
  Description of Artificial Sequence: Synthetic coding sequence

SEQ ID NO: 32962 - DNA, 726 bp, Artificial Sequence; identical to SEQ ID NO: 32952
  Description of Artificial Sequence: Synthetic coding sequence

SEQ ID NO: 32963 - DNA, 726 bp, Artificial Sequence; identical to SEQ ID NO: 32952
  Description of Artificial Sequence: Synthetic coding sequence

SEQ ID NO: 32964 - DNA, 726 bp, Artificial Sequence; identical to SEQ ID NO: 32952
  Description of Artificial Sequence: Synthetic coding sequence

SEQ ID NO: 32965 - DNA, 726 bp, Artificial Sequence; identical to SEQ ID NO: 32952
  Description of Artificial Sequence: Synthetic coding sequence

SEQ ID NO: 32966 - DNA, 726 bp, Artificial Sequence; identical to SEQ ID NO: 32952
  Description of Artificial Sequence: Synthetic coding sequence

SEQ ID NO: 32967 - DNA, 726 bp, Artificial Sequence; identical to SEQ ID NO: 32952
  Description of Artificial Sequence: Synthetic coding sequence

SEQ ID NO: 32968 - DNA, 726 bp, Artificial Sequence; identical to SEQ ID NO: 32952
  Description of Artificial Sequence: Synthetic coding sequence

SEQ ID NO: 32969 - DNA, 726 bp, Artificial Sequence; identical to SEQ ID NO: 32952
  Description of Artificial Sequence: Synthetic coding sequence

SEQ ID NO: 32970 - DNA, 726 bp, Artificial Sequence; identical to SEQ ID NO: 32952
  Description of Artificial Sequence: Synthetic coding sequence

SEQ ID NO: 32971 - DNA, 726 bp, Artificial Sequence; identical to SEQ ID NO: 32952
  Description of Artificial Sequence: Synthetic coding sequence

SEQ ID NO: 32972 - DNA, 726 bp, Artificial Sequence; identical to SEQ ID NO: 32952
  Description of Artificial Sequence: Synthetic coding sequence

SEQ ID NO: 32973 - DNA, 726 bp, Artificial Sequence; identical to SEQ ID NO: 32952
  Description of Artificial Sequence: Synthetic coding sequence

SEQ ID NO: 32974 - DNA, 726 bp, Artificial Sequence; identical to SEQ ID NO: 32952
  Description of Artificial Sequence: Synthetic coding sequence

SEQ ID NO: 32975 - DNA, 726 bp, Artificial Sequence; identical to SEQ ID NO: 32952
  Description of Artificial Sequence: Synthetic coding sequence

SEQ ID NO: 32976 - DNA, 726 bp, Artificial Sequence; identical to SEQ ID NO: 32952
  Description of Artificial Sequence: Synthetic coding sequence

SEQ ID NO: 32977 - DNA, 726 bp, Artificial Sequence; identical to SEQ ID NO: 32952
  Description of Artificial Sequence: Synthetic coding sequence

SEQ ID NO: 32978 - DNA, 726 bp, Artificial Sequence; identical to SEQ ID NO: 32952
  Description of Artificial Sequence: Synthetic coding sequence

SEQ ID NO: 32979 - DNA, 744 bp, Artificial Sequence
  Description of Artificial Sequence: Synthetic coding sequence
atgagcggcctgcggcccggcacccaggtggaccctgagattgagctgtttgtgaaggccggcagtgatggagagagcatcggcaactgccccttctgccagaggctcttcatgatcctgtggctgaagggcgtgaagttcaacgtgaccaccgtggacatgaccaggaagccagaggagctgaaggacctggcccctggcaccaacccccccttcctggtgtacaacaaggagctgaagacagacttcatcaagattgaggagttcctggagcagaccctggccccaccccgctacccccacctgagccccaagtacaaggagagctttgatgtgggctgcaacctgtttgccaagttcagcgcctacatcaagaacacccagaaggaggccaacaagaactttgagaagagcctgctgaaggagttcaagaggctggatgactacctgaacacccccctgctggatgaaattgatcctgacagcgctgaggagccccctgtgtcccggcggctcttcctggatggagaccagctgaccctggccgactgcagcctgctgcccaagctgaacatcatcaaggtggccgccaagaagtacagagactttgacatcccagctgagttcagcggcgtgtggagatacctgcacaatgcctatgcccgggaggagttcacccacacctgcccagaggacaaggagattgagaacacctacgccaacgtggccaagcagaagagctag

SEQ ID NO: 32980 - DNA, 762 bp, Artificial Sequence
  Description of Artificial Sequence: Synthetic coding sequence
atggccctgtccatgcccctgaatggcctgaaggaggaggacaaggagcccctgattgagctgtttgtgaaggccggcagtgatggagagagcatcggcaactgccccttcagccagaggctcttcatgatcctgtggctgaagggcgtggtgttttctgtgaccaccgtggacctgaagaggaagccagctgacctgcagaacctggcccctggcacccacccccccttcatcaccttcaacagcgaggtgaagacagatgtgaacaagattgaggagttcctggaggaggtgctgtgcccccccaagtacctgaagctgagccccaagcaccctgagagcaacacagctggcatggacatctttgccaagttcagcgcctacatcaagaacagcaggcctgaggccaatgaggccctggagcggggcctgctgaagaccctgcagaagctggatgagtacctgaacagccccctgcctgatgaaattgatgaaaattccatggaggacatcaagttcagcaccaggaagttcctggatggaaatgagatgaccctggccgactgcaacctgctgcccaagctgcacatcgtgaaggtggtggccaagaagtacagaaactttgacatccccaaggagatgacaggcatctggagatacctgaccaatgcctacagcagagatgagttcaccaacacctgccccagcgacaaggaggtggagatcgcctacagtgatgtggccaagaggctgaccaagtag

SEQ ID NO: 32981 - DNA, 624 bp, Artificial Sequence
  Description of Artificial Sequence: Synthetic coding sequence
atggccctgtccatgcccctgaatggcctgaaggaggaggacaaggagcccctgattgagctgtttgtgaaggccggcagtgatggagagagcatcggcaactgccccttcagccagaggctcttcatgatcctgtggctgaagggcgtggtgttttctgtgaccaccgtggacctgaagaggaagccagctgacctgcagaacctggcccctggcacccacccccccttcatcaccttcaacagcgaggtgaagacagatgtgaacaagattgaggagttcctggaggaggtgctgtgcccccccaagtacctgaagctgagccccaagcaccctgagagcaacacagctggcatggacatctttgccaagttcagcgcctacatcaagaacagcaggcctgaggccaatgaggccctggagcggggcctgctgaagaccctgcagaagctggatgagtacctgaacagccccctgcctgatgaaattgatgaaaattccatggaggacatcaagttcagcaccaggaagttcctggatggaaatgagatgaccctggccgactgcaacctgctgcccaagctgcacatcgtgaaggtggtggccaagatcagccagctgtag

SEQ ID NO: 32982 - DNA, 762 bp, Artificial Sequence; identical to SEQ ID NO: 32980
  Description of Artificial Sequence: Synthetic coding sequence

SEQ ID NO: 32983 - DNA, 2061 bp, Artificial Sequence
  Description of Artificial Sequence: Synthetic coding sequence
atggccgaggccgctgagcctgagggcgtggcccctggcccccagggccccccagaggtgcctgcccccctggccgagaggcctggagagcctggagctgctggaggagaggccgagggccctgagggcagcgagggcgctgaggaggcccccagaggagctgctgctgtgaaggaggccggcggcggcggccctgaccggggccctgaggccgaggcccggggcaccaggggggcccacggggagacagaagctgaggagggcgcccctgagggcgctgaggtgccccagggcggggaggagaccagcggggcccagcaggtggagggcgccagccctggccgcggggcccagggcgagcccagaggagaggcccagcgggagcctgaggacagcgctgcccctgagcggcaggaggaggccgagcagaggcctgaggtgcctgagggcagcgccagcggggaggccggggacagcgtggatgctgagggccccctgggggacaacatcgaggccgagggccctgctggggacagcgtggaggccgagggccgggtgggggacagcgtggatgctgagggccctgctggggacagcgtggatgctgagggccccctgggggacaacatccaggccgagggccctgctggggacagcgtggatgctgagggccgggtgggggacagcgtggatgctgagggccctgctggggacagcgtggatgctgagggccgggtgggggacagcgtggaggccggggaccctgctggagatggagtggaggccggcgtgcctgctggggacagcgtggaggccgagggccctgctggggacagcatggatgctgagggccctgctggccgggcccggcgggtgtctggagagccccagcagagcggagatggcagcctgagcccccaggccgaggccatcgaggtggccgccggggagagcgctggccgcagccctggagagctggcctgggatgctgctgaggaggccgaggtgcctggggtgaagggcagcgaggaggccgcccctggagatgcccgggcagatgctggggaggacagagtgggagatggcccccagcaggagcctggagaagatgaggagcggcgggagaggagccctgagggcccccgggaggaggaggccgccggcggggaggaggagagcccagacagcagcccccatggagaggccagcagaggagctgctgagcctgaggcccagctgagcaaccacctggccgaggagggccctgctgagggcagcggggaggccgcccgggtgaatggaagaagagaagatggagaggccagcgagccccgggccctgggccaggagcatgacatcaccctgtttgtgaaggccggctatgatggagagagcatcggcaactgccccttcagccagaggctcttcatgatcctgtggctgaagggcgtcatcttcaacgtgaccaccgtggacctgaagaggaagccagctgacctgcagaacctggcccctggcaccaacccccccttcatgacctttgatggagaggtgaagacagatgtgaacaagattgaggagttcctggaggagaagctggccccaccccgctaccccaagctgggcacccagcaccctgagagcaacagcgctggaaatgatgtgtttgccaagttcagcgccttcatcaagaacaccaagaaggatgccaatgagatccacgagaagaacctgctgaaggccctgaggaagctggacaactacctgaacagccccctgcctgatgaaattgatgcctacagcacagaagatgtgacagtgtctggcaggaagttcctggatggagatgagctgaccctggccgactgcaacctgctgcccaagctgcacatcatcaagatcgtggccaagaagtacagagactttgagttccccagcgagatgacaggcatctggagatacctgaacaatgcctatgccagagatgagttcaccaacacctgcccagctgaccaggagattgagcacgcctacagtgatgtggccaagaggatgaagtag

SEQ ID NO: 32984 - DNA, 2115 bp, Artificial Sequence
  Description of Artificial Sequence: Synthetic coding sequence
atggccgaggccgctgagcctgagggcgtggcccctggcccccagggccccccagaggtgcctgcccccctggccgagaggcctggagagcctggagctgctggaggagaggccgagggccctgagggcagcgagggcgctgaggaggcccccagaggagctgctgctgtgaaggaggccggcggcggcggccctgaccggggccctgaggccgaggcccggggcaccaggggggcccacggggagacagaagctgaggagggcgcccctgagggcgctgaggtgccccagggcggggaggagaccagcggggcccagcaggtggagggcgccagccctggccgcggggcccagggcgagcccagaggagaggcccagcgggagcctgaggacagcgctgcccctgagcggcaggaggaggccgagcagaggcctgaggtgcctgagggcagcgccagcggggaggccggggacagcgtggatgctgagggccccctgggggacaacatcgaggccgagggccctgctggggacagcgtggaggccgagggccgggtgggggacagcgtggatgctgagggccctgctggggacagcgtggatgctgagggccccctgggggacaacatccaggccgagggccctgctggggacagcgtggatgctgagggccgggtgggggacagcgtggatgctgagggccctgctggggacagcgtggatgctgagggccgggtgggggacagcgtggaggccggggaccctgctggagatggagtggaggccggcgtgcctgctggggacagcgtggaggccgagggccctgctggggacagcatggatgctgagggccctgctggccgggcccggcgggtgtctggagagccccagcagagcggagatggcagcctgagcccccaggccgaggccatcgaggtggccgccggggagagcgctggccgcagccctggagagctggcctgggatgctgctgaggaggccgaggtgcctggggtgaagggcagcgaggaggccgcccctggagatgcccgggcagatgctggggaggacagagtgggagatggcccccagcaggagcctggagaagatgaggagcggcgggagaggagccctgagggcccccgggaggaggaggccgccggcggggaggaggagagcccagacagcagcccccatggagaggccagcagaggagctgctgagcctgaggcccagctgagcaaccacctggccgaggagggccctgctgagggcagcggggaggccgcccgggtgaatggaagaagagaagatggagaggccagcgagccccgggccctgggccaggagcatgacatcaccctgtttgtgaaggtgaagctgacagccctgggctgcagcagaattgccatcaagaagtacctgcgggccggctatgatggagagagcatcggcaactgccccttcagccagaggctcttcatgatcctgtggctgaagggcgtcatcttcaacgtgaccaccgtggacctgaagaggaagccagctgacctgcagaacctggcccctggcaccaacccccccttcatgacctttgatggagaggtgaagacagatgtgaacaagattgaggagttcctggaggagaagctggccccaccccgctaccccaagctgggcacccagcaccctgagagcaacagcgctggaaatgatgtgtttgccaagttcagcgccttcatcaagaacaccaagaaggatgccaatgagatccacgagaagaacctgctgaaggccctgaggaagctggacaactacctgaacagccccctgcctgatgaaattgatgcctacagcacagaagatgtgacagtgtctggcaggaagttcctggatggagatgagctgaccctggccgactgcaacctgctgcccaagctgcacatcatcaagatcgtggccaagaagtacagagactttgagttccccagcgagatgacaggcatctggagatacctgaacaatgcctatgccagagatgagttcaccaacacctgcccagctgaccaggagattgagcacgcctacagtgatgtggccaagaggatgaagtag

SEQ ID NO: 32985 - DNA, 1785 bp, Artificial Sequence
  Description of Artificial Sequence: Synthetic coding sequence
atgtggtgcctgctgcggggcctgggccggcctggggccctggcccggggggccctgggccagcagcagagcctgggcgcccgggccctggccagcgctggcagcgagagcagagatgagtacagctatgtggtggtgggcgccggcagcgctggctgtgtgctggccggccgcctgacagaagatcctgctgagcgggtgctgctgctggaggccggccccaaggatgtgctggccggcagcaagaggctgtcctggaagatccacatgcctgctgccctggtggccaacctgtgtgatgaccgctacaactggtgctaccacacagaggtgcagaggggcctggatggccgggtgctgtactggccccggggccgggtgtggggcggcagcagcagcctgaatgccatggtgtatgtgcggggccacgcagaagattatgagcgctggcagaggcagggcgcccggggctgggactatgcccactgcctgccctacttcaggaaggcccagggccacgagctgggcgccagccgctacagaggagcagatggccccctgcgggtgtcccggggcaagaccaaccaccccctgcactgtgccttcctggaggccacccagcaggccggctaccccctgacagaggacatgaatggcttccagcaggagggcttcggctggatggacatgaccatccacgagggcaagcgctggagcgctgcctgtgcctacctgcacccagccctgagcaggaccaacctgaaggccgaggccgagaccctggtgtcccgggtgctgtttgagggcaccagggctgtgggcgtggagtatgtgaagaatggccagagccaccgggcctatgccagcaaggaggtgatcctgtctggaggagccatcaacagcccccagctgctgatgctgagcggcattggaaatgctgatgacctgaagaagctgggcatccctgtggtgtgccacctgcccggggtgggccagaacctgcaggaccacctggagatctacatccagcaggcctgcacccggcccatcaccctgcacagcgcccagaagcccctgaggaaggtgtgcatcggcctggagtggctgtggaagttcaccggggagggcgccacagcccacctggagactggaggcttcatccgcagccagcccggggtgccccacccagacatccagttccacttcctgcccagccaggtgattgaccacggccgggtgcccacccagcaggaggcctaccaggtgcacgtgggccccatgaggggcacctctgtgggctggctgaagctgcggagcgccaacccccaggaccaccctgtgatccagcccaactacctgagcacagaaacagacatcgaggacttccggctgtgtgtgaagctgacccgggagatctttgcccaggaggccctggcccccttccggggcaaggagctgcagcccggcagccacatccagagcgacaaggagattgatgcctttgtgcgggccaaggctgacagcgcctaccaccccagctgcacctgcaagatgggccagcccagcgaccccacagctgtggtggacccccagaccagggtgctgggcgtggagaacctgcgggtggtggatgccagcatcatgcccagcatggtgtctggcaacctgaatgcccccaccatcatgattgctgagaaggctgctgacatcatcaagggccagcctgccctgtgggacaaggatgtgcctgtgtacaagcccaggaccctggccacccagaggtag

SEQ ID NO: 32986 - DNA, 381 bp, Artificial Sequence
  Description of Artificial Sequence: Synthetic coding sequence
atgtggtgcctgctgcggggcctgggccggcctggggccctggcccggggggccctgggccagcagcagagcctgggcgcccgggccctggccagcgctggcagcgagagcagagatgagtacagctatgtggtggtgggcgccggcagcgctggctgtgtgctggccggccgcctgacagaagatcctgctgagcgggtgctgctgctggaggccggccccaaggatgtgctggccggcagcaagaggctgtcctggaagatccacatgcctgctgccctggtggccaacctgtgtgatgaccgctacaactggtgctaccacacagaggtgcagaggggcctggatggccgggtgctgtactggccccggggccgctag

SEQ ID NO: 32987 - DNA, 468 bp, Artificial Sequence
  Description of Artificial Sequence: Synthetic coding sequence
atgtggtgcctgctgcggggcctgggccggcctggggccctggcccggggggccctgggccagcagcagagcctgggcgcccgggccctggccagcgctggcagcgagagcagagatgagtacagctatgtggtggtgggcgccggcagcgctggctgtgtgctggccggccgcctgacagaagatcctgctgagcgggtgctgctgctggaggccggccccaaggatgtgctggccggcagcaagaggctgtcctggaagatccacatgcctgctgccctggtggccaacctgtgtgatgaccgctacaactggtgctaccacacagaggtgcagaggggcctggatggccgggtgctgtactggccccggggccgggtgtggggcggcagcagcagcctgaatgccatggtgtatgtgcggggccacgcagaagattatgagcgctggcagaggcagggcgcctag

SEQ ID NO: 32988 - DNA, 1023 bp, Artificial Sequence
  Description of Artificial Sequence: Synthetic coding sequence
atgggagagatggagcagctgcggcaggaggccgagcagctgaagaagcagattgctgatgccaggaaggcctgtgctgatgtgaccctggccgagctggtgtctggcctggaggtggtgggccgggtgcagatgaggaccaggaggaccctgcggggccacctggccaagatctatgccatgcactgggccacagacagcaagctgctggtgtctgccagccaggacggcaagctgattgtgtgggacagctacaccaccaacaaggtgcacgccatccccctgcggagctcctgggtgatgacctgtgcctatgcccccagcggcaactttgtggcctgtggcggcctggacaacatgtgcagcatctacaacctgaagagccgggagggcaatgtgaaggtgtcccgggagctgagcgcccacacaggctacctgagctgctgccgcttcctggatgacaacaacatcgtgaccagcagcggggacaccacctgtgccctgtgggacattgaaacaggccagcagaagacagtgtttgtgggccacactggagactgcatgagcctggccgtgtccccagacttcaacctcttcatcagcggggcctgtgatgccagcgccaagctgtgggatgtgcgggagggcacctgccggcagaccttcaccggccatgaaagtgacatcaatgccatctgcttcttccccaatggagaggccatctgcaccggcagtgatgatgccagctgccgcctgtttgacctgcgggctgaccaggagctgatctgcttcagccatgagagcatcatctgtggcatcacctctgtggccttcagcctgagcggccgcctgctgtttgctggctatgatgacttcaactgcaatgtgtgggacagcatgaagtctgagcgggtgggcatcctgagcggccatgacaacagagtgtcctgcctgggcgtgacagcagatggcatggctgtggccaccggctcctgggacagcttcctgaagatctggaactag

SEQ ID NO: 32989 - DNA, 696 bp, Artificial Sequence
  Description of Artificial Sequence: Synthetic coding sequence
atgtttgtgttctactgtgcccactggcagacctacgtgtctggcatgctgcgctttgggaaggtggatgtgacagagatccagatcgccctggtgattgtgtttgtgctgagcgccttcggcggggccaccatgtgggactacaccatccccatcctggagatcaagctgaagatcctgcctgtgctgggcttcctgggcggcgtcatcttcagctgcagcaactacttccacgtgatcctgcacggcggcgtgggcaagaatggcagcaccatcgccggcacctctgtgctgagccctggcctgcacatcggcctcatcatcatcctggccatcatgatctacaagaagagcgccacagatgtgtttgagaagcacccctgcctgtacatcctgatgtttggctgtgtgtttgccaaggtgtcccagaagctggtggtggcccacatgaccaagtctgagctgtacctgcaggacaccgtcttcctgggccctggcctgctcttcctggaccagtacttcaacaacttcattgatgaatatgtggtgctgtggatggccatggtgatcagcagctttgacatggtgatctacttcagcgccctgtgcctgcagatcagccgccacctgcacctgaacatcttcaagacagcctgccaccaggcccctgagcaggtgcacaagcacatcgactag

SEQ ID NO: 32990 - DNA, 1251 bp, Artificial Sequence
  Description of Artificial Sequence: Synthetic coding sequence
atgagcggccacaggagcaccaggaagagatgtggggacagccaccctgagagccctgtgggcttcggccacatgagcaccaccggctgtgtgctgaacaagctgttccagctgcccaccccacccctgagccgccaccagctgaagaggctggaggagcaccgctaccagagcgctggccgcagcctgctggagcccctgatgcagggctactgggagtggctggtgagaagagtgcccagctggatcgcccccaacctgatcaccatcatcggcctgagcatcaacatctgcaccaccatcctgctggtgttctactgccccacagccacagagcaggcccccctgtgggcctacatcgcctgtgcctgtggcctcttcatctaccagagcctggatgccattgatggcaagcaggcccggaggaccaacagcagcagccccctgggggagctgtttgaccacggctgtgacagcctgagcacagtgtttgtggtgctgggcacctgcatcgctgtgcagctgggcaccaacccagactggatgttcttctgctgctttgctggcaccttcatgttctactgtgcccactggcagacctacgtgtctggcaccctgcgcttcggcatcattgatgtgacagaggtgcagatcttcatcatcatcatgcacctgctggccgtgattggaggcccccccttctggcagagcatgatccctgtgctgaacatccagatgaagatcttccctgccctgtgcaccgtggccggcaccatcttcagctgcaccaactacttccgggtcatcttcaccggaggagtgggcaagaatggcagcaccatcgccggcacctctgtgctgagccccttcctgcacatcggcagcgtcatcaccctggccgccatgatctacaagaagtctgctgtgcagctgtttgagaagcacccctgcctgtacatcctgacctttggatttgtgtctgccaagatcaccaacaagctggtggtggcccacatgaccaagtctgagatgcacctgcatgacacagccttcatcggccctgccctgctcttcctggaccagtacttcaacagcttcattgatgagtacatcgtgctgtggatcgccctggtgttctccttctttgacctgatccgctactgtgtgtctgtgtgcaaccagatcgccagccacctgcacatccacgtgttccgcatcaaggtgtccacagcccacagcaaccaccactag

SEQ ID NO: 32991 - DNA, 1251 bp, Artificial Sequence; identical to SEQ ID NO: 32990
  Description of Artificial Sequence: Synthetic coding sequence

SEQ ID NO: 32992 - DNA, 1599 bp, Artificial Sequence
  Description of Artificial Sequence: Synthetic coding sequence
atgatgatggtgagaagaggcctgctggcctggatcagccgggtggtggtgctgctggtgctgctgtgctgtgccatctctgtgctgtacatgctggcctgcacccccaagggagatgaggagcagctggccctgccccgggccaacagccccaccgggaaggagggctaccaggccgtgctgcaggagtgggaggagcagcacagaaattatgtgagcagcctgaagaggcagatcgcccagctgaaggaggagctgcaggagaggtctgagcagctgagaaatggccagtaccaggccagtgatgctgctggcctgggcctggacaggagccccccagagaagacccaggccgacctgctggccttcctgcacagccaggtggacaaggccgaggtgaatgccggcgtgaagctggccacagaatatgctgctgtgccctttgacagcttcaccctgcagaaggtgtaccagctggagaccggcctgaccaggcaccctgaggagaagcctgtgaggaaggacaagagagatgagctggtggaggccatcgagagcgccctggagaccctgaacagccctgctgagaacagccccaaccaccggccctacacagccagtgacttcatcgagggcatctacagaacagagcgggacaagggcaccctgtatgagctgaccttcaagggggaccacaagcatgagttcaagaggctcatcctcttccggcccttcggccccatcatgaaggtgaagaatgagaagctgaacatggccaacaccctcatcaacgtcatcgtgcccctggccaagagggtggacaagttccggcagttcatgcagaacttccgggagatgtgcatcgagcaggacggccgggtgcacctgactgtggtgtactttgggaaggaggagatcaatgaggtgaagggcatcctggagaacaccagcaaggccgccaacttcaggaacttcaccttcatccagctgaatggagagttcagccggggcaagggcctggatgtgggcgcccgcttctggaagggcagcaatgtgctgctcttcttctgtgatgtggacatctacttcaccagcgagttcctgaacacctgccgcctgaacacccagcccgggaagaaggtgttctaccctgtgctcttcagccagtacaaccctggcatcatctacggccaccatgatgctgtgccccccctggagcagcagctggtgatcaagaaggagaccggcttctggagggactttggatttggcatgacctgccagtacagaagtgacttcatcaacatcggcggctttgacctggacatcaagggctggggcggagaagatgtgcacctgtacaggaagtacctgcacagcaacctgattgtggtgaggacccctgtgcggggcctcttccacctgtggcatgagaagcgctgcatggatgagctgaccccagagcagtacaagatgtgcatgcagagcaaggccatgaatgaggccagccacggccagctgggcatgctggtgttcagacatgaaattgaggcccacctgaggaagcagaagcagaagaccagcagcaagaagacctag

SEQ ID NO: 32993 - DNA, 1599 bp, Artificial Sequence; identical to SEQ ID NO: 32992
  Description of Artificial Sequence: Synthetic coding sequence

SEQ ID NO: 32994 - DNA, 1599 bp, Artificial Sequence; identical to SEQ ID NO: 32992
  Description of Artificial Sequence: Synthetic coding sequence

SEQ ID NO: 32995 - DNA, 291 bp, Artificial Sequence
  Description of Artificial Sequence: Synthetic coding sequence
atgatgatggtgagaagaggcctgctggcctggatcagccgggtggtggtgctgctggtgctgctgtgctgtgccatctctgtgctgtacatgctggcctgcacccccaagggagatgaggagcagctggccctgccccgggccaacagccccaccgggaaggagggctaccaggccgtgctgcaggagtgggaggagcagcacagaaattatgtgagcagcctgaagaggcagatcgcccagctgaaggaggagctgcaggagaggtctgagcagctgagaaatggatag

SEQ ID NO: 32996 - DNA, 162 bp, Artificial Sequence
  Description of Artificial Sequence: Synthetic coding sequence
atgatgatggtgagaagaggcctgctggcctggatcagccgggtggtggtgctgctggtgctgctgtgctgtgccatctctgtgctgtacatgctggcctgcacccccaagggagatgaggagcagctggccctgccccgggccaacagccccaccggctag

SEQ ID NO: 32997 - DNA, 1599 bp, Artificial Sequence; identical to SEQ ID NO: 32992
  Description of Artificial Sequence: Synthetic coding sequence

SEQ ID NO: 32998 - DNA, 315 bp, Artificial Sequence
  Description of Artificial Sequence: Synthetic coding sequence
atgatgatggtgagaagaggcctgctggcctggatcagccgggtggtggtgctgctggtgctgctgtgctgtgccatctctgtgctgtacatgctggcctgcacccccaagggagatgaggagcagctggccctgccccgggccaacagccccaccgggaaggagggctaccaggccgtgctgcaggagtgggaggagcagcacagaaattatgtgagcagcctgaagaggcagatcgcccagctgaaggaggagctgcaggagaggtctgagcagctgagaaatggccagtaccaggccagtgatgctgcctag

SEQ ID NO: 32999 - DNA, 45 bp, Artificial Sequence
  Description of Artificial Sequence: Synthetic coding sequence
atgatgatggtgagaagaggcctgctggcctggatcagcaggtag

SEQ ID NO: 33000 - DNA, 1599 bp, Artificial Sequence; identical to SEQ ID NO: 32992
  Description of Artificial Sequence: Synthetic coding sequence

SEQ ID NO: 33001 - DNA, 1002 bp, Artificial Sequence
  Description of Artificial Sequence: Synthetic coding sequence
atgccccggcggggcctcatcctgcacaccaggacccactggctgctgctgggcctggccctgctgtgcagcctggtgctcttcatgtacctgctggagtgtgccccccagacagatggaaatgccagcctgcccggggtggtgggggagaactacggcaaggagtactaccaggccctgctgcaggagcaggaggagcactaccagacccgggccaccagcctgaagaggcagatcgcccagctgaagcaggagctgcaggagatgtctgagaagatgaggagcctgcaggagaggagaaatgtgggcgccaatggaattggctaccagagcaacaaggagcaggcccccagcgacctgctggagttcctgcacagccagattgacaaggccgaggtgtccattggagccaagctgcccagtgaatatggagtcatcccctttgagagcttcaccctgatgaaggtgttccagctggagatgggcctgaccaggcaccctgaggagaagcctgtgaggaaggacaagagagatgagctggtggaggtgattgaggccggcctggaggtgatcaacaacccagatgaagatgatgagcaggaggatgaggagggccccctgggggagaagctgatcttcaatgaaaatgactttgtggagggctactacagaacagagcgggacaagggcacccagtatgagctgttcttcaagaaggctgacctgacagagtacagacatgtgaccctcttccggcccttcggccccctgatgaaggtgaagtctgagatgattgacatcaccaggagcatcatcaacatcatcgtgcccctggccgagaggacagaggcctttgtgcagttcatgcagaacttcagagatgtgtgcatccaccaggacaagaagatccacctgactgtggtgtactttgggaaggagggcctgagcaaggtgaagagcatcctggagagcgtgacccggctggccagcagcacctggtag

SEQ ID NO: 33002 - DNA, 1629 bp, Artificial Sequence
  Description of Artificial Sequence: Synthetic coding sequence
atgccccggcggggcctcatcctgcacaccaggacccactggctgctgctgggcctggccctgctgtgcagcctggtgctcttcatgtacctgctggagtgtgccccccagacagatggaaatgccagcctgcccggggtggtgggggagaactacggcaaggagtactaccaggccctgctgcaggagcaggaggagcactaccagacccgggccaccagcctgaagaggcagatcgcccagctgaagcaggagctgcaggagatgtctgagaagatgaggagcctgcaggagaggagaaatgtgggcgccaatggaattggctaccagagcaacaaggagcaggcccccagcgacctgctggagttcctgcacagccagattgacaaggccgaggtgtccattggagccaagctgcccagtgaatatggagtcatcccctttgagagcttcaccctgatgaaggtgttccagctggagatgggcctgaccaggcaccctgaggagaagcctgtgaggaaggacaagagagatgagctggtggaggtgattgaggccggcctggaggtgatcaacaacccagatgaagatgatgagcaggaggatgaggagggccccctgggggagaagctgatcttcaatgaaaatgactttgtggagggctactacagaacagagcgggacaagggcacccagtatgagctgttcttcaagaaggctgacctgacagagtacagacatgtgaccctcttccggcccttcggccccctgatgaaggtgaagtctgagatgattgacatcaccaggagcatcatcaacatcatcgtgcccctggccgagaggacagaggcctttgtgcagttcatgcagaacttcagagatgtgtgcatccaccaggacaagaagatccacctgactgtggtgtactttgggaaggagggcctgagcaaggtgaagagcatcctggagagcgtgaccagcgagagcaacttccacaactacaccctggtgtccctgaatgaggagttcaacagaggccggggcctgaatgtgggcgcccgggcctgggacaagggggaggtgctgatgttcttctgtgatgtggacatctacttctctgctgagttcctgaacagctgccgcctgaatgctgagcccgggaagaaggtgttctaccctgtggtgttcagcctgtacaacccagccatcgtgtatgccaaccaggaggtgcccccacctgtggagcagcagctggtgcacaagaaggacagcggcttctggagggactttggcttcggcatgacctgccagtacagaagtgacttcctgaccatcggcggctttgacatggaggtgaagggctggggcggggaggatgtgcacctgtacaggaagtacctgcacggggacctgattgtcatccgcacccctgtgcccggcctcttccacctgtggcatgagaagagatgtgctgatgagctgaccccagagcagtacaggatgtgcatccagagcaaggccatgaatgaggccagccacagccacctgggcatgctggtgttccgggaggagattgagacccacctgcacaagcaggcctaccgcaccaacagcgaggccgtgggctag

SEQ ID NO: 33003 - DNA, 1620 bp, Artificial Sequence
  Description of Artificial Sequence: Synthetic coding sequence
atgggccgggccggcggcggcggccctggccggggccccccacccctgctgctcttcctgggcgccgccctggtgctggccagcggggctgtgcctgcccgggaggccggcagcgctgtggaggccgaggagctggtgaagggcagccctgcctgggagcccccagccaatgacacccgggaggaggccggccccccagctgctggggaggatgaggcctcctggacagcccctggaggagagctggccggccctgaggaggtgctgcaggagagcgctgctgtgactggaacagcctggctggaggccgacagccctggcctgggcggcgtgacagctgaggccggcagcggagatgcccaggccctgcctgccaccctgcaggcccctcatgaggtgctgggccagagcatcatgcccccagccatccctgaggccacagaggccagcggcccccccagccccacccctggggacaagctgagccctgccagcgagctgcccaaggagagccccctggaggtgtggctgaacctgggcggcagcaccccagacccccagggccctgagctgacctaccccttccagggcaccctggagccccagcctgccagtgacatcatcgacatcgactactttgagggcctggatggagagggcagaggagctgacctgggcagcttccctggcagccctggcaccagcgagaaccacccagacacagaaggagagacccccagctggagcctgctggacctgtatgatgacttcaccccatttgatgaaagtgacttctaccccaccaccagcttctatgatgacctggatgaggaggaggaggaggaggaggatgacaaggatgctgtgggcggcggggacctggaggatgaaaatgagctgctggtgcccaccgggaagccaggcctgggccctggcaccggccagcccaccagccgctggcatgctgtgcccccccagcacaccctgggctctgtgcccggcagcagcatcgccctgcggcccaggcctggagagcccggccgggacctggccagcagtgaaaatggaacagagtgccgcagcggctttgtgcgccacaacggcagctgccgctctgtgtgtgacctcttccccagctactgccacaatggaggccagtgctacctggtggagaacattggagccttctgccgctgcaacacccaggactacatctggcacaagggcatgagatgtgagagcatcatcacagacttccaggtgatgtgtgtggccgtgggcagcgctgccctggtgctgctgctgctcttcatgatgaccgtcttctttgccaagaagctgtacctgctgaagacagagaacaccaagctgcggaggaccaacaagttccgcaccccatctgagctgcacaatgacaacttcagcctgagcaccatcgccgagggcagccaccccaatgatgaccccagcgccccccacaagatccaggaggtgctgaagagctgcctgaaggaggaggagagcttcaacatccagaacagcatgagccccaagctggagggcggcaaaggagaccaggccgacctggatgtgaactgcctgcagaacaacctgacctag

SEQ ID NO: 33004 - DNA, 1701 bp, Artificial Sequence
  Description of Artificial Sequence: Synthetic coding sequence
atgggccgggccggcggcggcggccctggccggggccccccacccctgctgctcttcctgggcgccgccctggtgctggccagcggggctgtgcctgcccgggaggccggcagcgctgtggaggccgaggagctggtgaagggcagccctgcctgggagcccccagccaatgacacccgggaggaggccggccccccagctgctggggaggatgaggcctcctggacagcccctggaggagagctggccggccctgaggaggtgctgcaggagagcgctgctgtgactggaacagcctggctggaggccgacagccctggcctgggcggcgtgacagctgaggccggcagcggagatgcccaggccctgcctgccaccctgcaggcccctcatgaggtgctgggccagagcatcatgcccccagccatccctgaggccacagaggccagcggcccccccagccccacccctggggacaagctgagccctgccagcgagctgcccaaggagagccccctggaggtgtggctgaacctgggcggcagcaccccagacccccagggccctgagctgacctaccccttccagggcaccctggagccccagcctgccagtgacatcatcgacatcgactactttgagggcctggatggagagggcagaggagctgacctgggcagcttccctggcagccctggcaccagcgagaaccacccagacacagaaggagagacccccagctggagcctgctggacctgtatgatgacttcaccccatttgatgaaagtgacttctaccccaccaccagcttctatgatgacctggatgaggaggaggaggaggaggaggatgacaaggatgctgtgggcggcggggacctggaggatgaaaatgagctgctggtgcccaccgggaagccaggcctgggccctggcaccggccagcccaccagccgctggcatgctgtgcccccccagcacaccctgggctctgtgcccggcagcagcatcgccctgcggcccaggcctggagagcccggccgggacctggccagcagtgaaaatggaacagagtgccgcagcggctttgtgcgccacaacggcagctgccgctctgtgtgtgacctcttccccagctactgccacaatggaggccagtgctacctggtggagaacattggagccttctgccgctgcaacacccaggactacatctggcacaagggcatgagatgtgagagcatcatcacagacttccaggtgatgtgtgtggccgtgggcagcgctgccctggtgctgctgctgctcttcatgatgaccgtcttctttgccaagaagctgtacctgctgaagacagagaacaccaagctgcggaggaccaacaagttccgcaccccatctgagctgcacaatgacaacttcagcctgagcaccatcgccgagggcagccaccccaacgtgaggaagctgtgcaacacccccaggaccagcagcccccacgcccgggccctggcccactatgacaacgtcatctgccaggatgaccccagcgccccccacaagatccaggaggtgctgaagagctgcctgaaggaggaggagagcttcaacatccagaacagcatgagccccaagctggagggcggcaagggggaccaggccgacctggatgtgaactgcctgcagaacaacctgacctag

SEQ ID NO: 33005 - DNA, 1206 bp, Artificial Sequence
  Description of Artificial Sequence: Synthetic coding sequence
atgcccccagccatccctgaggccacagaggccagcggcccccccagccccacccctggggacaagctgagccctgccagcgagctgcccaaggagagccccctggaggtgtggctgaacctgggcggcagcaccccagacccccagggccctgagctgacctaccccttccagggcaccctggagccccagcctgccagtgacatcatcgacatcgactactttgagggcctggatggagagggcagaggagctgacctgggcagcttccctggcagccctggcaccagcgagaaccacccagacacagaaggagagacccccagctggagcctgctggacctgtatgatgacttcaccccatttgatgaaagtgacttctaccccaccaccagcttctatgatgacctggatgaggaggaggaggaggaggaggatgacaaggatgctgtgggcggcggggacctggaggatgaaaatgagctgctggtgcccaccgggaagccaggcctgggccctggcaccggccagcccaccagccgctggcatgctgtgcccccccagcacaccctgggctctgtgcccggcagcagcatcgccctgcggcccaggcctggagagcccggccgggacctggccagcagtgaaaatggaacagagtgccgcagcggctttgtgcgccacaacggcagctgccgctctgtgtgtgacctcttccccagctactgccacaatggaggccagtgctacctggtggagaacattggagccttctgccgctgcaacacccaggactacatctggcacaagggcatgagatgtgagagcatcatcacagacttccaggtgatgtgtgtggccgtgggcagcgctgccctggtgctgctgctgctcttcatgatgaccgtcttctttgccaagaagctgtacctgctgaagacagagaacaccaagctgcggaggaccaacaagttccgcaccccatctgagctgcacaatgacaacttcagcctgagcaccatcgccgagggcagccaccccaatgatgaccccagcgccccccacaagatccaggaggtgctgaagagctgcctgaaggaggaggagagcttcaacatccagaacagcatgagccccaagctggagggcggcaaaggagaccaggccgacctggatgtgaactgcctgcagaacaacctgacctag

SEQ ID NO: 33006 - DNA, 822 bp, Artificial Sequence
  Description of Artificial Sequence: Synthetic coding sequence
atgagccgggtggtgtccctgctgctgggcgccgccctgctgtgtggccatggagccttctgccggcgggtggtgtctggccagaaggtgtgctttgctgacttcaagcacccctgctacaagatggcctacttccacgagctgagcagccgggtgtccttccaggaggcccggctggcctgtgagagcgagggcggcgtgctgctgagcctggagaatgaagctgagcagaagctgattgagagcatgctgcagaacctgaccaagccaggcaccggcatcagtgatggagacttctggattggcctgtggagaaatggagatggccagaccagcggggcctgcccagacctgtaccagtggagcgatggcagcaacagccagtacagaaactggtacacagatgagcccagctgtggcagcgagaagtgtgtggtgatgtaccaccagcccacagccaaccctggcctgggcggcccctacctgtaccagtggaatgatgaccgctgcaacatgaagcacaactacatctgcaagtatgagcctgagatcaaccccacagcccctgtggagaagccctacctgaccaaccagcccggggacacccaccagaatgtggtggtgacagaagctggcatcatccccaacctgatctacgtggtgatccccaccatccccctgctgctgctgatcctggtggccttcggcacctgctgcttccagatgctgcacaagagcaaaggaagaaccaagaccagccccaaccagagcaccctgtggatcagcaagagcaccaggaaggagagcggcatggaggtgtag

SEQ ID NO: 33007 - DNA, 711 bp, Artificial Sequence
  Description of Artificial Sequence: Synthetic coding sequence
atggcctacttccacgagctgagcagccgggtgtccttccaggaggcccggctggcctgtgagagcgagggcggcgtgctgctgagcctggagaatgaggccgagcagaagctgattgaatccatgctgcagaacctgaccaagccaggcaccggcatcagtgatggagacttctggattggcctgtggagaaatggagatggccagaccagcggggcctgcccagacctgtaccagtggagcgatggcagcaacagccagtacagaaactggtacacagatgagcccagctgtggcagcgagaagtgtgtggtgatgtaccaccagcccacagccaaccctggcctgggcggcccctacctgtaccagtggaatgatgaccgctgcaacatgaagcacaactacatctgcaagtatgagcctgagatcaaccccacagcccctgtggagaagccctacctgaccaaccagcccggggacacccaccagaatgtggtggtgacagaggccgtgaaggaggagcagaagctggtgcagaccagcctgcactgcggcttccagagggtgcctgagaagaaggtggcctggaagtacaacaacagcctgacctggttccagaacttcgtcatcctggacctgtacaaggagtggcaccagaacaacagcctggagtggctggagatcaccaaggacctgcaggatgagctgtag

SEQ ID NO: 33008 - DNA, 699 bp, Artificial Sequence
  Description of Artificial Sequence: Synthetic coding sequence
atggcctacttccacgagctgagcagccgggtgtccttccaggaggcccggctggcctgtgagagcgagggcggcgtgctgctgagcctggagaatgaggccgagcagaagctgattgaatccatgctgcagaacctgaccaagccaggcaccggcatcagtgatggagacttctggattggcctgtggagaaatggagatggccagaccagcggggcctgcccagacctgtaccagtggagcgatggcagcaacagccagtacagaaactggtacacagatgagcccagctgtggcagcgagaagtgtgtggtgatgtaccaccagcccacagccaaccctggcctgggcggcccctacctgtaccagtggaatgatgaccgctgcaacatgaagcacaactacatctgcaagtatgagcctgagatcaaccccacagcccctgtggagaagccctacctgaccaaccagcccggggacacccaccagaatgtggtggtgacagaggccggcatcatccccaacctgatctacgtggtgatccccaccatccccctgctgctgctgatcctggtggccttcggcacctgctgcttccagatgctgcacaagagcaagggccgcaccaagaccagccccaaccagagcaccctgtggatcagcaagagcaccaggaaggagagcggcatggaggtgtag

SEQ ID NO: 33009 - DNA, 699 bp, Artificial Sequence; identical to SEQ ID NO: 33008
  Description of Artificial Sequence: Synthetic coding sequence

SEQ ID NO: 33010 - DNA, 711 bp, Artificial Sequence; identical to SEQ ID NO: 33007
  Description of Artificial Sequence: Synthetic coding sequence

SEQ ID NO: 33011 - DNA, 711 bp, Artificial Sequence; identical to SEQ ID NO: 33007
  Description of Artificial Sequence: Synthetic coding sequence

SEQ ID NO: 33012 - DNA, 141 bp, Artificial Sequence
  Description of Artificial Sequence: Synthetic coding sequence
atggcctacttccacgagctgagcagccgggtgtccttccaggaggcccggctggcctgtgagagcgagggcggcgtgctgctgagcctggagaatgaggccgagcagaagctgattgaatccatgctgcagaacctgtag

SEQ ID NO: 33013 - DNA, 141 bp, Artificial Sequence; identical to SEQ ID NO: 33012
  Description of Artificial Sequence: Synthetic coding sequence

SEQ ID NO: 33014 - DNA, 141 bp, Artificial Sequence; identical to SEQ ID NO: 33012
  Description of Artificial Sequence: Synthetic coding sequence

SEQ ID NO: 33015 - DNA, 765 bp, Artificial Sequence
  Description of Artificial Sequence: Synthetic coding sequence
atgacagctggcagcgcccacagccagaaggtgtgctttgctgacttcaagcacccctgctacaagatggcctacttccacgagctgagcagccgggtgtccttccaggaggcccggctggcctgtgagagcgagggcggcgtgctgctgagcctggagaatgaggccgagcagaagctgattgaatccatgctgcagaacctgaccaagccaggcaccggcatcagtgatggagacttctggattggcctgtggagaaatggagatggccagaccagcggggcctgcccagacctgtaccagtggagcgatggcagcaacagccagtacagaaactggtacacagatgagcccagctgtggcagcgagaagtgtgtggtgatgtaccaccagcccacagccaaccctggcctgggcggcccctacctgtaccagtggaatgatgaccgctgcaacatgaagcacaactacatctgcaagtatgagcctgagatcaaccccacagcccctgtggagaagccctacctgaccaaccagcccggggacacccaccagaatgtggtggtgacagaggccggcatcatccccaacctgatctacgtggtgatccccaccatccccctgctgctgctgatcctggtggccttcggcacctgctgcttccagatgctgcacaagagcaagggccgcaccaagaccagccccaaccagagcaccctgtggatcagcaagagcaccaggaaggagagcggcatggaggtgtag

SEQ ID NO: 33016 - DNA, 1239 bp, Artificial Sequence
  Description of Artificial Sequence: Synthetic coding sequence
atgcagaagtactgcatctaccagcacttccagttccagctgctgatccagcacctgtggattgctgccaactgtgacattgctgatgaaagatttgatgccaccttccacaccaacgtgctggtgaacagcagcggccactgccagtacctgcccccaggcatcttcaagagcagctgctacattgatgtgcgctggttcccctttgatgtgcagcactgcaagctgaagtttggctcctggagctatggaggctggagcctggacctgcagatgcaggaggccgacatcagcggctacatccccaatggagagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgactgtgttcatgctgctggtggccgagatcatgcctgccaccagtgacagcgtgcccctgattgcccagtactttgccagcaccatgatcatcgtgggcctgtctgtggtggtgacagtgattgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagattctggagtggtgtgtggccgcatggcctgcagccccacccatgatgagcacctgctgcacggcggccagcccccagagggggaccctgacctggccaagatcctggaggaggtgcgctacatcgccaaccgcttccgctgccaggatgaaagtgaagctgtgtgcagcgagtggaagtttgctgcctgtgtggtggaccggctgtgcctgatggccttcagcgtcttcaccatcatctgcaccatcggcatcctgatgtctgcccccaactttgtggaggccgtgtccaaggactttgcctag

SEQ ID NO: 33017 - DNA, 966 bp, Artificial Sequence
  Description of Artificial Sequence: Synthetic coding sequence
atgcaggaggccgacatcagcggctacatccccaacggggagtgggacctggtgggcatccctgggaagaggtctgagcgcttctatgagtgctgcaaggagccctacccagatgtgaccttcaccgtgaccatgagaagaaggaccctgtactacggcctgaacctgctgatcccctgtgtgctgatcagcgccctggccctgctggtgttcctgctgcctgctgacagcggggagaagatcagcctgggcatcaccgtgctgctgagcctgaccgtcttcatgctgctggtggccgagatcatgcctgccaccagtgacagcgtgcccctcatcgcccagtactttgccagcaccatgatcatcgtgggcctgtctgtggtggtgaccgtcatcgtgctgcagtaccaccaccacgaccctgatggcggcaagatgcccaagtggaccagggtcatcctgctgaactggtgtgcctggttcctgaggatgaagaggcctggagaggacaaggtgcggcctgcctgccagcacaagcagaggcgctgcagcctggcctctgtggagatgtctgctgtggcccctcctccagccagcaatggaaacctgctgtacatcggcttccggggcctggatggagtgcactgtgtgcccaccccagacagcggcgtggtgtgtggccgcatggcctgcagccccacccatgatgagcacctgctgcatggaggccagcccccagagggggaccctgacctggccaagatcctggaggaggtgcgctacatcgccaaccgcttccgctgccaggatgagagcgaggccgtgtgcagcgagtggaagtttgctgcctgtgtggtggaccggctgtgcctgatggccttctctgtgttcaccatcatctgcaccatcggcatcctgatgtctgcccccaactttgtggaggccgtgtccaaggactttgcctag

SEQ ID NO: 33018 - DNA, 966 bp, Artificial Sequence; identical to SEQ ID NO: 33017
  Description of Artificial Sequence: Synthetic coding sequence

SEQ ID NO: 33019 - DNA, 1626 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaactgcaagctgtttgctgccagcaagaatgtgcggaggaaggccgccagcaccctgagtgacaccaagaacatggagatcatcaacagcaccatcgagaccctggccccagacagcccctttgaccacaagaagacagtgtctggcttccagaagctggagaagctggaccccatcgctgctgaccagcaggacacagtggtgttcaaggtgacagagggcaagctgctgcgggaccccctgagccaccctggagctgagcagacaggcatccagaacaagacccagatgcaccccctgatgagccagatgagcggctctgtgacagcctccatggccactggaagtgccaccaggaaaggaattgtggtgctgattgaccccctggccgccaacggcaccacagacatgcacacctctgtgccccgggtgaagggcggccagaggaacatcacagatgacagccggggccagcccttcatcaagaagatgcacttcaccatccggctgacagagagcgccatcacctacagagacatcgtggtgaagaaggaggatggcttcacccagatcgtgctgagcaccaggagcacagagaagaatgccctgaacacagaggtgatcaaggagatggtgaatgccctgaacagcgctgctgctgatgacagcaagctggtgctcttctctgctgctggcagcgtcttctgctgcggcctggactttggctactttgtgcgccacctgagaaatgacaggaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaatgccatcgtgctggaggagtgcaaggccctggtgcgctgcaacatcaagctggagctggagcaggccaatgaaagagaatgtgaggtgctgaggaagatctggagcagcgcccagggcattgaatccatgctgaagtatgtggagaacaagattgatgagttctag

SEQ ID NO: 33020 - DNA, 1668 bp, Artificial Sequence
  Description of Artificial Sequence: Synthetic coding sequence
atggccagccaggagtttgaggtggaggccatcgtggacaagaggcaggacaagaatggaaacacccagtacctggtgcgctggaagggctatgacaagcaggatgacacctgggagcctgagcagcacctgatgaactgtgagaagtgtgtgcatgacttcaacagacggcagacagagaagcagaagaagctgacctggaccaccaccagccgcatcttcagcaacaatgcccggcggaggaccagccgcagcaccaaggccaactacagcaagaacagccccaagacccctgtgacagacaagcaccacaggagcaagaactgcaagctgtttgctgccagcaagaatgtgcggaggaaggccgccagcaccctgagtgacaccaagaacatggagatcatcaacagcaccatcgagaccctggccccagacagcccctttgaccacaagaagacagtgtctggcttccagaagctggagaagctggaccccatcgctgctgaccagcaggacacagtggtgttcaaggtgacagagggcaagctgctgcgggaccccctgagccaccctggagctgagcagacaggcatccagaacaagacccagatgcaccccctgatgagccagatgagcggctctgtgacagcctccatggccactggaagtgccaccaggaaaggaattgtggtgctgattgaccccctggccgccaacggcaccacagacatgcacacctctgtgccccgggtgaagggcggccagaggaacatcacagatgacagccggggccagcccttcatcaagaagatgcacttcaccatccggctgacagagagcgccatcacctacagagacatcgtggtgaagaaggaggatggcttcacccagatcgtgctgagcaccaggagcacagagaagaatgccctgaacacagaggtgatcaaggagatggtgaatgccctgaacagcgctgctgctgatgacagcaagctggtgctcttctctgctgctggcagcgtcttctgctgcggcctggactttggctactttgtgcgccacctgagaaatgacaggaacacagccagcctggagatggtggacaccatcaagaactttgtgaacaccttcatccagttcaagaagcccatcgtggtgtctgtgaatggacctgccatcggcctgggcgccagcatcctgcccctgtgtgacctggtgtgggccaatgagaaggcctggttccagaccccctacaccaccttcggccagagcccagatggctgcagcagcatcaccttccccaagatgatgggcaaggccagcgccaatgagatgctgattgctggcaggaagctgacagcccgggaggcctgtgccaagggcctggtgtcccaggtgttcctgaccggcaccttcacccaggaggtgatgatccagatcaaggagctggccagctacaatgccatcgtgctggaggagtgcaaggccctggtgcgctgcaacatcaagctggagctggagcaggccaatgaaagagaatgtgaggtgctgaggaagatctggagcagcgcccagggcattgaatccatgctgaagatccccctgctgggctacaaggccgccttcccccccaggaagacccagaatgaccagcgctggtgcccctag

SEQ ID NO: 33021 - DNA, 2403 bp, Artificial Sequence
  Description of Artificial Sequence: Synthetic coding sequence
atggccaccctgggccagaagcctgtgatccacacagtgctgaagaggaaggtgtacagcagcaatgagaagatgaggcggggcacctggagaattgtggtgcccatgaccaaggatgatgccctgaaggagatccggggcaaccaggtgaccttccaggactgcttcatcgctgacttcctgatcctgctgaccttccccctgctgaccatccctgagatccctggctacctgcccatcagcagcccccggggcagccagctgatggcctcctgggatgcctgtgtggtggccagcgctgtgctggtgacagacatggagaccttccacaccacagacagcttcaagtcctggacccgcatccgggtgcccccagacatcctgagtgatgatgaaagaagatctgtggcccacgtgatcctgagcagagatggcatcgtgttcctgatcaatggagtgctgtacatcaagagcttccggggcttcatccggctgggcggcatcgtgaacctgcctgatggcggcatcaccggcatcagcagcaggaagtggtgctgggtgaactacctgctgaaggccaagggccgccgcagcacctttgctgtgtggacagaaaatgagatctacctgggcagcatcctgctgaagtttgcccggctggtgaccaccacagagctgaagaacatcctgagcctgtctgtgacagccaccctgaccatcgacagagtggagtacacaggccaccccctggagattgctgtgttcctgaactactgcaccgtgtgcaatgtgaccaagaagatcttcctggtgatctacaatgaagacaccaagcagtgggtgtcccaggacttcaccctggatgcccccattgattctgtgaccatgccccacttcaccttcagcgccctgcccggcctgctgctgtggaacaagcacagcatctactactgctaccacaacttcaccttcaccggcatcctgcagaccccagctggccacggcaacctgtccatgctgagcaatgacagcatcatccacgaggtgttcatcgactactacggggacatcctggtgaagatggagaacaacgtcatcttctacagcaagatcaacaccagagatgctgtgaagctgcacctgtggaccaactacaccacccgggccttcatcttcctgagcaccagcggccagacctacttcctgtatgccctggatgatggcaccatccagatccaggactaccccctgcacctggaggcccagagcatcgccttcaccaccaaggacaagtgcccctacatggccttccacaacaacgtggcccacgtgttctacttcctggacaagggggaggccctgactgtgtggacccagatcgtgtacccagagaacacaggcctgtatgtgattgtggagagctatggccccaagatcctgcaggagagccatgagatcagctttgaggccgccttcggctactgcaccaagaccctgaccctgaccttctaccagaatgtggactatgagcgcatcagtgactactttgagacccaggacaagcacacaggcctggtgctggtgcagttccggcccagcgagtacagcaaggcctgccccatcgcccagaaggtgttccagattgctgtgggctgtgatgacaagaagttcatcgccatcaagggcttcagcaagaagggctgccaccaccacgacttctcctatgtgattgagaagagctacctgcggcaccagcccagcaagaacctgcgggtgcgctacatctggggcgagtatggctgccccctgcggctggacttcacagagaagttccagcctgtggtgcagctgtttgatgacaatggctacgtgaaggatgtggaggccaacttcatcgtgtgggagatccacggcagagatgactacagcttcaacaacaccatggcccagagcggctgcctgcacgaggcccagacctggaagtccatgattgagctgaacaagcacctgcccctggaggaggtgtggggccctgagaactacaagcactgcttctcctatgccatcggcaagccaggggacctgaaccagccctatgagatcatcaacagcagcaatggaaaccacatcttctggcccatgggccacagcggcatgtatgtgttccgggtgaagatcctggaccccaactacagcttctgcaacctgacagccatgtttgccatcgagaccttcggcctcatccccagccccagcgtgtacctggtggccagcttcctgtttgtgctgatgctgctcttcttcaccatcctggtgctgagctacttccgctacatgaggatctaccgccgctacatctatgagcccctgcacaagccccagaggaagaggaagaagaactag

SEQ ID NO: 33022 - DNA, 2499 bp, Artificial Sequence
  Description of Artificial Sequence: Synthetic coding sequence
atgtctgcccgggaggtggccgtgctgctgctgtggctgagctgctacggcagcgccctgtggagatacagcaccaacagccccaactaccgcatcttcagcaccaggagcaccatcaagctggagtatgagggcaccctcttcacagagtggagcgtgcctgagacctgctttgtgctgaacaagagcagccccaccacagagctgcgctgcagcagccctggggtgcacgccatcaagcccatcgtgacaggcccagatgaggaggagcgctacctgtttgtggagagcagccacacctgcttcctgtggtactacagagtgcgccacttcttcaacaacttcacccagctgatcaccgtgtgggcctatgaccctgagagcgctgaccctgatgagctgctgggcaatgctgaggagcccagcatcaacagcatcgtgctgagcacccagatggccaccctgggccagaagcctgtgatccacacagtgctgaagaggaaggtgtacagcagcaatgagaagatgagaagaggcacctggagaattgtggtgcccatgaccaaggatgatgccctgaaggagatccggggcaaccaggtgaccttccaggactgcttcatcgctgacttcctgatcctgctgaccttccccctgctgaccatccctgagatccctggctacctgcccatcagcagcccccggggcagccagctgatggcctcctgggatgcctgtgtggtggccagcgctgtgctggtgacagacatggagaccttccacaccacagacagcttcaagtcctggacccgcatccgggtgcccccagacatcctgagtgatgatgagcggcgctctgtggcccacgtgatcctgagcagagatggcatcgtgttcctgatcaacggggtgctgtacatcaagagcttccggggcttcatccggctgggcggcatcgtgaacctgcctgatggcggcatcaccggcatcagcagcaggaagtggtgctgggtgaactacctgctgaaggccaagggcagaagaagcacctttgctgtgtggacagaaaatgagatctacctgggcagcatcctgctgaagtttgcccggctggtgaccaccacagagctgaagaacatcctgagcctgtctgtgacagccaccctgaccatcgacagagtggagtacacaggccaccccctggagattgctgtgttcctgaactactgcaccgtgtgcaatgtgaccaagaagatcttcctggtgatctacaatgaagacaccaagcagtgggtgtcccaggacttcaccctggatgcccccatcgacagcgtgaccatgccccacttcaccttcagcgccctgcccggcctgctgctgtggaacaagcacagcatctactactgctaccacaacttcaccttcaccggcatcctgcagaccccagctggccacggcaacctgtccatgctgagcaatgacagcatcatccacgaggtgttcatcgactactatggagacatcctggtgaagatggagaacaacgtcatcttctacagcaagatcaacaccagagatgctgtgaagctgcacctgtggaccaactacaccacccgggccttcatcttcctgagcaccagcggccagacctacttcctgtatgccctggatgatggcaccatccagatccaggactaccccctgcacctggaggcccagagcatcgccttcaccaccaaggacaagtgcccctacatggccttccacaacaacgtggcccacgtgttctacttcctggacaagggggaggccctgactgtgtggacccagatcgtgtacccagaaaatacaggcctgtatgtgattgtggagagctatggccccaagatcctgcaggagagccatgagatcagctttgaagctgccttcggctactgcaccaagaccctgaccctgaccttctaccagaatgtggactatgaaagaatttctgactactttgagacccaggacaagcacacaggcctggtgctggtgcagttccggcccagcgagtacagcaaggcctgccccatcgcccagaaggtgttccagattgctgtgggctgtgatgacaagaagttcatcgccatcaagggcttcagcaagaagggctgccaccaccacgacttctcctatgtgattgagaagagctacctgcggcaccagcccagcaagaacctgcgggtgcgctacatctggggcgagtatggctgccccctgcggctggacttcacagagaagttccagcctgtggtgcagctgtttgatgacaatggctacgtgaaggatgtggaggccaacttcatcgtgtgggagatccacggcagagatgactacagcttcaacaacaccatggcccagagcggctgcctgcacgaggcccagacctggaagtccatgattgagctgaacaagcacctgcccctggaggaggtgtggggccctgagttcctgtag

SEQ ID NO: 33023 - DNA, 2856 bp, Artificial Sequence
  Description of Artificial Sequence: Synthetic coding sequence
atgtctgcccgggaggtggccgtgctgctgctgtggctgagctgctacggcagcgccctgtggagatacagcaccaacagccccaactaccgcatcttcagcaccaggagcaccatcaagctggagtatgagggcaccctcttcacagagtggagcgtgcctgagacctgctttgtgctgaacaagagcagccccaccacagagctgcgctgcagcagccctggggtgcacgccatcaagcccatcgtgacaggcccagatgaggaggagcgctacctgtttgtggagagcagccacacctgcttcctgtggtactacagagtgcgccacttcttcaacaacttcacccagctgatcaccgtgtgggcctatgaccctgagagcgctgaccctgatgagctgctgggcaatgctgaggagcccagcatcaacagcatcgtgctgagcacccagatggccaccctgggccagaagcctgtgatccacacagtgctgaagaggaaggtgtacagcagcaatgagaagatgagaagaggcacctggagaattgtggtgcccatgaccaaggatgatgccctgaaggagatccggggcaaccaggtgaccttccaggactgcttcatcgctgacttcctgatcctgctgaccttccccctgctgaccatccctgagatccctggctacctgcccatcagcagcccccggggcagccagctgatggcctcctgggatgcctgtgtggtggccagcgctgtgctggtgacagacatggagaccttccacaccacagacagcttcaagtcctggacccgcatccgggtgcccccagacatcctgagtgatgatgagcggcgctctgtggcccacgtgatcctgagcagagatggcatcgtgttcctgatcaacggggtgctgtacatcaagagcttccggggcttcatccggctgggcggcatcgtgaacctgcctgatggcggcatcaccggcatcagcagcaggaagtggtgctgggtgaactacctgctgaaggccaagggcagaagaagcacctttgctgtgtggacagaaaatgagatctacctgggcagcatcctgctgaagtttgcccggctggtgaccaccacagagctgaagaacatcctgagcctgtctgtgacagccaccctgaccatcgacagagtggagtacacaggccaccccctggagattgctgtgttcctgaactactgcaccgtgtgcaatgtgaccaagaagatcttcctggtgatctacaatgaagacaccaagcagtgggtgtcccaggacttcaccctggatgcccccatcgacagcgtgaccatgccccacttcaccttcagcgccctgcccggcctgctgctgtggaacaagcacagcatctactactgctaccacaacttcaccttcaccggcatcctgcagaccccagctggccacggcaacctgtccatgctgagcaatgacagcatcatccacgaggtgttcatcgactactatggagacatcctggtgaagatggagaacaacgtcatcttctacagcaagatcaacaccagagatgctgtgaagctgcacctgtggaccaactacaccacccgggccttcatcttcctgagcaccagcggccagacctacttcctgtatgccctggatgatggcaccatccagatccaggactaccccctgcacctggaggcccagagcatcgccttcaccaccaaggacaagtgcccctacatggccttccacaacaacgtggcccacgtgttctacttcctggacaagggggaggccctgactgtgtggacccagatcgtgtacccagaaaatacaggcctgtatgtgattgtggagagctatggccccaagatcctgcaggagagccatgagatcagctttgaagctgccttcggctactgcaccaagaccctgaccctgaccttctaccagaatgtggactatgaaagaatttctgactactttgagacccaggacaagcacacaggcctggtgctggtgcagttccggcccagcgagtacagcaaggcctgccccatcgcccagaaggtgttccagattgctgtgggctgtgatgacaagaagttcatcgccatcaagggcttcagcaagaagggctgccaccaccacgacttctcctatgtgattgagaagagctacctgcggcaccagcccagcaagaacctgcgggtgcgctacatctggggcgagtatggctgccccctgcggctggacttcacagagaagttccagcctgtggtgcagctgtttgatgacaatggctacgtgaaggatgtggaggccaacttcatcgtgtgggagatccacggcagagatgactacagcttcaacaacaccatggcccagagcggctgcctgcacgaggcccagacctggaagtccatgattgagctgaacaagcacctgcccctggaggaggtgtggggccctgagaactacaagcactgcttctcctatgccatcggcaagccaggggacctgaaccagccctatgagatcatcaacagcagcaatggaaaccacatcttctggcccatgggccacagcggcatgtatgtgttccgggtgaagatcctggaccccaactacagcttctgcaacctgacagccatgtttgccatcgagaccttcggcctcatccccagccccagcgtgtacctggtggccagcttcctgtttgtgctgatgctgctcttcttcaccatcctggtgctgagctacttccgctacatgaggatctaccgccgctacatctatgagcccctgcacaagccccagaggaagaggaagaagaactag

SEQ ID NO: 33024 - DNA, 2499 bp, Artificial Sequence; identical to SEQ ID NO: 33022
  Description of Artificial Sequence: Synthetic coding sequence

SEQ ID NO: 33025 - DNA, 2616 bp, Artificial Sequence
  Description of Artificial Sequence: Synthetic coding sequence
agaagaagaagcagaagacatgtgtccccaggcagcggccgggctgctgctgtggccgagctgctgtggctgcggcccctggagatcaagctggagtatgagggcaccctcttcacagagtggagcgtgcctgagacctgctttgtgctgaacaagagcagccccaccacagagctgcgctgcagcagccctggggtgcacgccatcaagcccatcgtgacaggcccagatgaggaggagcgctacctgtttgtggagagcagccacacctgcttcctgtggtactacagagtgaggacctggagaattgtggtgcccatgaccaaggatgatgccctgaaggagatccggggcaaccaggtgaccttccaggactgcttcatcgctgacttcctgatcctgctgaccttccccctgctgaccatccctgagatccctggctacctgcccatcagcagcccccggggcagccagctgatggcctcctgggatgcctgtgtggtggccagcgctgtgctggtgacagacatggagaccttccacaccacagacagcttcaagtcctggacccgcatccgggtgcccccagacatcctgagtgatgatgagcggcgctctgtggcccacgtgatcctgagcagagatggcatcgtgttcctgatcaacggggtgctgtacatcaagagcttccggggcttcatccggctgggcggcatcgtgaacctgcctgatggcggcatcaccggcatcagcagcaggaagtggtgctgggtgaactacctgctgaaggccaagggcagaagaagcacctttgctgtgtggacagaaaatgagatctacctgggcagcatcctgctgaagtttgcccggctggtgaccaccacagagctgaagaacatcctgagcctgtctgtgacagccaccctgaccatcgacagagtggagtacacaggccaccccctggagattgctgtgttcctgaactactgcaccgtgtgcaatgtgaccaagaagatcttcctggtgatctacaatgaagacaccaagcagtgggtgtcccaggacttcaccctggatgcccccatcgacagcgtgaccatgccccacttcaccttcagcgccctgcccggcctgctgctgtggaacaagcacagcatctactactgctaccacaacttcaccttcaccggcatcctgcagaccccagctggccacggcaacctgtccatgctgagcaatgacagcatcatccacgaggtgttcatcgactactatggagacatcctggtgaagatggagaacaacgtcatcttctacagcaagatcaacaccagagatgctgtgaagctgcacctgtggaccaactacaccacccgggccttcatcttcctgagcaccagcggccagacctacttcctgtatgccctggatgatggcaccatccagatccaggactaccccctgcacctggaggcccagagcatcgccttcaccaccaaggacaagtgcccctacatggccttccacaacaacgtggcccacgtgttctacttcctggacaagggggaggccctgactgtgtggacccagatcgtgtacccagaaaatacaggcctgtatgtgattgtggagagctatggccccaagatcctgcaggagagccatgagatcagctttgaagctgccttcggctactgcaccaagaccctgaccctgaccttctaccagaatgtggactatgaaagaatttctgactactttgagacccaggacaagcacacaggcctggtgctggtgcagttccggcccagcgagtacagcaaggcctgccccatcgcccagaaggtgttccagattgctgtgggctgtgatgacaagaagttcatcgccatcaagggcttcagcaagaagggctgccaccaccacgacttctcctatgtgattgagaagagctacctgcggcaccagcccagcaagaacctgcgggtgcgctacatctggggcgagtatggctgccccctgcggctggacttcacagagaagttccagcctgtggtgcagctgtttgatgacaatggctacgtgaaggatgtggaggccaacttcatcgtgtgggagatccacggcagagatgactacagcttcaacaacaccatggcccagagcggctgcctgcacgaggcccagacctggaagtccatgattgagctgaacaagcacctgcccctggaggaggtgtggggccctgagaactacaagcactgcttctcctatgccatcggcaagccaggggacctgaaccagccctatgagatcatcaacagcagcaatggaaaccacatcttctggcccatgggccacagcggcatgtatgtgttccgggtgaagatcctggaccccaactacagcttctgcaacctgacagccatgtttgccatcgagaccttcggcctcatccccagccccagcgtgtacctggtggccagcttcctgtttgtgctgatgctgctcttcttcaccatcctggtgctgagctacttccgctacatgaggatctaccgccgctacatctatgagcccctgcacaagccccagaggaagaggaagaagaactag

SEQ ID NO: 33026 - DNA, 309 bp, Artificial Sequence
  Description of Artificial Sequence: Synthetic coding sequence
atgaccacagccacccccctgggggacaccaccttcttcagcctgaacatgaccaccagaggagaggacttcctgtacaagagcagcggggccatcgtggccgctgtggtggtggtggtgatcatcatcttcaccgtggtgctgatcctgctgaagatgtacaacaggaagatgaggacccggcgggagctggagcccaagggccccaagcccacagcccccagcgctgtgggccccaacagcaatggcagccagcacccagccaccgtgaccttcagccctgtggatgtgcaggtggagaccaggtag

SEQ ID NO: 33027 - DNA, 1035 bp, Artificial Sequence
  Description of Artificial Sequence: Synthetic coding sequence
atggccctgcggcacctggccctgctggccggcctgctggtgggcgtggccagcaagtccatggagaacacagcccagctgcctgagtgctgcgtggatgtggtgggcgtgaatgccagctgccctggggccagcctgtgtggccctggctgctaccgccgctggaatgctgatggcagcgccagctgtgtgcgctgtggaaatggcaccctgcctgcctacaatggaagtgagtgccgcagctttgctggccctggggcccccttccccatgaacagaagcagcggcaccccaggccggccccaccctggggccccccgggtggccgccagcctcttcctgggcaccttcttcatcagcagcggcctcatcctgtctgtggccggcttcttctacctgaagaggagcagcaagctgccccgggcctgctacagaagaaacaaggccccagccctgcagcccggggaggccgccgccatgatccccccaccccagagcagcggcaacagcagctgccgcatccccctgtggggcttccccagcctgggccagagccagggcgccctgtgggtgtgcccccagacaggcctgcccggcagcggcagccggccccccctgcccggcagccctggggacccccccacccggcagggccagggccgcatctggctggtgcccccagccctggacctgtcctggatctggccagcccccccagcccggcccccactcatccctgtgacctccatgctgtttcctgtgcctgagacctggggcctgcaggagaggaggacccaccacgacagagctgacccccagtacctgctgctgctggaggtgcagctgcaccccaggacagatgctgctggcctgcggcaggccctgctgagcagccaccgcttcagcggggccggcagcggcggccccaagagccagcctgtgaggaagcccaggtatgtgagaagagagcggcccctggaccgggccacagatcctgctgccttccctggagaggcccgcatcagcaatgtgtag

SEQ ID NO: 33028 - DNA, 597 bp, Artificial Sequence
  Description of Artificial Sequence: Synthetic coding sequence
atggccctgcggcacctggccctgctggccggcctgctggtgggcgtggccagcaagtccatggagaacacagcccagctgcctgagtgctgcgtggatgtggtgggcgtgaatgccagctgccctggggccagcctgtgtggccctggctgctaccgccgctggaatgctgatggcagcgccagctgtgtgcgctgtggaaatggcaccctgcctgcctacaatggaagtgagtgccgcagctttgctggccctggggcccccttccccatgaacagaagcagcggcaccccaggccggccccaccctggggccccccgggtggccgccagcctcttcctgggcaccttcttcatcagcagcggcctcatcctgtctgtggccggcttcttctacctgaagaggagcagcaagctgccccgggcctgctacagaagaaacaaggccccagccctgcagcccggggaggccgccgccatgatccccccaccccagagctctgtgaggaagcccaggtatgtgagaagagagcggcccctggaccgggccacagatcctgctgccttccctggagaggcccgcatcagcaatgtgtag

SEQ ID NO: 33029 - DNA, 1143 bp, Artificial Sequence
  Description of Artificial Sequence: Synthetic coding sequence
atggccctgcggcacctggccctgctggccggcctgctggtgggcgtggccagcaagtccatggagaacacagtgaccaggaacagcacagctgtgatcaacacccaggccgagggcaccctgagccccccaggcctgagcagcctgcctgtggtgcgggagtgggccctgacccacacagcccagctgcctgagtgctgcgtggatgtggtgggcgtgaatgccagctgccctggggccagcctgtgtggccctggctgctaccgccgctggaatgctgatggcagcgccagctgtgtgcgctgtggaaatggcaccctgcctgcctacaatggaagtgagtgccgcagctttgctggccctggggcccccttccccatgaacagaagcagcggcaccccaggccggccccaccctggggccccccgggtggccgccagcctcttcctgggcaccttcttcatcagcagcggcctcatcctgtctgtggccggcttcttctacctgaagaggagcagcaagctgccccgggcctgctacagaagaaacaaggccccagccctgcagcccggggaggccgccgccatgatccccccaccccagagcagcggcaacagcagctgccgcatccccctgtggggcttccccagcctgggccagagccagggcgccctgtgggtgtgcccccagacaggcctgcccggcagcggcagccggccccccctgcccggcagccctggggacccccccacccggcagggccagggccgcatctggctggtgcccccagccctggacctgtcctggatctggccagcccccccagcccggcccccactcatccctgtgacctccatgctgtttcctgtgcctgagacctggggcctgcaggagaggaggacccaccacgacagagctgacccccagtacctgctgctgctggaggtgcagctgcaccccaggacagatgctgctggcctgcggcaggccctgctgagcagccaccgcttcagcggggccggcagcggcggccccaagagccagcctgtgaggaagcccaggtatgtgagaagagagcggcccctggaccgggccacagatcctgctgccttccctggagaggcccgcatcagcaatgtgtag

SEQ ID NO: 33030 - DNA, 597 bp, Artificial Sequence; identical to SEQ ID NO: 33028
  Description of Artificial Sequence: Synthetic coding sequence

SEQ ID NO: 33031 - DNA, 558 bp, Artificial Sequence
  Description of Artificial Sequence: Synthetic coding sequence
atggccctgcggcacctggccctgctggccggcctgctggtgggcgtggccagcaagtccatggagaacacagcccagctgcctgagtgctgcgtggatgtggtgggcgtgaatgccagctgccctggggccagcctgtgtggccctggctgctaccgccgctggaatgctgatggcagcgccagctgtgtgcgctgtggaaatggcaccctgcctgcctacaatggaagtgagtgccgcagctttgctggccctggggcccccttccccatgaacagaagcagcggcaccccaggccggccccaccctggggccccccgggtggccgccagcctcttcctgggcaccttcttcatcagcagcggcctcatcctgtctgtggccggcttcttctacctgaagaggagcagcaagctgccccgggcctgctacagaagaaacaagggccctgccccagctggcagcctgcccggccgctggagcagccagcagtttggcccccaggccccagccctgcagcccggggaggccgtgagcaacccccaccaccctggatag

SEQ ID NO: 33032 - DNA, 174 bp, Artificial Sequence
  Description of Artificial Sequence: Synthetic coding sequence
atggccctgcggcacctggccctgctggccggcctgctggtgggcgtggccagcaagtccatggagaacacagcccagctgcctgagtgctgcgtggatgtggtgggcgtgaatgccagctgccctggggccagcctgtgtggccctggctgctaccgccgctggaatgcctag

SEQ ID NO: 33033 - DNA, 1143 bp, Artificial Sequence; identical to SEQ ID NO: 33029
  Description of Artificial Sequence: Synthetic coding sequence

SEQ ID NO: 33034 - DNA, 603 bp, Artificial Sequence
  Description of Artificial Sequence: Synthetic coding sequence
atgtctgtggtgcccatcctggagggccaggccctgcgcatctgcagctgctcctggctggccttctcctgggagagccctgccagcccctggaggacccggcccagctgccccagcgctgtgtggatgtggtgggccagcaccccagctgcccaggcccaggtgtgtgtggtgcaggccgtgactggagctggcaccaggactggagccccagctgccagcgctgtgggcacagagcccagccagcccaccacagcccccagcgtggaggccgtggtggccggccctggggcccccttccccatgaacagaagcagcggcaccccaggccggccccaccctggggccccccgggtggccgccagcctcttcctgggcaccttcttcatcagcagcggcctcatcctgtctgtggccggcttcttctacctgaagaggagcagcaagctgccccgggcctgctacagaagaaacaaggccccagccctgcagcctggagaggccgccgccatgatccccccaccccagagcagtgatgtgggcagcgctgggaaggaggaccccccccggcagggccggccccccatcccagcccctccttag

SEQ ID NO: 33035 - DNA, 468 bp, Artificial Sequence
  Description of Artificial Sequence: Synthetic coding sequence
atgggcggcaatggcagcacctgcaagccagacacagagcggcagggcaccctgagcacagctgcccccaccaccagccctgccccctgcctgagcaaccaccacaacaagaagcacctgatcctggccttctgtgccggcgtgctgctgaccctgctgctgattgccttcatcttcctgatcatcaagagctacaggaagtacagaagagagcggctgcccatcagccctggccccctgctgcgctgggtgcccctgctgagcggcaccatggctgaccacagcaagccccaggccccagacccccacagcgaccccccagccaagctgagcagcatccctggagagagcctgacctacgccagcaccaccttcaagctgtctgaggagaagagcaaccacctggccgagaaccacagcgctgactttgaccccatcgtgtatgcccagatcaaggtgaccaactag

SEQ ID NO: 33036 - DNA, 393 bp, Artificial Sequence
  Description of Artificial Sequence: Synthetic coding sequence
atgggcggcaatggcagcacctgcaagccagacacagagcggcagggcaccctgagcacagctgcccccaccaccagccctgccccctgcctgagcaaccaccacaacaagaagcacctgatcctggccttctgtgccggcgtgctgctgaccctgctgctgattgccttcatcttcctgatcatcaagagctacaggaagtaccacagcaagccccaggccccagacccccacagcgaccccccagccaagctgagcagcatccctggagagagcctgacctacgccagcaccaccttcaagctgtctgaggagaagagcaaccacctggccgagaaccacagcgctgactttgaccccatcgtgtatgcccagatcaaggtgaccaactag

SEQ ID NO: 33037 - DNA, 600 bp, Artificial Sequence
  Description of Artificial Sequence: Synthetic coding sequence
atggccagccccaagggcttcttcaactacctgacctacttcctggccgccggggctgtgaccctgggcatcggcttctttgccctggccagcgccctgtggttcctgatctgcaagaggcgggagatcttccagaacagcaagttcaaggccattgatgagcgctgccggcagaggcccagcatggccaagatcaagagccacagccagtgtgtgttcatcagcaggaacttccacacaggccgcttccagctgcaggaggagcagaggaagaaggaggccgcccacatcaaggccatcaaggaccacagcaaggatgagccccagctggccaccaagaacatcatctgtgaccccagcgagaccagcagcaccaccaacagaagctctgtgaccctgagcctgagcaccctgcccagcgacagctactacagccagagcattgaggccgcagatgactggttcagtgatgacagcctggtgaagaggaacagccccatgcccagcctgggggagcccctgatggagaaggtgttctcctacctgagcaccatcagcctggaggagggcacagaatctgtgctgaatgacaccctgtag

SEQ ID NO: 33038 - DNA, 519 bp, Artificial Sequence
  Description of Artificial Sequence: Synthetic coding sequence
atgctgacagaggtgatggaggtgtggcacggcctggtgattgctgtggtgtccctcttcctgcaggcctgcttcctgacagccatcaactacctgctgagccgccacatggcccacaagtctgagcagatcctgaaggccgccagcctgcaggtgccccggcccagccctggccaccaccaccccccagctgtgaaggagatgaaggagacccagacagagcgggacatccccatgtctgacagcctgtacagacatgacagcgacacccccagcgacagcctggacagcagctgcagcagccccccagcctgccaggccacagaagatgtggactacacccaggtggtgttcagtgaccctggagagctgaagaatgacagccccctggactatgagaacatcaaggagatcacagattatgtgaatgtgaaccctgagcggcacaagcccagcttctggtactttgtgaacccagccctgtctgagccagcagaatatgaccaggtggccatgtag

SEQ ID NO: 33039 - DNA, 342 bp, Artificial Sequence
  Description of Artificial Sequence: Synthetic coding sequence
atgaatgagaccaacaagaccctggtgggccccagcgagctgcccacagccagcgctgtggcccctggccctggcaccggggcccgggcctggcctgtgctggtgggctttgtgctgggcgctgtggtgctgagcctgctgattgccctggccgccaagtgccacctgtgccgccgctaccacgccagctaccgccaccggcccctgcctgagaccggccggggcggccggccccaggtggccgaggatgaagatgatgatggcttcatcgaggacaactacatccagcccggcactggagagctgggcacagagggcagccgggaccacttcagcctgtag

SEQ ID NO: 33040 - DNA, 342 bp, Artificial Sequence; identical to SEQ ID NO: 33039
  Description of Artificial Sequence: Synthetic coding sequence

SEQ ID NO: 33041 - DNA, 1365 bp, Artificial Sequence
  Description of Artificial Sequence: Synthetic coding sequence
atgggccgcacctacatcgtggaggagaccgtgggccagtacctgagcaacatcaacctgcagggcaaggcctttgtgtctggcctgctgattggccagtgcagcagccagaaggactatgtgatcctggccaccaggaccccacccaaggaggagcagagcgagaacctgaagcaccccaaggccaagctggacaacctggatgaggagtgggccacagaacatgcctgccaggtgtccaggatgctgcccggcggcctgctggtgctgggcgtcttcatcatcaccaccctggagctggccaatgacttccagaatgccctgcggcggctgatgtttgctgtggagaagagcatcaacaggaagaggctgtggaacttcacagaggaggaggtgtctgagcgggtgaccctgcacatctgtgccagcaccaagaagatcttctgcaggacctatgacatccatgaccccaagagcagcgcccggcctgctgactggaagtaccagagcggcctgagcagctcctggctgagcctggagtgcaccgtgcacatcaacatccacatccccctgagcgccacctctgtgtcctacaccctggagaagaacaccaagaatggcctgacccgctgggccaaggagattgaaaatggagtgtacctgatcaatggccaggtgaaggatgaggactgtgacctgctggagggccagaagaagagcagccggggcaacacccaggccaccagccacagctttgatgtgcgggtgctgacccagctgctgctgaacagcgaccacaggagcacagccaccgtgcagatctgcagcggctctgtgaacctgaagggagctgtgaagtgccgggcctacatccacagcagcaagcccaaggtgaaggatgctgtgcaggccgtgaagagggacatcctgaacacagtggccgacagatgtgagatgctgtttgaggacctgctgctgaatgagatccctgagaagaaggacagcgagaaggagttccacgtgctgccctacagagtgtttgtgcccctgcccggcagcacagtgatgctgtgtgactacaagtttgatgatgagagcgctgaggagatccgggaccacttcatggagatgctggaccacaccatccagatcgaggacctggagattgctgaggagaccaacacagcctgcatgagcagctccatgaacagccaggccagcctggacaacacagatgatgagcagcccaagcagcccatcaagaccaccatgctgctgaagatccagcagaacatcggcgtgattgctgccttcaccgtggccgtgctggccgccggcatctccttccactacttcagtgactag

SEQ ID NO: 33042 - DNA, 1296 bp, Artificial Sequence
  Description of Artificial Sequence: Synthetic coding sequence
atgggccgcacctacatcgtggaggagaccgtgggccagtacctgagcaacatcaacctgcagggcaaggcctttgtgtctggcctgctgattggccagtgcagcagccagaaggactatgtgatcctggccaccaggaccccacccaaggaggagcagagcgagaacctgaagcaccccaaggccaagctggacaacctggatgaggagtgggccacagaacatgcctgccaggtgtccaggatgctgcccggcggcctgctggtgctgggcgtcttcatcatcaccaccctggagctggccaatgacttccagaatgccctgcggcggctgatgtttgctgtggagaagagcatcaacaggaagaggctgtggaacttcacagaggaggaggtgtctgagcgggtgaccctgcacatctgtgccagcaccaagaagatcttctgcaggacctatgacatccatgaccccaagagcagcgcccggcctgctgactggaagtaccagagcggcctgagcagctcctggctgagcctggagtgcaccgtgcacatcaacatccacatccccctgagcgccacctctgtgtcctacaccctggagaagaacaccaagaatggcctgacccgctgggccaaggagattgaaaatggagtgtacctgatcaatggccaggtgaaggatgaggactgtgacctgctggagggccagctgctgaacagcgaccacaggagcacagccaccgtgcagatctgcagcggctctgtgaacctgaagggagctgtgaagtgccgggcctacatccacagcagcaagcccaaggtgaaggatgctgtgcaggccgtgaagagggacatcctgaacacagtggccgacagatgtgagatgctgtttgaggacctgctgctgaatgagatccctgagaagaaggacagcgagaaggagttccacgtgctgccctacagagtgtttgtgcccctgcccggcagcacagtgatgctgtgtgactacaagtttgatgatgaatctgctgaggagatccgggaccacttcatggagatgctggaccacaccatccagatcgaggacctggagattgctgaggagaccaacacagcctgcatgagcagctccatgaacagccaggccagcctggacaacacagatgatgagcagcccaagcagcccatcaagaccaccatgctgctgaagatccagcagaacattggagtgattgctgccttcaccgtggccgtgctggccgccggcatctccttccactacttcagtgactag

SEQ ID NO: 33043 - DNA, 1269 bp, Artificial Sequence
  Description of Artificial Sequence: Synthetic coding sequence
atgggccgcacctacatcgtggaggagaccgtgggccagtacctgagcaacatcaacctgcagggcaaggcctttgtgtctggcctgctgattggccagtgcagcagccagaaggactatgtgatcctggccaccaggaccccacccaaggaggagcagagcgagaacctgaagcaccccaaggccaagctggacaacctggatgaggagtgggccacagaacatgcctgccagctgatgtttgctgtggagaagagcatcaacaggaagaggctgtggaacttcacagaggaggaggtgtctgagcgggtgaccctgcacatctgtgccagcaccaagaagatcttctgcaggacctatgacatccatgaccccaagagcagcgcccggcctgctgactggaagtaccagagcggcctgagcagctcctggctgagcctggagtgcaccgtgcacatcaacatccacatccccctgagcgccacctctgtgtcctacaccctggagaagaacaccaagaatggcctgacccgctgggccaaggagattgaaaatggagtgtacctgatcaatggccaggtgaaggatgaggactgtgacctgctggagggccagaagaagagcagccggggcaacacccaggccaccagccacagctttgatgtgcgggtgctgacccagctgctgctgaacagcgaccacaggagcacagccaccgtgcagatctgcagcggctctgtgaacctgaagggagctgtgaagtgccgggcctacatccacagcagcaagcccaaggtgaaggatgctgtgcaggccgtgaagagggacatcctgaacacagtggccgacagatgtgagatgctgtttgaggacctgctgctgaatgagatccctgagaagaaggacagcgagaaggagttccacgtgctgccctacagagtgtttgtgcccctgcccggcagcacagtgatgctgtgtgactacaagtttgatgatgagagcgctgaggagatccgggaccacttcatggagatgctggaccacaccatccagatcgaggacctggagattgctgaggagaccaacacagcctgcatgagcagctccatgaacagccaggccagcctggacaacacagatgatgagcagcccaagcagcccatcaagaccaccatgctgctgaagatccagcagaacatcggcgtgattgctgccttcaccgtggccgtgctggccgccggcatctccttccactacttcagtgactag

SEQ ID NO: 33044 - DNA, 1008 bp, Artificial Sequence
  Description of Artificial Sequence: Synthetic coding sequence
atgggccgcacctacatcgtggaggagaccgtgggccagtacctgagcaacatcaacctgcagggcaaggcctttgtgtctggcctgctgattggccagtgcagcagccagaaggactatgtgatcctggccaccaggaccccacccaaggaggagcagagcgagaacctgaagcaccccaaggccaagctggacaacctggatgaggagtgggccacagaacatgcctgccaggtgtccaggatgctgcccggcggcctgctggtgctgggcgtcttcatcatcaccaccctggagctggccaatgacttccagaatgccctgcggcggctgatgtttgctgtggagaagagcatcaacaggaagaggctgtggaacttcacagaggaggaggtgtctgagcgggtgaccctgcacatctgtgccagcaccaagaagatcttctgcaggacctatgacatccatgaccccaagagcagcgcccggcctgctgactggaagtaccagagcggcctgagcagctcctggctgagcctggagtgcaccgtgcacatcaacatccacatccccctgagcgccacctctgtgtcctacaccctggagaagaacaccaagaatggcctgacccgctgggccaaggagattgaaaatggagtgtacctgatcaatggccaggtgaaggatgaggactgtgacctgctggagggccagaagaagagcagccggggcaacacccaggccaccagccacagctttgatgtgcgggtgctgacccagctgctgctgaacagcgaccacaggagcacagccaccgtgcagatctgcagcggctctgtgaacctgaagggagctgtgaagtgccgggcctacatccacagcagcaagcccaaggtgaaggatgctgtgcaggccgtgaagagggacatcctgaacacagtggccgacagatgtgagatgctgtttgaggacctgctgctgaatgagatccctgagaagaaggacttctag

SEQ ID NO: 33045 - DNA, 240 bp, Artificial Sequence
  Description of Artificial Sequence: Synthetic coding sequence
atggccgcccccagcatgaaggagcggcaggtgtgctggggcgccagagatgagtactggaagtgcctggatgagaacctggaggatgccagccagtgcaagaagctgcggagcagctttgagagcagctgcccccagcagtggatcaagtactttgacaagagaagagactacctgaagttcaaggagaagtttgaagctggccagtttgagcccagcgagaccacagccaagagctag

SEQ ID NO: 33046 - DNA, 378 bp, Artificial Sequence
  Description of Artificial Sequence: Synthetic coding sequence
atgggccctgggggccccctgctgagccccagccggggcttcctgctgtgcaagacaggctggcacagcaaccggctgctgggggactgtggcccccacacccctgtgtccacagccctgtccttcatcgctgtgggcatggccgcccccagcatgaaggagcggcaggtgtgctggggcgccagagatgagtactggaagtgcctggatgagaacctggaggatgccagccagtgcaagaagctgcggagcagctttgagagcagctgcccccagcagtggatcaagtactttgacaagagaagagactacctgaagttcaaggagaagtttgaagctggccagtttgagcccagcgagaccacagccaagagctag

SEQ ID NO: 33047 - DNA, 468 bp, Artificial Sequence
  Description of Artificial Sequence: Synthetic coding sequence
atggtggccaggaagggccagaagagcccccgcttcagaagagtgtcctgcttcctgcggctgggccgcagcaccctgctggagctggagcccgccggccggccctgcagcggccgcaccaggcaccgggccctgcaccggcggctggtggcctgtgtgacagtgagcagccgccgccacaggaaggaggccggccggggccgggcagagagcttcatcgctgtgggcatggccgcccccagcatgaaggagcggcaggtgtgctggggcgccagagatgagtactggaagtgcctggatgagaacctggaggatgccagccagtgcaagaagctgcggagcagctttgagagcagctgcccccagcagtggatcaagtactttgacaagagaagagactacctgaagttcaaggagaagtttgaagctggccagtttgagcccagcgagaccacagccaagagctag

SEQ ID NO: 33048 - DNA, 471 bp, Artificial Sequence
  Description of Artificial Sequence: Synthetic coding sequence
atggtggccaggaagggccagaagagcccccgcttcagaagagtgtcctgcttcctgcggctgggccgcagcaccctgctggagctggagcccgccggccggccctgcagcggccgcaccaggcaccgggccctgcaccggcggctggtggcctgtgtgacagtgagcagccgccgccacaggaaggaggccggccggggccgggcagagagcagcttcatcgctgtgggcatggccgcccccagcatgaaggagcggcaggtgtgctggggcgccagagatgagtactggaagtgcctggatgagaacctggaggatgccagccagtgcaagaagctgcggagcagctttgagagcagctgcccccagcagtggatcaagtactttgacaagaggcgggactacctgaagttcaaggagaagtttgaggccggccagtttgagcccagcgagaccacagccaagagctag

SEQ ID NO: 33049 - DNA, 660 bp, Artificial Sequence
  Description of Artificial Sequence: Synthetic coding sequence
atggccagcggcagcaactggctgtctggagtgaatgtggtgctggtgatggcctacggcagcctggacctgaaggaggagattgacatccggctgagccgggtgcaggacatcaagtatgagccccagctgctggctgatgatgatgcccggctgctgcagctggagacccagggcaaccagagctgctacaactacctgtacaggatgaaggccctggatgccatccgcaccagcgagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagctgtgaaggcccgcatcggcagcagccagaggcaccaccagagcgctgccaaggacctgacccagagccctgaggtgagccccaccaccatccaggtgacctacctgcccagcagccagaagagcaagagggccaagcacttcctggagctgaagagcttcaaggacaactacaacaccctggagagcaccctgtag

SEQ ID NO: 33050 - DNA, 606 bp, Artificial Sequence
  Description of Artificial Sequence: Synthetic coding sequence
atggccagcggcagcaactggctgtctggagtgaatgtggtgctggtgatggcctacggcagcctggacctgaaggaggagattgacatccggctgagccgggtgcaggacatcaagtatgagccccagctgctggctgatgatgatgcccggctgctgcagctggagacccagggcaaccagaagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagctgtgaaggcccgcatcggcagcagccagaggcaccaccagagcgctgccaaggacctgacccagagccctgaggtgagccccaccaccatccaggtgacctacctgcccagcagccagaagagcaagagggccaagcacttcctggagctgaagagcttcaaggacaactacaacaccctggagagcaccctgtag

SEQ ID NO: 33051 - DNA, 468 bp, Artificial Sequence
  Description of Artificial Sequence: Synthetic coding sequence
atggccagcggcagcaactggctgtctggagtgaatgtggtgctggtgatggcctacggcagcctggacctgaaggaggagattgacatccggctgagccgggtgcaggacatcaagtatgagccccagctgctggctgatgatgatgcccggctgctgcagctggagacccagggcaaccagagctgctacaactacctgtacaggatgaaggccctggatgccatccgcaccagcgagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagcctag

SEQ ID NO: 33052 - DNA, 570 bp, Artificial Sequence
  Description of Artificial Sequence: Synthetic coding sequence
atggccagcggcagcaactggctgtctggagtgaatgtggtgctggtgatggcctacggcagcctggtgtttgtgctgctcttcatctttgtgaagaggcagatcatgagatttgccatgaagagcagaagaggcccccacgtgcctgtgggccacaatgcccccaaggacctgaaggaggagattgacatccggctgagccgggtgcaggacatcaagtatgagccccagctgctggctgatgatgatgcccggctgctgcagctggagacccagggcaaccagagctgctacaactacctgtacaggatgaaggccctggatgccatccgcaccagcgagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagcctag

SEQ ID NO: 33053 - DNA, 708 bp, Artificial Sequence
  Description of Artificial Sequence: Synthetic coding sequence
atggccagcggcagcaactggctgtctggagtgaatgtggtgctggtgatggcctacggcagcctggtgtttgtgctgctcttcatctttgtgaagaggcagatcatgagatttgccatgaagagcagaagaggcccccacgtgcctgtgggccacaatgcccccaaggacctgaaggaggagattgacatccggctgagccgggtgcaggacatcaagtatgagccccagctgctggctgatgatgatgcccggctgctgcagctggagacccagggcaaccagaagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagctgtgaaggcccgcatcggcagcagccagaggcaccaccagagcgctgccaaggacctgacccagagccctgaggtgagccccaccaccatccaggtgacctacctgcccagcagccagaagagcaagagggccaagcacttcctggagctgaagagcttcaaggacaactacaacaccctggagagcaccctgtag

SEQ ID NO: 33054 - DNA, 762 bp, Artificial Sequence
  Description of Artificial Sequence: Synthetic coding sequence
atggccagcggcagcaactggctgtctggagtgaatgtggtgctggtgatggcctacggcagcctggtgtttgtgctgctcttcatctttgtgaagaggcagatcatgagatttgccatgaagagcagaagaggcccccacgtgcctgtgggccacaatgcccccaaggacctgaaggaggagattgacatccggctgagccgggtgcaggacatcaagtatgagccccagctgctggctgatgatgatgcccggctgctgcagctggagacccagggcaaccagagctgctacaactacctgtacaggatgaaggccctggatgccatccgcaccagcgagatccccttccacagcgagggccgccaccccaggagcctgatgggcaagaacttccgcagctacctgctggacctgaggaacaccagcacccccttcaagggcgtgaggaaggccctgattgacaccctgctggatggctatgaaacagcccgctatggcaccggggtgtttggccagaatgagtacctgcgctaccaggaggccctgtctgagctggccacagctgtgaaggcccgcatcggcagcagccagaggcaccaccagagcgctgccaaggacctgacccagagccctgaggtgagccccaccaccatccaggtgacctacctgcccagcagccagaagagcaagagggccaagcacttcctggagctgaagagcttcaaggacaactacaacaccctggagagcaccctgtag

SEQ ID NO: 33055 - DNA, 1221 bp, Artificial Sequence
  Description of Artificial Sequence: Synthetic coding sequence
atgaggggctctgtggagtgcacctggggctggggccactgtgcccccagccccctgctgctgtggaccctgctgctgtttgctgcccccttcggcctgctgggggagaagacccggcaggtgtccctggaggtgatccccaactggctgggccccctgcagaacctgctgcacatccgggctgtgggcaccaacagcaccctgcactacgtgtggagcagcctgggccccctggccgtggtgatggtggccaccaacaccccccacagcaccctgtctgtgaactggagcctgctgctgagccctgagccagatggcggcctgatggtgctgcccaaggacagcatccagttcagcagcgccctggtgttcacccggctgctggagtttgacagcaccaacgtgtctgacacagctgccaagcccctgggccggccctacccaccctacagcctggccgacttctcctggaacaacatcacagacagcctggaccctgccaccctgagcgccaccttccagggccaccccatgaatgaccccaccaggacctttgccaacggcagcctggccttccgggtgcaggccttcagccgcagcagcaggcctgcccagcccccccggctgctgcacacagctgacacctgccagctggaggtggccctgattggagccagcccccggggcaacagaagcctgtttggcctggaggtggccaccctgggccagggccctgactgccccagcatgcaggagcagcacagcattgatgatgaatatgccccagctgtgttccagctggaccagctgctgtggggcagcctgcccagcggctttgcccagtggaggcctgtggcctacagccagaagccaggcggccgggagagcgccctgccctgccaggccagccccctgcacccagccctggcctacagcctgccccagagccccatcgtgcgggccttcttcggcagccagaacaacttctgtgccttcaacctgaccttcggggccagcacaggccctggctactgggaccagcactacctgtcctggagcatgctgctgggcgtgggcttcccccctgtggatggcctgagccccctggtgctgggcatcatggctgtggccctgggcgcccctggcctgatgctgctgggcggcggcctggtgctgctgctgcaccacaagaagtacagcgagtaccagagcatcaactag

SEQ ID NO: 33056 - DNA, 3765 bp, Artificial Sequence
  Description of Artificial Sequence: Synthetic coding sequence
atgaagaagcacagaagagccctggccctggtgtcctgcctcttcctgtgcagcctggtgtggctgcccagctggagggtgtgctgcaaggagagcagcagcgccagcgccagcagctactacagccaggatgacaactgtgccctggagaatgaagatgtgcagttccagaagaaggatgagcgggagggccccatcaatgctgagagcctgggcaagagcggcagcaacctgcccatcagccccaaggagcacaagctgaaggatgacagcatcgtggatgtgcagaacacagagagcaagaagctgagcccccctgtggtggagaccctgcccaccgtggacctgcacgaggagagcagcaatgctgtggtggacagcgagaccgtggagaacatcagcagcagcagcaccagcgagatcacccccatcagcaagctggatgaaattgagaagagcggcaccatccccatcgccaagcccagcgagacagagcagagcgagacagactgtgatgtgggggaggccctggatgccagcgcccccatcgagcagcccagctttgtgtccccaccagacagcctggtgggccagcacattgaaaatgtgagcagcagccacggcaagggcaagatcaccaagtcagaatttgagagcaaggtgtctgccagcgagcagggcggcggggaccccaagagcgccctgaatgccagtgacaacctgaagaatgaaagcagtgactacaccaagccaggggacatcgaccccacctctgtggccagccccaaggaccctgaggacatccccacctttgatgagtggaagaagaaggtgatggaggtggagaaggagaagagccagagcatgcacgccagcagcaatggaggcagccacgccaccaagaaggtgcagaagaacagaaacaactatgcctctgtggagtgtggggccaagatcctggccgccaaccctgaggccaagagcaccagcgccatcctgattgagaacatggacctgtacatgctgaacccctgcagcaccaagatctggtttgtgattgagctgtgtgagcccatccaggtgaagcagctggacatcgccaactatgagctgttcagcagcacccccaaggacttcctggtgtccatcagtgaccgctaccccaccaacaagtggatcaagctgggcaccttccacggcagagatgaaagaaatgtgcagagcttccccctggatgagcagatgtatgccaagtatgtgaagatgttcatcaagtacatcaaggtggagctgctgagccactttggaagtgagcacttctgccccctgagcctcatccgggtgtttggcacctccatggtggaggagtatgaggagattgctgacagccagtaccacagcgagcggcaggagctgtttgatgaagattatgactaccccctggactacaacacaggagaggacaagagcagcaagaacctgctgggcagcgccaccaatgccatcctgaacatggtgaacattgctgccaacatcctgggcgccaagacagaggacctgacagagggcaacaagagcatcagtgaaaatgccacagccacagctgcccccaagatgcctgagagcacccctgtgtccacccctgtgcccagcccagaatatgtgaccacagaggtgcacacccatgacatggagcccagcaccccagacacccccaaggagagccccatcgtgcagctggtgcaggaggaggaggaggaggccagccccagcacagtgaccctgctgggcagcggggagcaggaggatgagagcagcccctggtttgaaagtgagacccagatcttctgcagcgagctgaccaccatctgctgcatcagcagcttcagcgagtacatctacaagtggtgcagcgtgcgggtggccctgtaccggcagaggagcaggacagccctgagcaagggcaaggactacctggtgctggcccagccccccctgctgctgcctgctgagagcgtggatgtgtctgtgctgcagcccctgagcggggagctggagaacaccaacatcgagcgggaggccgagaccgtggtgctgggggacctgagcagctccatgcaccaggatgacctggtgaaccacacagtggatgctgtggagctggagcccagccacagccagaccctgagccagagcctgctgctggacatcaccccagagatcaaccccctgcccaagattgaggtgtctgagagcgtggagtatgaagctggccacatccccagccctgtgatcccccaggagagctctgtggagattgacaatgaaacagagcagaagtctgagagcttcagcagcattgagaagcccagcatcacctatgagaccaacaaggtgaatgagctgatggacaacatcatcaaggaggatgtgaacagcatgcagatcttcaccaagctgtctgagaccatcgtgccccccatcaacacagccaccgtgcctgacaatgaagatggagaggccaagatgaacattgctgacacagccaagcagaccctcatctctgtggtggacagcagcagcctgcctgaggtgaaggaggaggagcagagcccagaagatgccctgctgcggggcctgcagaggacagccacagacttctatgcagagctgcagaacagcacagacctgggctacgccaatggaaacctggtgcacggcagcaaccagaaggagagcgtcttcatgaggctgaacaaccgcatcaaggccctggaggtgaacatgagcctgagcggccgctacctggaggagctgagccagcgctacaggaagcagatggaggagatgcagaaggccttcaacaagaccatcgtgaagctgcagaacaccagcagaattgctgaggagcaggaccagaggcagacagaggccatccagctgctgcaggcccagctgaccaacatgacccagctggtgagcaacctgagcgccaccgtggccgagctgaagcgggaggtgtctgaccggcagagctacctggtgatcagcctggtgctgtgtgtggtgctgggcctgatgctgtgcatgcagcgctgcaggaacaccagccagtttgatggagactacatcagcaagctgcccaagagcaaccagtaccccagccccaagcgctgcttcagcagctatgatgacatgaacctgaagaggaggaccagcttccccctgatgaggagcaagagcctgcagctgaccgggaaggaggtggaccccaatgacctgtacatcgtggagcccctgaagttcagccctgagaagaagaagaagcgctgcaagtacaagattgagaagattgagaccatcaagccagaggagcccctgcaccccatcgccaacggggacatcaagggcaggaagcccttcaccaaccagagggacttcagcaacatgggagaggtgtaccacagcagctacaagggccccccatctgagggcagcagcgagaccagcagccagagcgaggagagctacttctgtggcatcagcgcctgcaccagcctgtgcaatggccagagccagaagaccaagacagagaagagggccctgaagagaagaagaagcaaggtgcaggaccagggcaagctgatcaagaccctcatccagaccaagagcggcagcctgcccagcctgcatgacatcatcaagggcaacaaggagatcaccgtgggcacctttggagtgacagctgtgtctggccacatctag

SEQ ID NO: 33057 - DNA, 4221 bp, Artificial Sequence
  Description of Artificial Sequence: Synthetic coding sequence
atgaggggcttcctggcccggcccttcctgagcaccaaccagcacctggcccagtggggcagccccctgccccagggcaagggcctggtgcagctgcccagccagcacaccaggcacagccggcccttccacgagctgtgcagcaaggaggagaacagcgccaccgtgcccaagctgatcagcctggtggtgagcagcgagaccatcgacttcagcaacaagaccatggacagcagaagagactgggagcgggagaagaggatcctggagggcaagctgcagctgcccaaggccctggcccggacccagagggccagagatgagggccggcgggcctggaccagccgctggctgcagaggagaagaagccctgagagctgtgaggcccccctgagcgcccccctgtggggcccccagaggggcctgcccggccgggagcccctgcggagccgcagcgccagcgccatcgccctgcggaccatcggccacatcctggccctgctgctgcggctgctgcacctgggcctgggcagcggcggctgcagagaagatgtgccccccagcggccggggcaagaaggaggagaagatgaagaagcacagaagagccctggccctggtgtcctgcctcttcctgtgcagcctggtgtggctgcccagctggagggtgtgctgcaaggagagcagcagcgccagcgccagcagctactacagccaggatgacaactgtgccctggagaatgaagatgtgcagttccagaagaagaacacagagagcaagaagctgagcccccctgtggtggagaccctgcccaccgtggacctgcacgaggagagcagcaatgctgtggtggacagcgagaccgtggagaacatcagcagcagcagcaccagcgagatcacccccatcagcaagctggatgaaattgagaagagcggcaccatccccatcgccaagcccagcgagacagagcagagcgagacagactgtgatgtgggggaggccctggatgccagcgcccccatcgagcagcccagctttgtgagccccccagacagcctggtgggccagcacattgaaaatgtgagcagcagccacggcaagggcaagatcaccaagtcagaatttgagagcaaggtgtctgccagcgagcagggcggcggggaccccaagagcgccctgaatgccagtgacaacctgaagaatgaaagcagtgactacaccaagccaggggacatcgaccccacctctgtggccagccccaaggaccctgaggacatccccacctttgatgagtggaagaagaaggtgatggaggtggagaaggagaagagccagagcatgcacgccagcagcaatggaggcagccacgccaccaagaaggtgcagaagaacagaaacaactatgcctctgtggagtgtggggccaagatcctggccgccaaccctgaggccaagagcaccagcgccatcctgattgagaacatggacctgtacatgctgaacccctgcagcaccaagatctggtttgtgattgagctgtgtgagcccatccaggtgaagcagctggacatcgccaactatgagctgttcagcagcacccccaaggacttcctggtgtccatcagtgaccgctaccccaccaacaagtggatcaagctgggcaccttccacggcagagatgaaagaaatgtgcagagcttccccctggatgagcagatgtatgccaagtatgtgaaggtggagctgctgagccactttggaagtgagcacttctgccccctgagcctcatccgggtgtttggcacctccatggtggaggagtatgaggagattgctgacagccagtaccacagcgagcggcaggagctgtttgatgaagattatgactaccccctggactacaacacaggagaggacaagagcagcaagaacctgctgggcagcgccaccaatgccatcctgaacatggtgaacattgctgccaacatcctgggcgccaagacagaggacctgacagagggcaacaagagcatcagtgaaaatgccacagccacagctgcccccaagatgcctgagagcacccctgtgtccacccctgtgcccagcccagaatatgtgaccacagaggtgcacacccatgacatggagcccagcaccccagacacccccaaggagagccccatcgtgcagctggtgcaggaggaggaggaggaggccagccccagcacagtgaccctgctgggcagcggggagcaggaggatgagagcagcccctggtttgaaagtgagacccagatcttctgcagcgagctgaccaccatctgctgcatcagcagcttcagcgagtacatctacaagtggtgcagcgtgcgggtggccctgtaccggcagaggagcaggacagccctgagcaagggcaaggactacctggtgctggcccagccccccctgctgctgcctgctgagagcgtggatgtgtctgtgctgcagcccctgagcggggagctggagaacaccaacatcgagcgggaggccgagaccgtggtgctgggggacctgagcagctccatgcaccaggatgacctggtgaaccacacagtggatgctgtggagctggagcccagccacagccagaccctgagccagagcctgctgctggacatcaccccagagatcaaccccctgcccaagattgaggtgtctgagagcgtggagtatgaagctggccacatccccagccctgtgatcccccaggagagctctgtggagattgacaatgaaacagagcagaagtctgagagcttcagcagcattgagaagcccagcatcacctatgagaccaacaaggtgaatgagctgatggacaacatcatcaaggaggatgtgaacagcatgcagatcttcaccaagctgtctgagaccatcgtgccccccatcaacacagccaccgtgcctgacaatgaagatggagaggccaagatgaacattgctgacacagccaagcagaccctcatctctgtggtggacagcagcagcctgcctgaggtgaaggaggaggagcagagcccagaagatgccctgctgcggggcctgcagaggacagccacagacttctatgcagagctgcagaacagcacagacctgggctacgccaatggaaacctggtgcacggcagcaaccagaaggagagcgtcttcatgaggctgaacaaccgcatcaaggccctggaggtgaacatgagcctgagcggccgctacctggaggagctgagccagcgctacaggaagcagatggaggagatgcagaaggccttcaacaagaccatcgtgaagctgcagaacaccagcagaattgctgaggagcaggaccagaggcagacagaggccatccagctgctgcaggcccagctgaccaacatgacccagctggtgagcaacctgagcgccaccgtggccgagctgaagcgggaggtgtctgaccggcagagctacctggtgatcagcctggtgctgtgtgtggtgctgggcctgatgctgtgcatgcagcgctgcaggaacaccagccagtttgatggagactacatcagcaagctgcccaagagcaaccagtaccccagccccaagcgctgcttcagcagctatgatgacatgaacctgaagaggaggaccagcttccccctgatgaggagcaagagcctgcagctgaccgggaaggaggtggaccccaatgacctgtacatcgtggagcccctgaagttcagccctgagaagaagaagaagcgctgcaagtacaagattgagaagattgagaccatcaagccagaggagcccctgcaccccatcgccaacggggacatcaagggcaggaagcccttcaccaaccagagggacttcagcaacatgggagaggtgtaccacagcagctacaagggccccccatctgagggcagcagcgagaccagcagccagagcgaggagagctacttctgtggcatcagcgcctgcaccagcctgtgcaatggccagagccagaagaccaagacagagaagagggccctgaagagaagaagaagcaaggtgcaggaccagggcaagctgatcaagaccctcatccagaccaagagcggcagcctgcccagcctgcatgacatcatcaagggcaacaaggagatcaccgtgggcacctttggagtgacagctgtgtctggccacatctag

SEQ ID NO: 33058 - DNA, 1227 bp, Artificial Sequence
  Description of Artificial Sequence: Synthetic coding sequence
atgcctgtgatcagcagccggcaggactgtgacagcgccaccagcacagtgacagacatcctgtgtgccgctgaggtgaagagcagcaagggcacagaagatcggggccgcatcctgggggacagcaacctgcaggtgtccaagctgctgagccagttccccctgaagagcacagagaccagcaaggtgcctgacaacaagaatgtgctggacaagaccagggtgaccaaggacttcctgcaggacaacctcttcagcggccctggccccaaggagcccaccggcctgagccccttcctgctgctgcccccccggcccccaccagcccggccagacaagctgcctgagctgcctgcccagaagaggcagctgcctgtgtttgccaagatctgcagcaagcccaaggctgaccctgctgtggagcggcaccacctgatggagtggagccctggcaccaaggagcccaagaagggccagggcagcctcttcctgagccagtggccccagagccagaaggatgcctgtggggaggagggctgctgtgatgctgtgggcacagccagcctgaccctgccccccaagaagcccacctgcccagctgagaagaacctgctgtatgagttcctgggcgccaccaagaaccccagcggccagccccggctgaggaacaaggtggaggtggatggccctgagctgaagttcaatgcccctgtgacagtggccgacaagaacaaccccaagtacacaggaaatgtgttcaccccccacttccccacagccatgaccagcgccaccctgaaccagcccctgtggctgaacctgaactacccacctcctcctgtgttcaccaaccacagcaccttcctgcagtaccagggcctgtacccccagcaggccgccaggatgccctaccagcaggccctgcacccccagctgggctgctacagccagcaggtgatgccctacaacccccagcagatgggccagcagatcttccgcagcagctacacccccctgctgagctacatcccctttgtgcagcccaactacccctacccccagaggaccccacccaagatgtctgccaacccccgggacccccccctgatggctggagatggcccccagtacctgttcccccagggctacggcttcggcagcaccagcggcggccccctgatgcacagcccctacttcagcagcagtggaaatggcatcaacttctag

SEQ ID NO: 33059 - DNA, 1797 bp, Artificial Sequence
  Description of Artificial Sequence: Synthetic coding sequence
atgagaggaggcggcggctgtgtgctggccctgggcggccagaggggcttccagaaggagaggaggaggatggccagcggaaatggcctgcccagcagcagcgccctggtggccaagggcccctgtgccctgggccccttcccccgctacatctggatccaccaggacaccccccaggacagcctggacaagacctgccacgagatctggaagagggtgcagggcctgcctgaggccagccagccctggacctccatggagcagctgtctgtgcctgtggtgggcaccctgcggggaaatgagctgtccttccaggaggaggccctggagctgagcagcggcaaggatgagatcagcctgctggtggagcaggagttcctgagcctgaccaaggagcacagcatcctggtggaggagagcagtggagagctggaggtgcccggcagcagccctgagggcacccgggagctggccccctgcatcctggccccacccctggtggccggcagcaatgaaagaccccgggccagcatcatcgtgggggacaagctgctgaagcagaaggtggccatgcctgtgatcagcagccggcaggactgtgacagcgccaccagcacagtgacagacatcctgtgtgccgctgaggtgaagagcagcaagggcacagaagatcggggccgcatcctgggggacagcaacctgcaggtgtccaagctgctgagccagttccccctgaagagcacagagaccagcaaggtgcctgacaacaagaatgtgctggacaagaccagggtgaccaaggacttcctgcaggacaacctcttcagcggccctggccccaaggagcccaccggcctgagccccttcctgctgctgcccccccggcccccaccagcccggccagacaagctgcctgagctgcctgcccagaagaggcagctgcctgtgtttgccaagatctgcagcaagcccaaggctgaccctgctgtggagcggcaccacctgatggagtggagccctggcaccaaggagcccaagaagggccagggcagcctcttcctgagccagtggccccagagccagaaggatgcctgtggggaggagggctgctgtgatgctgtgggcacagccagcctgaccctgccccccaagaagcccacctgcccagctgagaagaacctgctgtatgagttcctgggcgccaccaagaaccccagcggccagccccggctgaggaacaaggtggaggtggatggccctgagctgaagttcaatgcccctgtgacagtggccgacaagaacaaccccaagtacacaggaaatgtgttcaccccccacttccccacagccatgaccagcgccaccctgaaccagcccctgtggctgaacctgaactacccacctcctcctgtgttcaccaaccacagcaccttcctgcagtaccagggcctgtacccccagcaggccgccaggatgccctaccagcaggccctgcacccccagctgggctgctacagccagcaggtgatgccctacaacccccagcagatgggccagcagatcttccgcagcagctacacccccctgctgagctacatcccctttgtgcagcccaactacccctacccccagaggaccccacccaagatgtctgccaacccccgggacccccccctgatggctggagatggcccccagtacctgttcccccagggctacggcttcggcagcaccagcggcggccccctgatgcacagcccctacttcagcagcagtggaaatggcatcaacttctag

SEQ ID NO: 33060 - DNA, 426 bp, Artificial Sequence
  Description of Artificial Sequence: Synthetic coding sequence
atggagcccagccacaaggatgctgagacagctgctgctgctgctgctgtggccgctgctgaccccaggggggccagcagcagcagtggagtggtggtgcaggtgcgggagaagaagggccccctgcgggccgccatcccctacatgcccttccctgtggccgtcatctgcctcttcctgaacacctttgtgcccggcctgggcacctttgtgtctgccttcaccgtgctgtgtggggccaggacagacctgcctgacagacatgtgtgctgcgtgttctggctgaacattgctgctgccctgatccagatcctgacagccatcgtgatggtgggctggatcatgagcatcttctggggcatggacatggtgatcctggccatcagccagggctacaaggagcagggcatcccccagcagctgtag

SEQ ID NO: 33061 - DNA, 426 bp, Artificial Sequence
  Description of Artificial Sequence: Synthetic coding sequence
atggagcccagccacaaggatgctgagacagctgctgctgctgctgctgtggccgctgctgaccccaggggggccagcagcagcagtggagtggtggtgcaggtgcgggagaagaagggccccctgcgggccgccatcccctacatgcccttccctgtggccgtcatctgcctcttcctgaacacctttgtgcccggcctgggcacctttgtgtctgccttcaccgtgctgtgtggggccaggacagacctgcctgacagacatgtgtgctgcgtgttctggctgaacattgctgctgccctgatccagatcctgacagccatcgtgatggtgggctggatcatgagcatcttctggggcatggacatggtgatcctggccaccagcacaggctacaaggagcagggcatcccccagcagctgtag

SEQ ID NO: 33062 - DNA, 639 bp, Artificial Sequence
  Description of Artificial Sequence: Synthetic coding sequence
atgaggagccggctgctgctgtctgtggcccacctgcccaccatccgggagaccacagaggagatgctgctgggcggccctggccaggagcccccacccagccccagcctggatgattatgtgcgcagcatcagccggctggcccagcccacctctgtgctggacaaggccacagcccagggccagcccaggcctccccacaggcctgcccaggcctgcaggaagggccggcctgctgtgtccctgcgggacatcacagcccgcttcagcggccagcagcccaccctgcccatggctgacacagtggaccccctggactggctgtttggagagagccaggagaagcagcccagccagagggacctgcccaggagaacaggccccagcgctggcctgtggggcccccaccggcagatggacagcagcaagcccatgggcgccccccggggccgcctgtgtgaggccaggatgcctggccacagcctggcccggcccccccaggacggccagcagagcagtgacctgcgctcctggaccttcggccagagcgcccaggccatggccagccgccaccggccccggcccagctctgtgctgcggaccctgtacagccacctgcctgtgatccacgagctgtag

SEQ ID NO: 33063 - DNA, 384 bp, Artificial Sequence
  Description of Artificial Sequence: Synthetic coding sequence
atgaggagccggctgctgctgtctgtggcccacctgcccaccatccgggagaccacagaggagatgctgctgggcggccctggccaggagcccccacccagccccagcctggatgattatgtgcgcagcatcagccggctggcccagcccacctctgtgctggacaaggccacagcccagggccagcccaggcctccccacaggcctgcccaggcctgcaggaagggccggcctgctgtgtccctgctggccagcggcgtgcacatcgaccgctggacagctgccagcccctggggccccccagagggcggctctgtgaagccaggctgcctgggcatcccctggcaggaccacaggaggatgggcagccgggccctgacctag

SEQ ID NO: 33064 - DNA, 255 bp, Artificial Sequence
  Description of Artificial Sequence: Synthetic coding sequence
atgaggagccggctgctgctgtctgtggcccacctgcccaccatccgggagaccacagaggagatgctgctgggcggccctggccaggagcccccacccagccccagcctggatgattatgtgcgcagcatcagccggctggcccagcccacctctgtgctggacaaggccacagcccagggccagcccaggcctccccacaggcctgcccaggcctgcaggaagggccggcctgctgtgtccctgcgggactag

SEQ ID NO: 33065 - DNA, 504 bp, Artificial Sequence
  Description of Artificial Sequence: Synthetic coding sequence
ctgggcctgctggtggagcggcaggagagcgagggcctgccccgggtgcggccccctgtgcacggccggccccaggccacagctgctggcatcaccggggccatgagcacagagggccccagcctggccagcagccctgccatcagccccctggccttcctgagcgcccctgtgaccccaggcaccctggccgaggccacagaccccctgcccatgctgattgccctggcctgcatcttcctgctgctggccacctgcctgctcttcatgaccctgtgcaagccagctgccctggaccccagcagaagaagagcccacgagtgcatgccccaccaccctggcagccccagcgagccccagctgcggctgtggaagaggctgggcagcctgcggctgagcctgcacagcttcagacatggccggcccaccgtgccccggcagcccctgcccggccctgaggacaacagaagccactgtgactacatggagagcaccaagatgtag

SEQ ID NO: 33066 - DNA, 402 bp, Artificial Sequence
  Description of Artificial Sequence: Synthetic coding sequence
atgagcacagagggccccagcctggccagcagccctgccatcagccccctggccttcctgagcgcccctgtgaccccaggcaccctggccgaggccacagaccccctgcccatgctgattgccctggcctgcatcttcctgctgctggccacctgcctgctcttcatgaccctgtgcaagccagctgccctggaccccagcagaagaagagcccacgagtgcatgccccaccaccctggcagccccagcgagccccagctgcggctgtggaagaggctgggcagcctgcggctgagcctgcacagcttcagacatggccggcccaccgtgccccggcagcccctgcccggccctgaggacaacagaagccactgtgactacatggagagcaccaagatgtag

SEQ ID NO: 33067 - DNA, 402 bp, Artificial Sequence; identical to SEQ ID NO: 33066
  Description of Artificial Sequence: Synthetic coding sequence

SEQ ID NO: 33068 - DNA, 468 bp, Artificial Sequence
  Description of Artificial Sequence: Synthetic coding sequence
atggagagcctgcagaccccccagcaccgggagaaccaggacaagcgggagaaggagtatggagtgaagcacatgcccatgggcaacaatgccggcaacctggagcctgagaagaggaaggctgtgcgggtggccctgagcagcgccacagctgcccagaacatccccagctctgtgcactgcggctgcagcaagcagtggaggctgcggctgcccagcgagagcctgcagagccggggccaggtgatgaagaggcccaacaacatcctgaagctgaggaacctggacctgctgatctacccctggccagagctgcggcggcggcaggtggccagtgacctgatgagcctgctgctgctgcctgccttcagcggcctgacctgggcccccttcctgttcctgttcacctacctgccccccttcctgaacctgctgactgtgggctttgtgtcctacttcctggtgtag

SEQ ID NO: 33069 - DNA, 1524 bp, Artificial Sequence
  Description of Artificial Sequence: Synthetic coding sequence
tgagaatgtccccggggccgcagcgccctgctgaagggccccccccaggagaagcccaacagaagaagtgccctgctgtctgtgggggagatcagcgagctgtgcccagagatcacagacttcctgtgccgggacaagaagtgcatcgccagccacctgctgtgtgactacaagccagactgcagcgacagaagtgatgaggcccactgtgcccactacaccagcaccaccggcagctgcaactttgagaccagcagcggcaactggaccacagcctgcagcctgacccaggacagtgaagatgacctggactgggccatcggcagccgcatcccagccaaggccctgatcccagacagcgaccacaccccaggcagcggccagcacttcctgtatgtgaacagcagcggcagcaaggagggctctgtggcccgcatcaccaccagcaagagcttccctgccagcctgggcatgtgcaccgtgcgcttctggttctacatgattgaccccaggtccatgggcatcctgaaggtgtacaccatcgaggagagcggcctgaacatcctggtgtggagcgtcatcggcaacaagaggacaggctggacctacggctctgtgcccctgagcagcaacagccccttcaaggtggcctttgaggccgacctggatggaaatgaagacatcttcatcgccctggatgacatctccttcaccccagaatgtgtgactggaggccctgtgcctgtgcagcccagcccctgtgaggccgaccagttcagctgcatctacaccctgcagtgtgtgcccctgtctggaaaatgtgatggccacgaggactgcattgatggcagtgatgagatggactgccccctgagccccaccccacccctgtgcagcaacatggagttcccctgcagcacagatgagtgcatccccagcctgctgctgtgtgatggagtgcctgactgccacttcaatgaagatgagctgatctgcagcaacaagagctgcagcaatggagccctggtgtgtgccagcagcaacagctgcatcccagcccaccagagatgtgatggctttgctgactgcatggacttccagctggatgagagcagctgcagtgaatgtcccctgaactactgcagaaatggaggcacctgtgtggtggagaagaatggccccatgtgccgctgccggcagggctggaagggcaaccgctgccacatcaagttcaaccccccagccacagacttcacctacgcccagaacaacacctggaccctgctgggcatcggcctggccttcctgatgacccacatcaccgtggccgtgctgtgcttcctggccaacaggaaggtgcccatcaggaagacagagggcagcggcaactgtgcctttgtgaaccctgtgtatggcaactggagcaaccctgagaagacagagagctctgtgtacagcttcagcaaccccctgtatggcaccaccagcggcagcctggagaccctgagccaccacctgaagtag

SEQ ID NO: 33070 - DNA, 4461 bp, Artificial Sequence
  Description of Artificial Sequence: Synthetic coding sequence
ccccgggaccacagcctgaatgccagccagggccacttcatgttcatcctgaagaagagcagcagcctgtggcaggtggccaagctgcagagccccaccttcagccagacaggccctggctgcatcctgtccttctggttctacaactacggcctgtctgtgggcgctgctgagctgcagctgcacatggagaacagccatgacagcaccgtcatctggagggtgctgtacaaccagggcaagcagtggctggaggccaccatccagctgggccgcctgagccagcccttccacctgagcctggacaaggtgtccctgggcatctatgatggagtgtctgccattgatgacatccgctttgagaactgcaccctgcccctgcctgctgagagctgtgagggcctggaccacttctggtgccgccacacccgggcctgcatcgagaagctgcggctgtgtgacctggtggatgactgtggggacagaacagatgaggtgaactgtgcccctgagctgcagtgcaactttgagaccggcatctgcaactgggagcaggatgccaaggatgactttgactggaccaggagccagggccccacccccaccctgaacacaggccccatgaaggacaacaccctgggcacagccaagggccactacctgtacatcgagagcagcgagccccaggccttccaggacagcgctgccctgctgagccccatcctgaatgccacagacaccaagggctgcaccttccgcttctactaccacatgtttgggaagaggatctaccgcctggccatctaccagaggatctggagcgacagccggggccagctgctgtggcagatctttggaaaccagggcaaccgctggatcaggaagcacctgaacatcagcagccggcagcccttccagatcctggtggaggcctctgtgggagatggcttcaccggggacatcgccattgatgacctgtccttcatggactgcaccctgtacccaggcaacctgcctgctgacctgcccaccccacctgagacctctgtgcctgtgaccctgcccccccacaactgcacagacaatgagttcatctgccgcagtgatggccactgcatcgagaagatgcagaagtgtgacttcaagtatgactgcccagacaagagtgatgaggccagctgtgtgatggaggtgtgcagctttgagaagaggagcctgtgcaagtggtaccagcccatccctgtgcacctgctgcaggacagcaacaccttccgctggggcctgggcaatggcatcagcatccaccacggggaggagaaccaccggcccagcgtggaccacacccagaacaccacagatggctggtacctgtatgctgacagcagcaatggcaagtttggagacacagctgacatcctgacccccatcatcagcctgaccggccccaagtgcaccctggtgttctggacccacatgaatggagccaccgtgggcagcctgcaggtgctgatcaagaaggacaacgtgaccagcaagctgtgggcccagacaggccagcagggcgcccagtggaagagagctgaggtgttcctgggcatccgcagccacacccagatcgtgttccgggccaagaggggcatctcctacatcggagatgtggccgtggatgacatctccttccaggactgcagccccctgctgagccctgagaggaagtgcacagaccacgagttcatgtgtgccaacaagcactgcatcgccaaggacaagctgtgtgactttgtgaatgactgtgccgacaacagtgatgagaccaccttcatctgcaggaccagcagcggccgctgtgactttgaatttgacctgtgctcctggaagcaggagaaggatgaagattttgactggaacctgaaggccagcagcatcccagctgctggaacagagcctgctgctgaccacaccctgggcaacagcagcggccactacatcttcatcaagagcctcttcccccagcagcccatgagagctgcccgcatcagcagccctgtgatcagcaagaggagcaagaactgcaagatcatcttccactaccacatgtatggaaatggcatcggggccctgaccctgatgcaggtgtctgtgaccaaccagaccaaggtgctgctgaacctgactgtggagcagggcaacttctggaggcgggaggagctgagcctgtttggagatgaggacttccagctgaagtttgagggccgggtgggcaagggccagagaggagacatcgccctggatgacatcgtgctgacagagaactgcctgagcctgcatgacagcgtgcaggaggagctggccgtgcccctgcccaccggcttctgccccctgggctaccgggagtgccacaacgggaagtgctaccgcctggagcagagctgcaactttgtggacaactgtggggacaacacagatgaaaatgaatgtggcagcagctgcacctttgagaagggctggtgtggctggcagaacagccaggccgacaactttgactgggtgctgggcgtgggcagccaccagagcctgcggccccccaaggaccacaccctgggcaatgaaaatgccatcctgctgatgagaagacacaagtaccccatccgctctgtgaacctgcacacagtgaagcacgtgctgaaggcccagacagtgggcaactgcagcgtgtccaagctggaggcccggctgctggacttcctgtctgtgcccaatgaaaacaccttcggcagcagtgaccacaccaactggcacttcatgtacctggaggccacagctgtgggcctgcggggggacaaggcccacttccgcagcaccatgtggagggagagcagcgctgcctgcaccatgtccttctggtactttgtgtctgccaaggccaccggcagcatccagatcctgatcaagagaggaagaagaagaagaagagcccccaaccctgtgctgagcggcagccccaccatcccccggcagggcagccagcagctgggcggctggaggggcggcagcgcccggcaccgggcccgggccttccctgagcctgagtgcccccggggccgcagcgccctgctgaagggccccccccaggagaagcccaacagaagaagtgccctgctgtctgtgggggagatcagcgagctgtgcccagagatcacagacttcctgtgccgggacaagaagtgcatcgccagccacctgctgtgtgactacaagccagactgcagcgacagaagtgatgaggcccactgtgcccactacaccagcaccaccggcagctgcaactttgagaccagcagcggcaactggaccacagcctgcagcctgacccaggacagtgaagatgacctggactgggccatcggcagccgcatcccagccaaggccctgatcccagacagcgaccacaccccaggcagcggccagcacttcctgtatgtgaacagcagcggcagcaaggagggctctgtggcccgcatcaccaccagcaagagcttccctgccagcctgggcatgtgcaccgtgcgcttctggttctacatgattgaccccaggtccatgggcatcctgaaggtgtacaccatcgaggagagcggcctgaacatcctggtgtggagcgtcatcggcaacaagaggacaggctggacctacggctctgtgcccctgagcagcaacagccccttcaaggtggcctttgaggccgacctggatggaaatgaagacatcttcatcgccctggatgacatctccttcaccccagaatgtgtgactggaggccctgtgcctgtgcagcccagcccctgtgaggccgaccagttcagctgcatctacaccctgcagtgtgtgcccctgtctggaaaatgtgatggccacgaggactgcattgatggcagtgatgagatggactgccccctgagccccaccccacccctgtgcagcaacatggagttcccctgcagcacagatgagtgcatccccagcctgctgctgtgtgatggagtgcctgactgccacttcaatgaagatgagctgatctgcagcaacaagagctgcagcaatggagccctggtgtgtgccagcagcaacagctgcatcccagcccaccagagatgtgatggctttgctgactgcatggacttccagctggatgagagcagctgcagcgacacctggaccctgctgggcatcggcctggccttcctgatgacccacatcaccgtggccgtgctgtgcttcctggccaacaggaaggtgcccatcaggaagacagagggcagcggcaactgtgcctttgtgaaccctgtgtatggcaactggagcaaccctgagaagacagagagctctgtgtacagcttcagcaaccccctgtatggcaccaccagcggcagcctggagaccctgagccaccacctgaagtag

SEQ ID NO: 33071 - DNA, 777 bp, Artificial Sequence
  Description of Artificial Sequence: Synthetic coding sequence
ctgaagtttgagggccgggtgggcaagggccagagaggagacatcgccctggatgacatcgtgctgacagagaactgcctgagcctgcatgacagcgtgcaggaggagctggccgtgcccctgcccaccggcttctgccccctgggctaccgggagtgccacaacgggaagtgctaccgcctggagcagagctgcaactttgtggacaactgtggggacaacacagatgaaaatgaatgtggcagcagctgcacctttgagaagggctggtgtggctggcagaacagccaggccgacaactttgactgggtgctgggcgtgggcagccaccagagcctgcggccccccaaggaccacaccctgggcaatgaaaatggccacttcatgtacctggaggccacagctgtgggcctgcggggggacaaggcccacttccgcagcaccatgtggagggagagcagcgctgcctgcaccatgtccttctggtactttgtgtctgccaaggccaccggcagcatccagatcctgatcaagacagagaagggcctgagcaaggtgtggcaggagagcaagcagaaccctggcaaccactggcagaaggctgacatcctgctgggcaagctgaggaactttgaagtcatcttccagggcatccgcacccgggacctgggcggcggggccgccattgatgacatcgagttcaagaactgcaccaccgtgggggagatcagcgagctgtgcccagagatcacagacttcctgtgccgggacaagtag

SEQ ID NO: 33072 - DNA, 4422 bp, Artificial Sequence
  Description of Artificial Sequence: Synthetic coding sequence
atgttcatcctgaagaagagcagcagcctgtggcaggtggccaagctgcagagccccaccttcagccagacaggccctggctgcatcctgtccttctggttctacaactacggcctgtctgtgggcgctgctgagctgcagctgcacatggagaacagccatgacagcaccgtcatctggagggtgctgtacaaccagggcaagcagtggctggaggccaccatccagctgggccgcctgagccagcccttccacctgagcctggacaaggtgtccctgggcatctatgatggagtgtctgccattgatgacatccgctttgagaactgcaccctgcccctgcctgctgagagctgtgagggcctggaccacttctggtgccgccacacccgggcctgcatcgagaagctgcggctgtgtgacctggtggatgactgtggggacagaacagatgaggtgaactgtgcccctgagctgcagtgcaactttgaaacaggcatctgcaactgggagcaggatgccaaggatgactttgactggaccaggagccagggccccacccccaccctgaacacaggccccatgaaggacaacaccctgggcacagccaagggccactacctgtacatcgagagcagcgagccccaggccttccaggacagcgctgccctgctgagccccatcctgaatgccacagacaccaagggctgcaccttccgcttctactaccacatgtttgggaagaggatctaccgcctggccatctaccagaggatctggagcgacagccggggccagctgctgtggcagatcttcggcaaccagggcaaccgctggatcaggaagcacctgaacatcagcagccggcagcccttccagatcctggtggaggcctctgtgggagatggcttcaccggggacatcgccattgatgacctgtccttcatggactgcaccctgtacccaggcaacctgcctgctgacctgcccaccccacctgagacctctgtgcctgtgaccctgcccccccacaactgcacagacaatgagttcatctgccgcagtgatggccactgcatcgagaagatgcagaagtgtgacttcaagtatgactgcccagacaagagtgatgaggccagctgtgtgatggaggtgtgcagctttgagaagaggagcctgtgcaagtggtaccagcccatccctgtgcacctgctgcaggacagcaacaccttccgctggggcctgggcaatggcatcagcatccaccacggggaggagaaccaccggcccagcgtggaccacacccagaacaccacagatggctggtacctgtatgctgacagcagcaatggcaagtttggagacacagctgacatcctgacccccatcatcagcctgaccggccccaagtgcaccctggtgttctggacccacatgaatggagccaccgtgggcagcctgcaggtgctgatcaagaaggacaacgtgaccagcaagctgtgggcccagacaggccagcagggcgcccagtggaagagagctgaggtgttcctgggcatccgcagccacacccagatcgtgttccgggccaagaggggcatctcctacatcggagatgtggccgtggatgacatctccttccaggactgcagccccctgctgagccctgagaggaaatgtacagaccacgagttcatgtgtgccaacaagcactgcatcgccaaggacaagctgtgtgactttgtgaatgactgtgccgacaacagtgatgagaccaccttcatctgcaggaccagcagcggccgctgtgactttgaatttgacctgtgctcctggaagcaggagaaggatgaggactttgactggaacctgaaggccagcagcatcccagctgctggaacagagcctgctgctgaccacaccctgggcaacagcagcggccactacatcttcatcaagagcctcttcccccagcagcccatgagagctgcccgcatcagcagccctgtgatcagcaagaggagcaagaactgcaagatcatcttccactaccacatgtatggaaatggaattggagccctgaccctgatgcaggtgtctgtgaccaaccagaccaaggtgctgctgaacctgactgtggagcagggcaacttctggaggcgggaggagctgagcctgtttggagatgaggacttccagctgaagtttgagggccgggtgggcaagggccagagaggagacatcgccctggatgacatcgtgctgacagagaactgcctgagcctgcatgattctgtgcaggaggagctggccgtgcccctgcccaccggcttctgccccctgggctaccgggagtgccacaacgggaagtgctaccgcctggagcagagctgcaactttgtggacaactgtggggacaacacagatgaaaatgaatgtggcagcagctgcacctttgagaagggctggtgtggctggcagaacagccaggccgacaactttgactgggtgctgggcgtgggcagccaccagagcctgcggccccccaaggaccacaccctgggcaatgaaaatgccatcctgctgatgaggaggcacaagtaccccatccgctctgtgaacctgcacacagtgaagcacgtgctgaaggcccagacagtgggcaactgcagcgtgtccaagctggaggcccggctgctggacttcctgtctgtgcccaatgaaaacaccttcggcagcagtgaccacaccaactggcacttcatgtacctggaggccacagctgtgggcctgcggggggacaaggcccacttccgcagcaccatgtggagggagagcagcgctgcctgcaccatgtccttctggtactttgtgtctgccaaggccaccggcagcatccagatcctgatcaagagaggaagaagaagaagaagagcccccaaccctgtgctgagcggcagccccaccatcccccggcagggcagccagcagctgggcggctggaggggcggcagcgcccggcaccgggcccgggccttccctgagccagaatgtccccggggccgcagcgccctgctgaagggccccccccaggagaagcccaacagaagaagtgccctgctgtctgtgggggagatcagcgagctgtgcccagagatcacagacttcctgtgccgggacaagaagtgcatcgccagccacctgctgtgtgactacaagccagactgcagcgacagaagtgatgaggcccactgtgcccactacaccagcaccaccggcagctgcaactttgagaccagcagcggcaactggaccacagcctgcagcctgacccaggacagtgaagatgacctggactgggccatcggcagccgcatcccagccaaggccctgatcccagacagcgaccacaccccaggcagcggccagcacttcctgtatgtgaacagcagcggcagcaaggagggctctgtggcccgcatcaccaccagcaagagcttccctgccagcctgggcatgtgcaccgtgcgcttctggttctacatgattgaccccaggtccatgggcatcctgaaggtgtacaccatcgaggagagcggcctgaacatcctggtgtggagcgtgattggcaacaagaggacaggctggacctacggctctgtgcccctgagcagcaacagccccttcaaggtggcctttgaagctgacctggatggaaatgaagacatcttcatcgccctggatgacatctccttcaccccagaatgtgtgactggaggccctgtgcctgtgcagcccagcccctgtgaggccgaccagttcagctgcatctacaccctgcagtgtgtgcccctgagcgggaaatgtgatggccacgaggactgcattgatggcagtgatgagatggactgccccctgagccccaccccacccctgtgcagcaacatggagttcccctgcagcacagatgagtgcatccccagcctgctgctgtgtgatggagtgcctgactgccacttcaatgaagatgagctgatctgcagcaacaagagctgcagcaatggagccctggtgtgtgccagcagcaacagctgcatcccagcccaccagagatgtgatggctttgctgactgcatggacttccagctggatgagagcagctgcagcgacacctggaccctgctgggcatcggcctggccttcctgatgacccacatcaccgtggccgtgctgtgcttcctggccaacaggaaggtgcccatcaggaagacagagggcagcggcaactgtgcctttgtgaaccctgtgtatggcaactggagcaaccctgagaagacagagagctctgtgtacagcttcagcaaccccctgtatggcaccaccagcggcagcctggagaccctgagccaccacctgaagtag

SEQ ID NO: 33073 - DNA, 1053 bp, Artificial Sequence
  Description of Artificial Sequence: Synthetic coding sequence
atgtgcaccgtgcgcttctggttctacatgattgaccccaggtccatgggcatcctgaaggtgtacaccatcgaggagagcggcctgaacatcctggtgtggagcgtgattggcaacaagaggacaggctggacctacggctctgtgcccctgagcagcaacagccccttcaaggtggcctttgaagctgacctggatggaaatgaagacatcttcatcgccctggatgacatctccttcaccccagaatgtgtgactggaggccctgtgcctgtgcagcccagcccctgtgaggccgaccagttcagctgcatctacaccctgcagtgtgtgcccctgagcgggaaatgtgatggccacgaggactgcattgatggcagtgatgagatggactgccccctgagccccaccccacccctgtgcagcaacatggagttcccctgcagcacagatgagtgcatccccagcctgctgctgtgtgatggagtgcctgactgccacttcaatgaagatgagctgatctgcagcaacaagagctgcagcaatggagccctggtgtgtgccagcagcaacagctgcatcccagcccaccagagatgtgatggctttgctgactgcatggacttccagctggatgagagcagctgcagcgagtgccccctgaactactgcagaaatggaggcacctgtgtggtggagaagaatggccccatgtgccgctgccggcagggctggaagggcaaccgctgccacatcaagttcaaccccccagccacagacttcacctacgcccagaacaacacctggaccctgctgggcatcggcctggccttcctgatgacccacatcaccgtggccgtgctgtgcttcctggccaacaggaaggtgcccatcaggaagacagagggcagcggcaactgtgcctttgtgaaccctgtgtatggcaactggagcaaccctgagaagacagagagctctgtgtacagcttcagcaaccccctgtatggcaccaccagcggcagcctggagaccctgagccaccacctgaagtag

SEQ ID NO: 33074 - DNA, 318 bp, Artificial Sequence
  Description of Artificial Sequence: Synthetic coding sequence
atgaacctgggcgtgtccatgctgcgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgagtgacaccatccccctgaagaagagggcccccaggaggaaccacaacttcagcaagagagatgcccaggtgattgagctgtag

SEQ ID NO: 33075 - DNA, 1443 bp, Artificial Sequence
  Description of Artificial Sequence: Synthetic coding sequence
atgctgggccgcttccagcccttcagcctggtgcgctccttccggctgggctttgaggcctgctgctaccccaaccagaagtgtgccacccagaccatccggcccccagacagccgctgcctggtgcaggccgtgtcccagaacttcaactttgccaaggatgtgctggaccagtggagccagctggagaaggatggcctgcggggcccctacccagccctgtggaaggtgtctgccaagggggaggaggacaagtggagctttgagaggatgacccagctgagcaagaaggccgccagcatcctgagtgacacctgtgccctgagccacggggaccggctgatgatcatcctgccccccaccccagaggcctactggatctgcctggcctgtgtgcggctgggcatcacctttgtgcccggcagcccccagctgacagccaagaagatccgctaccagctgaggatgagcaaggcccagtgcatcgtggccaatgaggccatggcccctgtggtgaacagcgctgtgtctgactgccccaccctgaagaccaagctgctggtgtctgacaagagctatgatggctggctggacttcaagaagctgatccaggtggccccacccaagcagacctacatgaggaccaagagccaggaccccatggccatcttcttcaccaagggcaccaccggggcccccaagatggtggagtacagccagtatggcctgggcatgggcttcagccaggccagccgccgctggatggacctgcagcccacagatgtgctgtggagcctgggagatgccttcggcggcagcctgagcctgtctgctgtgctgggcacctggttccagggcgcctgtgtgttcctgtgccacatgcccaccttctgcccagagaccgtgctgaatgtgctgagccgcttccccatcaccaccctgagcgccaaccctgagatgtaccaggagctgctgcagcacaagtgcttcaccagctaccgcttcaagagcctgaagcagtgtgtggccgccggcggccccatcagccctggggtgattgaggactggaagaggatcaccaagctggacatctatgagggctacggccagacagaaacaggcctgctgtgtgccaccagcaagaccatcaagctgaagcccagcagcctgggcaagcccctgcccccctacatcgtgcagatcgtggatgagaacagcaacctgctgcccccaggagaggagggcaacatcgccatccgcatcaagctgaaccagcctgccagcctgtactgcccccacatggtgtcctgggaggagtatgccagcgcccggggccacatgctgtacctgactggagaccggggcatcatggatgaagatggctacttctggtggagcggccgggtggatgatgtggccaatgccctgggccagaggctgtag

SEQ ID NO: 33076 - DNA, 1443 bp, Artificial Sequence; identical to SEQ ID NO: 33075
  Description of Artificial Sequence: Synthetic coding sequence

SEQ ID NO: 33077 - DNA, 561 bp, Artificial Sequence
  Description of Artificial Sequence: Synthetic coding sequence
atgagcaaggcccagtgcatcgtggccaatgaggccatggcccctgtggtgaacagcgctgtgtctgactgccccaccctgaagaccaagctgctggtgtctgacaagagctatgatggctggctggacttcaagaagctgatccaggtggccccacccaagcagacctacatgaggaccaagagccaggaccccatggccatcttcttcaccaagggcaccactggagcccccaagatggtggagtacagccagtatggcctgggcatgggcttcagccaggccagccgccgctggatggacctgcagcccacagatgtgctgtggagcctgggagatgcctttggaggcagcctgagcctgtctgctgtgctgggcacctggttccagggcgcctgtgtgttcctgtgccacatgcccaccttctgcccagagaccgtgctgaatgtgctgagccgcttccccatcaccaccctgagcgccaaccctgagatgtaccaggagctgctgcagcacaagtgcttcaccagggtgtacagcgtgcccctgcccaagcagtag

SEQ ID NO: 33078 - DNA, 1521 bp, Artificial Sequence
  Description of Artificial Sequence: Synthetic coding sequence
atgctgggccgcttccagcccttcagcctggtgcgctccttccggctgggctttgaggcctgctgctaccccaaccagaagtgtgccacccagaccatccggcccccagacagccgctgcctggtgcaggccgtgtcccagaacttcaactttgccaaggatgtgctggaccagtggagccagctggagaaggacaatggcctgcagctgcacccctgctgctgcaagaggcaggacttcatcctcttccacggctgcctcttctacattgatggcctgcggggcccctacccagccctgtggaaggtgtctgccaagggggaggaggacaagtggagctttgagaggatgacccagctgagcaagaaggccgccagcatcctgagtgacacctgtgccctgagccacggggaccggctgatgatcatcctgccccccaccccagaggcctactggatctgcctggcctgtgtgcggctgggcatcacctttgtgcccggcagcccccagctgacagccaagaagatccgctaccagctgaggatgagcaaggcccagtgcatcgtggccaatgaggccatggcccctgtggtgaacagcgctgtgtctgactgccccaccctgaagaccaagctgctggtgtctgacaagagctatgatggctggctggacttcaagaagctgatccaggtggccccacccaagcagacctacatgaggaccaagagccaggaccccatggccatcttcttcaccaagggcaccaccggggcccccaagatggtggagtacagccagtatggcctgggcatgggcttcagccaggccagccgccgctggatggacctgcagcccacagatgtgctgtggagcctgggagatgccttcggcggcagcctgagcctgtctgctgtgctgggcacctggttccagggcgcctgtgtgttcctgtgccacatgcccaccttctgcccagagaccgtgctgaatgtgctgagccgcttccccatcaccaccctgagcgccaaccctgagatgtaccaggagctgctgcagcacaagtgcttcaccagctaccgcttcaagagcctgaagcagtgtgtggccgccggcggccccatcagccctggggtgattgaggactggaagaggatcaccaagctggacatctatgagggctacggccagacagaaacaggcctgctgtgtgccaccagcaagaccatcaagctgaagcccagcagcctgggcaagcccctgcccccctacatcgtgcagatcgtggatgagaacagcaacctgctgcccccaggagaggagggcaacatcgccatccgcatcaagctgaaccagcctgccagcctgtactgcccccacatggtgtcctgggaggagtatgccagcgcccggggccacatgctgtacctgactggagaccggggcatcatggatgaagatggctacttctggtggagcggccgggtggatgatgtggccaatgccctgggccagaggctgtag

SEQ ID NO: 33079 - DNA, 366 bp, Artificial Sequence
  Description of Artificial Sequence: Synthetic coding sequence
atggtgcgcatcctggccaatggagagatcgtgcaggatgatgacccccgggtgaggaccaccacccagcccccccggggcagcatcccccggcagagcttcttcaacagaggacatggagcccctcctgggggccctggcccccggcagcagcaggccggggcccggctgggcgccgcccagagccccttcaatgacctgaaccggcagctggtgaacatgggcttcccccagtggcacctgggcaaccacgctgtggagcctgtgaccagcatcctgctgctcttcctgctgatgatgctgggcgtgcggggcctgctgctggtgggcctggtgtacctggtgagccacctgagccagaggtag

SEQ ID NO: 33080 - DNA, 312 bp, Artificial Sequence
  Description of Artificial Sequence: Synthetic coding sequence
atgagccctgtgctgagcggcatccacagcatctacagcgcctgggtgacctctgtgaacatcacagactgcaagccacccagcatcagcggggccgcccaccagggccccacagcccctggccgcatggtgcgcatcctggccaatggagagatcgtgcaggatgatgacccccgggtgaggaccaccacccagcccccccggggcagcatcccccggcagagcttcttcaacagaggacatggagcccctcctgggggccctggcccccggcagcagcaggccggggcccggctgggcgccgcccagtag

SEQ ID NO: 33081 - DNA, 924 bp, Artificial Sequence
  Description of Artificial Sequence: Synthetic coding sequence
gccagcccccggcggcccaggcctgcccggagccctgcccctgaggtgcccctgcgggtgagaagaagacatggccggccccacggccctgggggccggcagctggccctgggcatcccagccctgcggagcctgcccggctgtgtgccccggctgctgggccctgtggacaagggccatgatgtgaccttctacaagacctggtaccgcagcagcagaggagaggtgcagacctgcagcgagcggcggcccatccggaacctgaccttccaggacctgcacctgcaccacggcggccaccaggccgccaacaccagccatgacctggcccagagacatggcctggagagcgccagtgaccaccacggcaacttcagcatcaccatgaggaacctgaccctgctggacagcggcctgtactgctgcctggtggtggagatccgccaccaccacagcgagcaccgggtgcatggagccatggagctgcaggtgcagacaggcaaggatgcccccagcaactgtgtggtgtaccccagcagcagccaggacagcgagaacatcacagctgctgccctggccaccggggcctgcatcgtgggcatcctgtgcctgcccctcatcctgctgctggtgtacaagcagaggcaggccgccagcaaccggctggcccaggagctgctggcccaggacagcaacatccagggcattgaaaatcctggctttgaggccagccccccagcccagggcatccctgaggccaaggtgcgccaccccctgtcctatgtggcccagaggcagcccagcgagagcggccgccacctgctgtctgagcccagcacccccctgagccccccaggccctggagatgtgttcttccccagcctggaccctgtgcctgacagccccaactttgaggtgatctag

SEQ ID NO: 33082 - DNA, 936 bp, Artificial Sequence
  Description of Artificial Sequence: Synthetic coding sequence
atgggcgtgcccacagccctggaggccggctcctggcgctggggcagcctgctgtttgccctcttcctggccgccagcctgggccctgtggccgccttcaaggtggccaccccctacagcctgtatgtgtgcccagagggccagaatgtgaccctgacctgccgcctgctgggccctgtggacaagggccatgatgtgaccttctacaagacctggtaccgcagcagcagaggagaggtgcagacctgcagcgagcggcggcccatccggaacctgaccttccaggacctgcacctgcaccacggcggccaccaggccgccaacaccagccatgacctggcccagagacatggcctggagagcgccagtgaccaccacggcaacttcagcatcaccatgaggaacctgaccctgctggacagcggcctgtactgctgcctggtggtggagatccgccaccaccacagcgagcaccgggtgcatggagccatggagctgcaggtgcagacaggcaaggatgcccccagcaactgtgtggtgtaccccagcagcagccaggacagcgagaacatcacagctgctgccctggccaccggggcctgcatcgtgggcatcctgtgcctgcccctcatcctgctgctggtgtacaagcagaggcaggccgccagcaacagaagagcccaggagctggtgaggatggacagcaacatccagggcattgaaaatcctggctttgaggccagccccccagcccagggcatccctgaggccaaggtgcgccaccccctgtcctatgtggcccagaggcagcccagcgagagcggccgccacctgctgtctgagcccagcacccccctgagccccccaggccctggagatgtgttcttccccagcctggaccctgtgcctgacagccccaactttgaggtgatctag

SEQ ID NO: 33083 - DNA, 435 bp, Artificial Sequence
  Description of Artificial Sequence: Synthetic coding sequence
tgaacagctggggagctgcctgccaacagcgtgtctggcttcttcaagaggatggtgaagtctgaggccagcaatgctgccacagcctacttccggcctgcccggcccctgcccagcctggtgacagtgctgggcctgggctactttgcctgggtggtgttctggccccagagcatcccctaccagaacctgggccccctgggccccttcacccagtacctggtggaccaccaccacaccctgctgtgcaatggctactggctggcctggctgattcatgtgggggagagcctgtatgccatcgtgctgtgcaagcacaagggcatcaccagcggccgggcccagctgctgtggttcctgcagaccttcttctttggaattgccagcctgaccatcctgattgcctacaagaggaagaggcagaagcagacctag

SEQ ID NO: 33084 - DNA, 312 bp, Artificial Sequence
  Description of Artificial Sequence: Synthetic coding sequence
atggccacagctgctggggccacctacttccagaggggcagcctcttctggttcaccgtcatcaccctgagctttggctactacacctgggtggtgttctggccccagagcatcccctaccagaacctgggccccctgggccccttcacccagtacctggtggaccaccaccacaccctgctgtgcaatggctactggctggcctggctgatccacgtgggggagagcctgtatgccatcgtgctgtgcaagcagaatgagctgcgcatccgcatcaagatgaggaagctgatcctgcgggacagcgagtag

SEQ ID NO: 33085 - DNA, 255 bp, Artificial Sequence
  Description of Artificial Sequence: Synthetic coding sequence
atggccacagctgctggggccacctacttccagaggggcagcctcttctggttcaccgtcatcaccctgagctttggctactacacctgggtggtgttctggccccagagcatcccctaccagaacctgggccccctgggccccttcacccagtacctggtggaccaccaccacaccctgctgtgcaatggctactggctggcctggctgatccacgtgggggagagcctgtatgccatcgtgctgtgcaagtag

SEQ ID NO: 33086 - DNA, 312 bp, Artificial Sequence; identical to SEQ ID NO: 33084
  Description of Artificial Sequence: Synthetic coding sequence

SEQ ID NO: 33087 - DNA, 372 bp, Artificial Sequence
  Description of Artificial Sequence: Synthetic coding sequence
atggccacagctgctggggccacctacttccagaggggcagcctcttctggttcaccgtcatcaccctgagctttggctactacacctgggtggtgttctggccccagagcatcccctaccagaacctgggccccctgggccccttcacccagtacctggtggaccaccaccacaccctgctgtgcaatggctactggctggcctggctgatccacgtgggggagagcctgtatgccatcgtgctgtgcaagcacaagggcatcaccagcggccgggcccagctgctgtggttcctgcagaccttcttcttcggcatcgccagcctgaccatcctgattgcctacaagaggaagaggcagaagcagacctag

SEQ ID NO: 33088 - DNA, 306 bp, Artificial Sequence
  Description of Artificial Sequence: Synthetic coding sequence
tgagaattcctgcggtctgtgtgggtggtgttctggccccagagcatcccctaccagaacctgggccccctgggccccttcacccagtacctggtggaccaccaccacaccctgctgtgcaatggctactggctggcctggctgatccacgtgggggagagcctgtatgccatcgtgctgtgcaagcacaagggcatcaccagcggccgggcccagctgctgtggttcctgcagaccttcttcttcggcatcgccagcctgaccatcctgattgcctacaagaggaagaggcagaagcagacctag

SEQ ID NO: 33089 - DNA, 285 bp, Artificial Sequence
  Description of Artificial Sequence: Synthetic coding sequence
tctgtggagctgcccctggatgctgatgtgcagaccagcaacctgctgatcaccttcctgaagtacagcagcatcgtgatgcaggacaccaaggatgagcaccggctgcacagcggcaagctgtgcctgatcatcctgacctgcatcgccgagcccatgaggcacaggaagaaggctgctgacaagaacctgccctgccggcccctggtgtgtgctgtgctggacctgatggtggagttcatcgtgacccacatgatgaaggagttccccatggacctgtactag

SEQ ID NO: 33090 - DNA, 597 bp, Artificial Sequence
  Description of Artificial Sequence: Synthetic coding sequence
atggcccaggtggagaagaggggcggcctgctgaggaagagcagcgccagcaagaagcccctgaaggagaaggtggtgctgatgtatgatgagatcttcatgacagaggaccccagcaagtgcagcccccgcttctgggaggagctgttcctgatgaaggtgaacctggagtacctggagggcaagctggagagcctggatggagaggagctgatgaagatcaaggacaacatcaactgcctcttccagcactgcatccaggccctgggggaggagcaccccatccgggtggtgaatgccctgcagaccctgtgtgccctgatccggggcgtgcaccagaagaacaagagcaccagcggctttgacatcatcaacatgctgatgggctttgacaaggccgagctgtgcatgaaggtgcgccacaagctgcagatgtgcctgtggatggccgccagtgacagctgctcctggaccctgtctgctgacaagtgcacccagcgcttcggcctgaggaagatccagatgattgaatttggcctggccttccgctgcttctacttcacagacctgctgtacctgaacaagggcaagttctag

SEQ ID NO: 33091 - DNA, 2070 bp, Artificial Sequence
  Description of Artificial Sequence: Synthetic coding sequence
atggcccaggtggagaagaggggcggcctgctgaggaagagcagcgccagcaagaagcccctgaaggagaaggtggtgctgatgtatgatgagatcttcatgacagaggaccccagcaagtgcagcccccgcttctgggaggagctgttcctgatgaaggtgaacctggagtacctggagggcaagctggagagcctggatggagaggagctgatgaagatcaaggacaacatcaactgcctcttccagcactgcatccaggccctgggggaggagcaccccatccgggtggtgaatgccctgcagaccctgtgtgccctgatccggggcgtgcaccagaagaacaagagcaccagcggctttgacatcatcaacatgctgatgggctttgacaaggccgagctgtgcatgaagaacctgatggagagcctggacagcctgctgtgtgccgagggcagcgagagcctgaagagcctgtgcctgaagctgctgctgtgcctggtgacagtgacagacaacatcagccagaacaccatcctggagtatgtgatgatcaacagcatctttgaggccatcctgcagatcctgagccacccccccagccggcgggagcacggctatgatgctgtggtgctgctggccctgctggtgaactacagaaaatatgagagcgtgaacccctacatcgtgaagctgagcatcgtggatgatgaggccaccctgaatggcatgggcctggtgattgcccaggccctgtctgagtacaaccggcagtacaaggacaaggaggaggagcaccagagcggcttcttcagcgccctgaccaacatggtgggctccatgtttattgctgatgcccacgagaagatctctgtgcagaccaatgaggccatcctgctggccctgtatgaagctgtgcacctgaacagaaacttcatcaccgtgctggcccagagccaccctgagatgggcctggtgaccacccctgtgtccccagcccccaccacccctgtgacccccctgggcaccaccccacccagcagtgatgtgatcagctctgtggagctgcccctggatgctgatgtgcagaccagcaacctgctgatcaccttcctgaagtacagcagcatcgtgatgcaggacaccaaggatgagcaccggctgcacagcggcaagctgtgcctgatcatcctgacctgcatcgccgaggaccagtatgccaatgccttcctgcatgatgacaacatgaacttccgggtgaacctgcacaggatgcccatgaggcacaggaagaaggctgctgacaagaacctgccctgccggcccctggtgtgtgctgtgctggacctgatggtggagttcatcgtgacccacatgatgaaggagttccccatggacctgtacatccgctgcatccaggtggtgcacaagctgctgtgctaccagaagaagtgccgggtgcggctgcactacacctggagggagctgtggagcgccctgatcaacctgctgaagttcctgatgagcaatgagaccgtgctgctggccaagcacaacatcttcaccctggccctgatgattgtgaacctcttcaacatgttcatcacctatggagacaccttcctgcccacccccagcagctatgatgagctgtactatgagatcatccgcatgcaccagagctttgacaacctgtacagcatggtgctgcggctgagcaccaatgccggccagtggaaggaggccgccagcaaggtgacccacgccctggtgaacatccgggccatcatcaaccacttcaaccccaagattgagagctatgctgctgtgaaccacatcagccagctgtctgaggagcaggtgctggaggtggtgcgggccaactatgacaccctgaccctgaagctgcaggacggcctggaccagtatgagcgctacagcgagcagcacaaggaggccgccttcttcaaggagctggtgcgcagcatcagcaccaacgtgagaagaaacctggccttccacaccctgagccaggaggtgctgctgaaggagttcagcaccatctcctag

SEQ ID NO: 33092 - DNA, 285 bp, Artificial Sequence; identical to SEQ ID NO: 33089
  Description of Artificial Sequence: Synthetic coding sequence

SEQ ID NO: 33093 - DNA, 240 bp, Artificial Sequence
  Description of Artificial Sequence: Synthetic coding sequence
atggagctggaggccatgagccgctacaccagccctgtgaacccagctgtgttcccccacctgactgtggtgctgctggccatcggcatgttcttcaccgcctggttctttgtgtatgaggtgaccagcaccaagtacacccgggacatctacaaggagctgctgatcagcctggtggccagcctcttcatgggcttcggcgtgctcttcctgctgctgtgggtgggcatctacgtgtag

SEQ ID NO: 33094 - DNA, 240 bp, Artificial Sequence; identical to SEQ ID NO: 33093
  Description of Artificial Sequence: Synthetic coding sequence

SEQ ID NO: 33095 - DNA, 2349 bp, Artificial Sequence
  Description of Artificial Sequence: Synthetic coding sequence
atggctgctgctgctgctgctggccccagccctggcagcggccctggggacagccctgagggccctgagggggaggcccctgagaggaggaggaaggcccacggcatgctgaagctgtactacggcctgtctgagggggaggccgccggccggcctgctggccctgaccccctggaccccacagacctgaatggagcccactttgatcctgaggtgtacctggacaagctgcggcgggagtgccccctggcccagctgatggattctgaaacagacatggtgcggcagatccgggccctggacagcgacatgcagaccctggtgtatgagaactacaacaagttcatcagcgccacagacaccatcaggaagatgaagaatgacttcaggaagatggaggatgagatggaccggctggccaccaacatggccgtcatcacagacttcagcgcccgcatcagcgccaccctgcaggacagacatgagcgcatcaccaagctggccggcgtgcacgccctgctgaggaagctgcagttcctgtttgagctgcccagccggctgaccaagtgtgtggagctgggcgcctacggccaggccgtgcgctaccagggccgggcccaggccgtgctgcagcagtaccagcacctgcccagcttccgggccatccaggatgactgccaggtgatcacagcccggctggcccagcagctgcggcagcgcttccgggagggcggcagcggggcccctgagcaggctgaatgtgtggagctgctgctggccctgggggagcctgctgaggagctgtgtgaggagttcctggcccacgcccggggccgcctggagaaggagctgaggaacctggaggccgagctgggccccagccccccagccccagatgtgctggagttcacagaccacggcggcagcggctttgtgggcggcctgtgccaggtggccgccgcctaccaggagctgtttgctgcccagggccctgctggagctgagaagctggccgcctttgcccggcagctgggcagccgctactttgccctggtggagcggcggctggcccaggagcagggcggcggggacaacagcctgctggtgcgggccctggaccgcttccaccggcggctgcgggcccctggggccctgctggccgctgctggcctggctgatgctgccacagagatcgtggagcgggtggcccgggagcggctgggccaccacctgcagggcctgcgggccgccttcctgggctgcctgacagatgtgcggcaggccctggccgccccccgggtggccggcaaggagggccctggcctggccgagctgctggccaacgtggccagcagcatcctgagccacatcaaggccagcctggccgctgtgcacctgttcaccgccaaggaggtgtccttcagcaacaagccctacttccggggggagttctgcagccagggcgtgcgggagggcctcatcgtgggctttgtgcacagcatgtgccagacagcccagagcttctgtgacagccctggagagaagggcggggccaccccaccagccctgctgctgctgctgagccggctgtgcctggactatgaaacagccaccatctcctacatcctgaccctgacagatgagcagttcctggtgcaggaccagtttcctgtgacccctgtgtccaccctgtgtgccgaggcccgggagacagcccggcggctgctgacccactacgtgaaggtgcagggcctggtgatcagccagatgctgaggaagtctgtggagacccgggactggctgagcaccctggagcccagaaatgtgcgggctgtgatgaagagggtggtggaggacaccacagccattgatgtgcaggtgggcctgctgtatgaggagggcgtgaggaaggcccagagcagtgacagcagcaagaggaccttctctgtgtacagcagcagccggcagcagggccgctatgcccccagctacaccccatctgcccccatggacaccaacctgctgagcaacatccagaagctgttcagcgagagaattgatgtgttcagccctgtggagttcaacaaggtgtctgtgctgaccggcatcatcaagatcagcctgaagaccctgctggagtgtgtgcggctgcggaccttcggccgcttcggcctgcagcaggtgcaggtggactgccacttcctgcagctgtacctgtggaggtttgtggctgatgaggagctggtgcacctgctgctggatgaggtggtggccagcgctgccctgcgctgcccagaccctgtgcccatggagcccagcgtggtggaggtgatctgtgagcggggctag

SEQ ID NO: 33096 - DNA, 594 bp, Artificial Sequence
  Description of Artificial Sequence: Synthetic coding sequence
atgtctgcccgggcccccaaggagctgcggctggccctgcccccctgcctgctgaacagaacatttgccagccccaatgccagcggcagcggcaacacaggagcccggggccctggagctgtgggcagcggcacctgcatcacccaggtgggccagcagctgttccagagcttcagcagcaccctggtgctgattgtgctggtgaccctcatcttctgcctgattgtgctgagcctgagcaccttccacatccacaagaggaggatgaagaagaggaagatgcagagggcccaggaggagtatgagcgggaccactgcagcggcagcagaggaggcggcggcctgccccggcccggccggcaggcccccacccacgccaaggagacccggctggagcggcagccccgggacagccccttctgtgcccccagcaatgccagcagcctgagcagcagcagccctggcctgccctgccagggcccctgtgcccctcctcctcctcctccagccagcagcccccagggcgcccacgccgccagcagctgcctggacacagctggggagggcctgctgcagacagtggtgctgtcctag

SEQ ID NO: 33097 - DNA, 1131 bp, Artificial Sequence
  Description of Artificial Sequence: Synthetic coding sequence
atgggccaccagttcctgcggggcctgctgaccctgctgctgcccccaccacccctgtacaccaggcacaggatgctgggccctgagagcgtgcccccacccaagaggagccgcagcaagctgatggcccccccaagaattggcacccacaacggcaccttccactgtgatgaggccctggcctgtgccctgctgcggctgctgcctgagtacagagatgctgagatcgtgaggacccgggaccctgagaagctggccagctgtgacatcgtggtggatgtgggcggggagtatgaccccaggaggcacagatatgaccaccaccagaggagcttcacagagaccatgagcagcctgagccctgggaagccctggcagaccaagctgagcagcgctggcctcatctacctgcacttcggccacaagctgctggcccagctgctgggcaccagtgaagaagattccatggtgggcaccctgtatgacaagatgtatgagaactttgtggaggaggtggatgctgtggacaatggcatcagccagtgggccgagggggagcccaggtatgccctgaccaccaccctgagcgcccgggtggcccggctgaaccccacctggaaccacccagaccaggacacagaagctggcttcaagagggccatggacctggtgcaggaggagttcctgcagaggctggacttctaccagcacagctggctgcctgcccgggccctggtggaggaggccctggcccagcgcttccaggtggaccccagcggggagatcgtggagctggccaagggggcctgcccctggaaggagcacctgtaccacctggagagcggcctgagcccccctgtggccatcttctttgtgatctacacagaccaggccggccagtggaggatccagtgtgtgcccaaggagccccacagcttccagagccggctgcccctgcctgagccctggaggggcctgagagatgaggccctggaccaggtgtctggcatccctggctgcatctttgtgcacgccagcggcttcaccggcggccaccacacccgggagggcgccctgtccatggcccgggccaccctggcccagaggagctacctgccccagatctcctag

SEQ ID NO: 33098 - DNA, 978 bp, Artificial Sequence
  Description of Artificial Sequence: Synthetic coding sequence
atgggccaccagttcctgcggggcctgctgaccctgctgctgcccccaccacccctgtacaccaggcacaggatgctgggccctgagagcgtgcccccacccaagaggagccgcagcaagctgatggcccccccaagaattggcacccacaacggcaccttccactgtgatgaggccctggcctgtgccctgctgcggctgctgcctgagtacagagatgctgagatcgtgaggacccgggaccctgagaagctggccagctgtgacatcgtggtggatgtgggcggggagtatgaccccaggaggcacagatatgaccaccaccagaggagcttcacagagaccatgagcagcctgagccctgggaagccctggcagaccaagctgagcagcgctggcctcatctacctgcacttcggccacaagctgctggcccagctgctgggcaccagtgaagaagattccatggtgggcaccctgtatgacaaggccggcttcaagagggccatggacctggtgcaggaggagttcctgcagaggctggacttctaccagcacagctggctgcctgcccgggccctggtggaggaggccctggcccagcgcttccaggtggaccccagcggggagatcgtggagctggccaagggggcctgcccctggaaggagcacctgtaccacctggagagcggcctgagcccccctgtggccatcttcttcgtcatctacacagaccaggccggccagtggaggatccagtgtgtgcccaaggagccccacagcttccagagccggctgcccctgcctgagccctggaggggcctgagagatgaggccctggaccaggtgtctggcatccctggctgcatctttgtgcacgccagcggcttcaccggcggccaccacacccgggagggcgccctgtccatggcccgggccaccctggcccagaggagctacctgccccagatctcctag

SEQ ID NO: 33099 - DNA, 351 bp, Artificial Sequence
  Description of Artificial Sequence: Synthetic coding sequence
atgaaccagacagacaagaaccagcaggagatccccagctacctgaatgatgagcccccagagggctccatgaaggaccacccccagcagcagcccggcatgctgagccgggtgactggaggcatcttctctgtgaccaagggagctgtgggcgccaccatcggcggcgtggcctggattggaggcaagagcctggaggtgaccaagacagctgtgaccaccgtgcccagcatgggcatcggcctggtgaagggcggcgtgtctgctgtggccggcggcgtgacagctgtgggcagcgctgtggtgaacaaggtgcccctgaccgggaagaagaaggacaagagtgactag

SEQ ID NO: 33100 - DNA, 351 bp, Artificial Sequence; identical to SEQ ID NO: 33099
  Description of Artificial Sequence: Synthetic coding sequence

SEQ ID NO: 33101 - DNA, 351 bp, Artificial Sequence; identical to SEQ ID NO: 33099
  Description of Artificial Sequence: Synthetic coding sequence

SEQ ID NO: 33102 - DNA, 351 bp, Artificial Sequence; identical to SEQ ID NO: 33099
  Description of Artificial Sequence: Synthetic coding sequence

SEQ ID NO: 33103 - DNA, 351 bp, Artificial Sequence; identical to SEQ ID NO: 33099
  Description of Artificial Sequence: Synthetic coding sequence

SEQ ID NO: 33104 - DNA, 351 bp, Artificial Sequence; identical to SEQ ID NO: 33099
  Description of Artificial Sequence: Synthetic coding sequence

SEQ ID NO: 33105 - DNA, 12741 bp, Artificial Sequence
  Description of Artificial Sequence: Synthetic coding sequence
atgggcctgctgctggtgttccccctcatccagagccagagcaggacagaccccagcctgtgcaacatcacagctgaggtgctgctgaactgcctgcgggactgccagcccctgagcctgaccaaggagcctgctgactgcctgaatggaattgagaccctgctgtgctcctggctggaggagaccagtgacaccggccgccacatcccccacaagcagaaggaaaatgctgctgctgccctggtggccctggcctgtgcccggggcagcctgaagacctttgtgcacacagtgcacctgctgcagaagcagacagacctgggcagcctgcctgtggctgatgtgctgtaccgcctgctgctgctggagggcggccctggcagccccagctgcctgctgggcggcaagcacatcgtgtcctggggctatgaggacatgctgcctgccccagacagcaacacaggcagcagcagcgagaacaaggatgctgacctgggccgctgcctgacagcagatggcctgtacctgtacaccaccaacagcgtgggccggggcgtgtccaagctgggcagcggcctgcacggcaccctgcggggctttgtgtactgcagaaatgaggagctggagcccggctgggtggcctttggaagtggcagcctgctgcacaggcctgtgtcctttgacaacaagccccacagcctcttccaggtgattgaccagaacaccctgcaggtgtgccaggtggtgcccatgcctgccaaccacctgcccatcggcagcaccatgagcacagtgcacctgagcagtgatggcacctacttctactggatctggagccctgccagcctgaatgagaagacccccaagggccacagcgtcttcatggacatctttgagctggtggtggagaatggagtgtttgtggccaaccccctgcaggagaggaccatcctgatgaggaaggagggggagagcgccaagagcatcaatgagatgctgctgagccggctgagccgctaccgggccagccccagcgccaccctggccgccctgaccggcagcaccatcagcaacaccctgaaggaggaccaggccgccaacaccagctgtggcctgcccctgaagatgctgaggaagacccccatctacacctgtggcacctacctggtgatgctggtgcccccacctgggggcagcggcagcagcgccaccaggagcctgtttggaggcaccagcggcctgagcagcctgaagagggcctgctatgacacagtgaacaacatgctgtggacctgcagcaatgactacatcgaccagtggtgcaaccctggcaaccaggccttccactacgtgtgccagaggctgggcgtgagccacatcatcacagagcccaaggaggaggccatcaccaccaatgaggtgatcaaccagctgctgcaccacgtgggcgccatgtgcatccaccagctgaacctgctggccaccaaccccaacctgcccatcacctctgtgctgggcaagcagcaccccatcgaggcccaccacctgagcagcatctgtgacatcatggagaaggccatggtgaatggagacacctgcatcatccgctgcatcctggtggtgttccaggtggtgttcaagttcttcttcagcccccagacagagaggaacagagacatcatccgccgcagcggcctgctgctgtggcagctgctgatggcccccaaggaccagatctgcccagagatccagaaggaggtgtgcctggccatcagcagcggcctgaacatcctgtacccaggagaaacagagatcaacaacctgctgaagctggtgctgacagaaggagagaggaacagcggcctgagccagctgagagatgtgatcctgaccaacctggccgagcagctgcagaacaaccgcttcggcagtgatgaagatgaccactaccgcctgaatgatgagctgctgcactacatcctgaagatcgtggtgcgggagagctgcatcctgatcaccaagtgccagacagtgtccaaggatgacttccagaagctgctgagcacagtgcctgctgccagcagctgcctgcgctacctgatggctgtgcagaaccacctgctgagcaacaccatcctgatcaagccagatgaaaatgatgacagcgacagcagcctgcagggcgagaccctgaaggtgcaggagctgaaggtgtccatcctggccctggccacccagatcctgaccggctgtgatgaggtgctggagatgctgcagcaggtgaccacagccctgatcaacagcgacattgctgaccgggagcagaggctgaagggcctggagcaggtgaccaaggccaccatgctgggccacctgctgcctgtgctgctgaccagcctgatgcaccccaacctgcagaccctcatcatggctgatgccctgatgccccagctggtgcagctggtgctgtacaccagccagacagccctgctgctgaagacccagtgccctgtgtttgctgaggtgggctgcagcccctgtggggccccagaccagaagtgccgcctcttcccagatgagaggatgctggaggagaaggaggagcccggcttcctgaccggcctgaagatcccagccccctgggccgccggcaagacagtggagaccgtgcaccctgtgcgggacaactacaagttcaaggagaccgtgcacatccctggggcccgctgcctgtacctgcgctttgacagccgctgcagcagccagtatgactatgacaagctggtgatctatgccggccccaacaccaacagcaggaaggtggccgagtatggaggcaacaccctgggctacggcagccgctctgtgctgggcaccggctggcccaaggacctggtgaagtgcatcagcccccccagcctgaacttcaaggtggagggggacacagtgaccttctcctttgagatgaggagcggccgggagcacaacaccccagacaaggccatgtggggctttgcctgcaccgtgcgggcccaggagagcagtgaagatgtgtctgggggcctgcccttcctggtggacctggccctgggcctgtctgtgctggcctgcagcatgctgcgcatcctgtacaatggacctgagatcaccaaggaggaggaggcctgccaggagctgctgcggagcaagctgctgcagcgctgccagtggcaggtggaggccaatggagtcatcagccctgccctgacccccagccccagccccctgcccctgaccattgaagaagatcgggagttcacctaccccagtgatgtgctggtgccccctgtgggcaactactttgacctgccccgcatccggctgcccccaggcatcatgatcaagctgcgggagatcagcggccgggcccggccccagttccggcccagcatcaaggaggtgatccagccagatgtgatggaggagatggtggtgtcctgtgtgatcaagcacctgaacctggtggatgccctgcagagcctcatcaacttccagtaccaggaggagcacgccgaggagtatgacctgctgtgcaagatcatgggagagaccttcaagaagctgaatgccatggagcggcagctgcagagcgtggccgagctggagcagaagtggcagagcgaggtggatgatgccatgcagggcaagctggagaacaacatgcccttcttctatgactaccacttcaatgaaaacaagatgaaggagctggagctgctgtgcagcatgaaggaggtgtcctttgatggaaatgacctggagaacatggtgctgagcctgcgggagaagttcctgcaggaggtgaacagcctcatccagaagcccagccaccccctggccaagaccaagaccctggtgaagagcctgatgaacagagctgagctgctgctgcacgtgaccatcgccgcccagagcggcctgaccaggagcatcagcggcaccccagctgagaccccagcctgcaagagcgccagcgagaccaaggtgatcagccatgctgtgcggcagcccgtcttcctgcgctccatgtctgcccccagcgacctggagatgattggaaatgaagacctggagttcacccgggccaaccagaggagaagacatgtgaccagccacaggagcagcagcttcaccctgctgcagagcctggccatcgaggacagccgggacaagcccacctacagcgtgctgctgggccagctgtttgccttcatcggcaccaacccagaccaggccgtgagcagcagcagcttcctgctggccgcccagacccgctggaggcggggcaacaccaggaagcaggccctggtgcacatgagggagctgctgacagctgctgtgcgggtgggcggcgtgacccacctggtgggccctgtgaccatggtgctgcagggcggcccccgcatcgaggagctgacctgtggcggcatggtggagcaggtgcaggaggccttcggggagaccatgacctctgtggtgtccctgtgtgcccgctaccccatcgcctgtgccaacagcatcggcctgctgtgcaccatcccctacaccaggtctgaggagaagtgcctggtgcgcagcggcctggtgcagctgatggaccggctgtgcagcctgagcaaccagacagagagcagcagcagcgagaagcagaccaagaagcagaaggtggccaccatggcctgggccgccttccaggtgctggccaacagatgtgtggagtgggagaaggaggagggcggcagcacagaagctgtgcacagcggcctggcccggcaggtgagcagcctgctgaccaaccacctggcccgggccacagagtgctgcggcaaccaggccgctggaaatgatgccctgcaggatgtgctgagcctgctgaatgacctgagccgcagccacatcggcaaggccatcctgagccagcctgcctgtgtgtccaagctgctgagcctgctgctggaccagaggcccagccccaagctggtgctgatcatcctgcagctgtgcagagctgccctgcccctgatgtctgtggaggactgtggaaatgtggagctgcccccctggagctacagcgtgcccagcctgaacagcgagcaggaggaccccagcgaccctgccagcaagatcgccagcctgctgctggccaagctggccgactatgtggtgcccggctgccagacagtgctgagccccacagccagcgagccagacaccaccctgaccaagaccagccccaagaacagcctgaagggggacaaggaccccggggaggagagcgaggccgtggatggcaagctgagcatcttcatccacaagcgggaggaccagagcagccatgaggtgctgcagcccctgctgagcagcagcgagggccggcccttccggctgggcactggagccaacatggagaaggtggtgaagatggaccgggacatgaccaagggcggctgctgtgaggtgatcacagaggaggccgccgccgccctgaggaaggccaccaagtgggcccagagcggcctcatcgtgtccatcggcccccctgtggagagcatcaaccctgagaccgtgtctggcctgagcactggagacaagaagaagacagcccagaccagcatctgccgggagagaaattctgagctggccaggacagatcctgtgcggcccttcatcagcggccacgtggccaacagcatggctgctgaggtgattgccctgctgcacagcctgctgatggcccctgagagcaatgctgcccagatctggaccaccacagctgagaaggtgctgagccgggccctgatgtacatcccccagctgggcaagtatgcagagagcatcctggagaatggcagcagcagcggcaggaagctggccaagctgcagagaattgcccggcaggccgtggccgccctgtgtgccctgggcggcttcaaggagaccatcaagattggcagcgaggtgcaggtgctgggccggggcatcagcggcagcattggagtggtggccagcatcaatgagcaggagggcatcgccaccgtgcgcttcccccccatcgactgcaggaagaccagccaggccagtgacaccctgaccatccccctgagccggctgtgtgtgcccaggtctgaggccctgcccctgcacaagctgagcatcacagagaaggtggtgcaggccgtgcagagcatgctgctgccccaggagggcagcctgagcatccacaccagcctgcctgccactggagatggcagcgcccctgtgatggctgtggtgcggctgctggccgagatccgcacccgggcctgcctggtgatggcccagctgctggaggacagcctcttctgtgaggagttcatccagcagtgcccagctgctgtggaggtgctgaacctggtggcccaggagtgcagcgctggggagcggctggccgtggtggaggtgcagtgtgagcggctgaggatgctgtacagagactgtgcccggcccccacctccacccctgcaggccgaccggcggcagcccaaggagatcacctggagccccagcagggtcttcccccctgtgcgggcctgcatgttcagcagccacctgacctctgtgaccttcctggccgaccccagcgctgggggcggcctgccccggggcaccttcatctatgccaccagccccctgcctgtgcaggcccccagcttctactgggagattgagatcgtgtcctatggagacacagatgatgacaccggccccatcgtgtcctttggcttcaccacagaggccgagaagagagatggagcctggaccaaccctgtgggcacctgcctcttccacaacaacggccgggctgtgcactacaacggcagcagcctgctgcagtggaagtctgtgcggctggatgtgaccctgagccctggagatgtggccggcatcggctgggagaggacagagggcaccccacctcctcctggccagcctgccaagggccgggtgtacttcacctactgcggccagaggctgagcccctacctggaggatgtgtctgggggcatgtggcctgtggtgcacatccagaagaagaacaccaagacccgggccaactttggcagccggccctttgcctatgcagagggccaggcccacagaaatgctgctgacctgtgcacagacctggccgaggagatcagcgccaactttgaggccctgccctttgccatggccagtgacagcgacaatgatgctggcaccagcatcgccagtgaccccggcacccacggccccccctgcagaattgctgctgtggccacagcccagcagcagtatgacagcgacaccagctgccactacaaggtggagctgtcctatgagaacttcatcaccagcggccctgacccccaccccccacccatcgcagatgatgaaagtgatgatgatgatgatgatgacatcccccaggaggaccactacgccctgctggtgaaggcctgggagaccaaggtgttccccaccatcagaagacgcttcagaaatgaagctgagaggaagagcggcctggaccagatcaagggggccctgcagctgggcatggtggacatcgcccggcagacagtggagttcctgtatgaggagaatggaggcatcccccgggacctgtacctgcccaccatcgaggacatcaaggatgaggccaacaagttcaccatcgacaaggtgaggaagggcctgactgtggtgaccaggagcccagacagcaacaacgtggccagcagcgctgtgggcacagccctgcccaagtttgccatccggggcatgctgaagaccttcggcctgcacggcgtggtgctggatgtggacagcgtgaatgagctggtgcaggtggagacctacctgcggagtgaaggagtgctggtgcgctactggtaccccatcgacatgctggagcggcccccagctggctacagaagaacagccaccaacggcctggtgaccctggacaacaccaacctgcagatccaccgggagctgctgcgctgtgaggccgccctggcccggctgtactgcaggatggccctgctgaacatctttgcccccaagctgccccacctgttcaccaggctcttccacatcccagccatccgggacatcaccctggagcacctgcagctgctgagcaaccagctgctggccccacccctgcctgatggcaccatcagcagcagcagcatcctgctggcccagagcctgcagcactgcatccacagccagaactgcagcgccacagacctcttctaccagggcaacagccagacagtgcgggagtggctgaatgtggccatcaccaggaccctgcaccagggcgaggagagcctgctggagctgaccaagcagatctgcagcttcctgcagacagcccctgagcagttccccagcgaggagttccccatcagcgagagcaaggtgaacatggatgtgaacttccctggggccgcctttgtggtggtgtcctgcaaggagagccagagcggcttcaggaaggacagcagcctgtacaaggccccctgggcccgggtgctggtgtatggcctgggccacaaggtgaagagaaatggccagctgaacctgattgaggccgcctgctaccccagagatgccagccctgccaacacaggcctggcccccccacccacagctgaccagtaccccagcgtggtgctgagcacagacagagtgcacatcaagctgggcgtgtccccacctcctggagctgtgctggtgctgcacagcctgcccctggagttccccctggccatggcctttgctgagcagctgctgtcctggaagtctgaggacagcgagggcaagtcagaagatgagccagacaccatccccacctctgtgctgctgcaggtggtggagctgctgggcaacttcctgtggaccacagacatggccgcctgtgtgaaggagctggtgttccacctgctggccgagctgctgaggacagtgcacaccctggagcagaggaggcaccctgctggcctgagcagcagcatcgccctgcagctgaacccctgcctggccatgctgatggccctgcagagcgagctgcacaagctgtatgatgaggagacccagaactgggtgtctgggggcgcctgtggcggcagcggcggcgctgctgctggggaccagggccgcttcagcacctacttccacgccctgatggagggctgcctggccgtggccgaggtgaccctgcccaccaacatgtctgtgacagccagcggcgtgaccagcgccacagcccccaacctgagtgacagcagcagcagcagcagcagcagccctggccagaccccccagagccccagcctgctgagcaagaggaagaaggtgaagatgaagcgggagaaggccagcagcagcggcaagaggcagagcagcaggacagtggacagcgaccccaccgtgctgagcattggaggcagcaagccagaggacatgctgtggttccaccgggccctgaccctgctgatcatcctgcggcacctgaccaggaaggacccccagggcctgggcgtgaccagtgatgccatcgcagatgcctgccaggccctggtgggccccacagcccacagccggctgctggtgatcagcggcatccccacccacctggatgaaggagtggtgcggggggccatcaggaaggcctgcaatgcccacggcggcgtcttcaaggatgagatctacatccccctgcaggaggaggacaccaagaagcccaaggacaaggccgagggcggagatggcaaggtggagcctgagaagaccctggccttccctggaacagacagcatggaggtgtccaccagcagcagcctgaccccagccatgagcatcagcgccagcgccagcaccagccaggccagcatctgcagcagccagggcatcagccagacagtgtctgacctgtctgtggaccccctgcctgctggcctggagctgcccatccccccaggcctgctggagccccatgctgtgagcagccaggagagcctggacatcagcctgtgcagcacaggcagcctgggcagcctgggcagcctgggggagcccctggacaatgctgagacagcctctgtgtctgacatgggctccatgtacacagtgaccagcctggacaaccagcccctggccgcccggcccatcaagggctttgctgtggtggagatccgcagccgggccaagattgagaagatccgggccagcctcttcaacaacaatgacctgattggcctgagcagcctggatggagaagatgagctgatggagatgagcacagaggagatcctgactgtgtctgtggtgaaccagagcctgtttgacacccagggcagccctggcctggaggactacttcaatgacaagagcatcaagggggagaagctggtgcctggggcccgggaggtgctgacagagatcttcaagagctgtgcccacagcgagcagaccctgagcctgaccccagccaagcccatccgggtgtctgacatctacctgagcaaggagcagatcaacagccagaccccaggcaacctgctgcacctgttcttcaccaacgtgcggccccccaagaaggtgctggaggaccagctgacccagatcctgaggaaatatggagtgcccaagcccaagtttgacaagagcaagtacagcaaggccggcaaggagcagcaccctgtgaaggtggtgtccaccaagaggcccatcaccaagcccccagccaaggacaaggctgtgctgaacagcgtgtccaggacagccctgtctgagaagaagcccaccgtgaagcccaagagccctgagaagagcaagccagatgagaaggaccctgagaagagccccaccaagaagcaggaggtgcctgaggagaagtacctgaccctggagggcttccacaagtttgtgattgaccgggcccggcaggacatccgctctgtgtggagggccatcctgagctgtggctatgacctgcactttgagcgctgtgcctgcattgatgtgagacatgcccagaaggccagcaggaagtggaccctggagatggatgtggccctggtgcagtacatcaaccagctgtgccgccacctggccatcaccccagcccggctgcacccccatgaggtgtacctggaccctgcagatgctgctgacccccgggtggcctgcctgctgaatgtgcccatcgagagcctgcggctgcgctttgccctgctgcagagcctgaacaccaccctggagaccttcttcctgcccctggtggagctgcggcagacccccatgtacacccacagcattgctgccctgctgaaggaggccaagggcctcatcttctatgacaccaaggtgacagtgatgaacagagtgctgaatgccaccgtgcagaggacagctgaccacgccgcccctgagatcaccctggaccccctggagatcgtgggcggggagatccgggccagcgagaacagctacttctgccaggccgcccggcagctggcctctgtgcccagcagccagctgtgtgtgaagctggccagcggcggggaccccacctacgccttcaacatccgcttcaccggggaggaggtgcacggcaccagcggcagcttccgccacttcctgtggcaggtgtgcaaggagctgcagagcagcagcctgagcctgctgctgctgtgccccagcagcgctgtgaacaagaacaagggcaagtacatcctgacccccagccccatcacctacggggaggagcagctgctgcacttcctgggccagctgctgggcatcgccatccgggcagatgtgcccctgcccctggacctgctgcccagcttctggaagaccctggtgggggagcccctggaccctgagcaggacctgcaggaggccgacatcctgacctacaactacgtgaagaagtttgagagcatcaatgatgaaacagagctggaggccctgtgtgccgagatcgccagccagcacctggccacagagagcccagacagccccaacaagccctgctgccgcttcacctacctgaccatgaccggggaggaggtggagctgtgcagccggggccgccacatcctggtggcctgggagaacaaggacatctatgctgctgccatccgcagcctgcggctgcgggagctgcagaatgtggagtgtgtgacagctgtgcgggccggcctgggcagcatcatccccctgcagctgctgaccatgctgagccccctggagatggagctgcggacctgtggcctgccctacatcaacctggagttcctgaaggcccacaccatgtaccaggtgggcctgatggagacagaccagcacatcgagttcttctggggcgccctggagatgttcacccaggaggagctgtgcaagttcatcaagtttgcctgcaaccaggagcgcatccccttcacctgcccctgcaaggatggcggccctgacacagcccacgtgcccccctaccccatgaagatcgcccccccagatggaacagctggcagcccagacagccgctacatccgggtggagacctgcatgttcatgatcaagctgccccagtacagcagcctggagatcatgctggagaagctgcgctgtgccatccactaccgggaggaccccctgtctggatag

SEQ ID NO: 33106 - DNA, 11991 bp, Artificial Sequence
  Description of Artificial Sequence: Synthetic coding sequence
atgcctgccaaccacctgcccatcggcagcaccatgagcacagtgcacctgagcagtgatggcacctacttctactggatctggagccctgccagcctgaatgagaagacccccaagggccacagcgtcttcatggacatctttgagctggtggtggagaatggagtgtttgtggccaaccccctgcaggagaggaccatcctgatgaggaaggagggggagagcgccaagagcatcaatgagatgctgctgagccggctgagccgctaccgggccagccccagcgccaccctggccgccctgaccggcagcaccatcagcaacaccctgaaggaggaccaggccgccaacaccagctgtggcctgcccctgaagatgctgaggaagacccccatctacacctgtggcacctacctggtgatgctggtgcccccacctgggggcagcggcagcagcgccaccaggagcctgtttggaggcaccagcggcctgagcagcctgaagagggcctgctatgacacagtgaacaacatgctgtggacctgcagcaatgactacatcgaccagtggtgcaaccctggcaaccaggccttccactacgtgtgccagaggctgggcgtgagccacatcatcacagagcccaaggaggaggccatcaccaccaatgaggtgatcaaccagctgctgcaccacgtgggcgccatgtgcatccaccagctgaacctgctggccaccaaccccaacctgcccatcacctctgtgctgggcaagcagcaccccatcgaggcccaccacctgagcagcatctgtgacatcatggagaaggccatggtgaatggagacacctgcatcatccgctgcatcctggtggtgttccaggtggtgttcaagttcttcttcagcccccagacagagaggaacagagacatcatccgccgcagcggcctgctgctgtggcagctgctgatggcccccaaggaccagatctgcccagagatccagaaggaggtgtgcctggccatcagcagcggcctgaacatcctgtacccaggagaaacagagatcaacaacctgctgaagctggtgctgacagaaggagagaggaacagcggcctgagccagctgagagatgtgatcctgaccaacctggccgagcagctgcagaacaaccgcttcggcagtgatgaagatgaccactaccgcctgaatgatgagctgctgcactacatcctgaagatcgtggtgcgggagagctgcatcctgatcaccaagtgccagacagtgtccaaggatgacttccagaagctgctgagcacagtgcctgctgccagcagctgcctgcgctacctgatggctgtgcagaaccacctgctgagcaacaccatcctgatcaagccagatgaaaatgatgacagcgacagcagcctgcagggcgagaccctgaaggtgcaggagctgaaggtgtccatcctggccctggccacccagatcctgaccggctgtgatgaggtgctggagatgctgcagcaggtgaccacagccctgatcaacagcgacattgctgaccgggagcagaggctgaagggcctggagcaggtgaccaaggccaccatgctgggccacctgctgcctgtgctgctgaccagcctgatgcaccccaacctgcagaccctcatcatggctgatgccctgatgccccagctggtgcagctggtgctgtacaccagccagacagccctgctgctgaagacccagtgccctgtgtttgctgaggtgggctgcagcccctgtggggccccagaccagaagtgccgcctcttcccagatgagaggatgctggaggagaaggaggagcccggcttcctgaccggcctgaagatcccagccccctgggccgccggcaagacagtggagaccgtgcaccctgtgcgggacaactacaagttcaaggagaccgtgcacatccctggggcccgctgcctgtacctgcgctttgacagccgctgcagcagccagtatgactatgacaagctggtgatctatgccggccccaacaccaacagcaggaaggtggccgagtatggaggcaacaccctgggctacggcagccgctctgtgctgggcaccggctggcccaaggacctggtgaagtgcatcagcccccccagcctgaacttcaaggtggagggggacacagtgaccttctcctttgagatgaggagcggccgggagcacaacaccccagacaaggccatgtggggctttgcctgcaccgtgcgggcccaggagagcagtgaagatgtgtctgggggcctgcccttcctggtggacctggccctgggcctgtctgtgctggcctgcagcatgctgcgcatcctgtacaatggacctgagatcaccaaggaggaggaggcctgccaggagctgctgcggagcaagctgctgcagcgctgccagtggcaggtggaggccaatggagtcatcagccctgccctgacccccagccccagccccctgcccctgaccattgaagaagatcgggagttcacctaccccagtgatgtgctggtgccccctgtgggcaactactttgacctgccccgcatccggctgcccccaggcatcatgatcaagctgcgggagatcagcggccgggcccggccccagttccggcccagcatcaaggaggtgatccagccagatgtgatggaggagatggtggtgtcctgtgtgatcaagcacctgaacctggtggatgccctgcagagcctcatcaacttccagtaccaggaggagcacgccgaggagtatgacctgctgtgcaagatcatgggagagaccttcaagaagctgaatgccatggagcggcagctgcagagcgtggccgagctggagcagaagtggcagagcgaggtggatgatgccatgcagggcaagctggagaacaacatgcccttcttctatgactaccacttcaatgaaaacaagatgaaggagctggagctgctgtgcagcatgaaggaggtgtcctttgatggaaatgacctggagaacatggtgctgagcctgcgggagaagttcctgcaggaggtgaacagcctcatccagaagcccagccaccccctggccaagaccaagaccctggtgaagagcctgatgaacagagctgagctgctgctgcacgtgaccatcgccgcccagagcggcctgaccaggagcatcagcggcaccccagctgagaccccagcctgcaagagcgccagcgagaccaaggtgatcagccatgctgtgcggcagcccgtcttcctgcgctccatgtctgcccccagcgacctggagatgattggaaatgaagacctggagttcacccgggccaaccagaggagaagacatgtgaccagccacaggagcagcagcttcaccctgctgcagagcctggccatcgaggacagccgggacaagcccacctacagcgtgctgctgggccagctgtttgccttcatcggcaccaacccagaccaggccgtgagcagcagcagcttcctgctggccgcccagacccgctggaggcggggcaacaccaggaagcaggccctggtgcacatgagggagctgctgacagctgctgtgcgggtgggcggcgtgacccacctggtgggccctgtgaccatggtgctgcagggcggcccccgcatcgaggagctgacctgtggcggcatggtggagcaggtgcaggaggccttcggggagaccatgacctctgtggtgtccctgtgtgcccgctaccccatcgcctgtgccaacagcatcggcctgctgtgcaccatcccctacaccaggtctgaggagaagtgcctggtgcgcagcggcctggtgcagctgatggaccggctgtgcagcctgagcaaccagacagagagcagcagcagcgagaagcagaccaagaagcagaaggtggccaccatggcctgggccgccttccaggtgctggccaacagatgtgtggagtgggagaaggaggagggcggcagcacagaagctgtgcacagcggcctggcccggcaggtgagcagcctgctgaccaaccacctggcccgggccacagagtgctgcggcaaccaggccgctggaaatgatgccctgcaggatgtgctgagcctgctgaatgacctgagccgcagccacatcggcaaggccatcctgagccagcctgcctgtgtgtccaagctgctgagcctgctgctggaccagaggcccagccccaagctggtgctgatcatcctgcagctgtgcagagctgccctgcccctgatgtctgtggaggactgtggaaatgtggagctgcccccctggagctacagcgtgcccagcctgaacagcgagcaggaggaccccagcgaccctgccagcaagatcgccagcctgctgctggccaagctggccgactatgtggtgcccggctgccagacagtgctgagccccacagccagcgagccagacaccaccctgaccaagaccagccccaagaacagcctgaagggggacaaggaccccggggaggagagcgaggccgtggatggcaagctgagcatcttcatccacaagcgggaggaccagagcagccatgaggtgctgcagcccctgctgagcagcagcgagggccggcccttccggctgggcactggagccaacatggagaaggtggtgaagatggaccgggacatgaccaagggcggctgctgtgaggtgatcacagaggaggccgccgccgccctgaggaaggccaccaagtgggcccagagcggcctcatcgtgtccatcggcccccctgtggagagcatcaaccctgagaccgtgtctggcctgagcactggagacaagaagaagacagcccagaccagcatctgccgggagagaaattctgagctggccaggacagatcctgtgcggcccttcatcagcggccacgtggccaacagcatggctgctgaggtgattgccctgctgcacagcctgctgatggcccctgagagcaatgctgcccagatctggaccaccacagctgagaaggtgctgagccgggccctgatgtacatcccccagctgggcaagtatgcagagagcatcctggagaatggcagcagcagcggcaggaagctggccaagctgcagagaattgcccggcaggccgtggccgccctgtgtgccctgggcggcttcaaggagaccatcaagattggcagcgaggtgcaggtgctgggccggggcatcagcggcagcattggagtggtggccagcatcaatgagcaggagggcatcgccaccgtgcgcttcccccccatcgactgcaggaagaccagccaggccagtgacaccctgaccatccccctgagccggctgtgtgtgcccaggtctgaggccctgcccctgcacaagctgagcatcacagagaaggtggtgcaggccgtgcagagcatgctgctgccccaggagggcagcctgagcatccacaccagcctgcctgccactggagatggcagcgcccctgtgatggctgtggtgcggctgctggccgagatccgcacccgggcctgcctggtgatggcccagctgctggaggacagcctcttctgtgaggagttcatccagcagtgcccagctgctgtggaggtgctgaacctggtggcccaggagtgcagcgctggggagcggctggccgtggtggaggtgcagtgtgagcggctgaggatgctgtacagagactgtgcccggcccccacctccacccctgcaggccgaccggcggcagcccaaggagatcacctggagccccagcagggtcttcccccctgtgcgggcctgcatgttcagcagccacctgacctctgtgaccttcctggccgaccccagcgctgggggcggcctgccccggggcaccttcatctatgccaccagccccctgcctgtgcaggcccccagcttctactgggagattgagatcgtgtcctatggagacacagatgatgacaccggccccatcgtgtcctttggcttcaccacagaggccgagaagagagatggagcctggaccaaccctgtgggcacctgcctcttccacaacaacggccgggctgtgcactacaacggcagcagcctgctgcagtggaagtctgtgcggctggatgtgaccctgagccctggagatgtggccggcatcggctgggagaggacagagggcaccccacctcctcctggccagcctgccaagggccgggtgtacttcacctactgcggccagaggctgagcccctacctggaggatgtgtctgggggcatgtggcctgtggtgcacatccagaagaagaacaccaagacccgggccaactttggcagccggccctttgcctatgcagagggccaggcccacagaaatgctgctgacctgtgcacagacctggccgaggagatcagcgccaactttgaggccctgccctttgccatggccagtgacagcgacaatgatgctggcaccagcatcgccagtgaccccggcacccacggccccccctgcagaattgctgctgtggccacagcccagcagcagtatgacagcgacaccagctgccactacaaggtggagctgtcctatgagaacttcatcaccagcggccctgacccccaccccccacccatcgcagatgatgaaagtgatgatgatgatgatgatgacatcccccaggaggaccactacgccctgctggtgaaggcctgggagaccaaggtgttccccaccatcagaagacgcttcagaaatgaagctgagaggaagagcggcctggaccagatcaagggggccctgcagctgggcatggtggacatcgcccggcagacagtggagttcctgtatgaggagaatggaggcatcccccgggacctgtacctgcccaccatcgaggacatcaaggatgaggccaacaagttcaccatcgacaaggtgaggaagggcctgactgtggtgaccaggagcccagacagcaacaacgtggccagcagcgctgtgggcacagccctgcccaagtttgccatccggggcatgctgaagaccttcggcctgcacggcgtggtgctggatgtggacagcgtgaatgagctggtgcaggtggagacctacctgcggagtgaaggagtgctggtgcgctactggtaccccatcgacatgctggagcggcccccagctggctacagaagaacagccaccaacggcctggtgaccctggacaacaccaacctgcagatccaccgggagctgctgcgctgtgaggccgccctggcccggctgtactgcaggatggccctgctgaacatctttgcccccaagctgccccacctgttcaccaggctcttccacatcccagccatccgggacatcaccctggagcacctgcagctgctgagcaaccagctgctggccccacccctgcctgatggcaccatcagcagcagcagcatcctgctggcccagagcctgcagcactgcatccacagccagaactgcagcgccacagacctcttctaccagggcaacagccagacagtgcgggagtggctgaatgtggccatcaccaggaccctgcaccagggcgaggagagcctgctggagctgaccaagcagatctgcagcttcctgcagacagcccctgagcagttccccagcgaggagttccccatcagcgagagcaaggtgaacatggatgtgaacttccctggggccgcctttgtggtggtgtcctgcaaggagagccagagcggcttcaggaaggacagcagcctgtacaaggccccctgggcccgggtgctggtgtatggcctgggccacaaggtgaagagaaatggccagctgaacctgattgaggccgcctgctaccccagagatgccagccctgccaacacaggcctggcccccccacccacagctgaccagtaccccagcgtggtgctgagcacagacagagtgcacatcaagctgggcgtgtccccacctcctggagctgtgctggtgctgcacagcctgcccctggagttccccctggccatggcctttgctgagcagctgctgtcctggaagtctgaggacagcgagggcaagtcagaagatgagccagacaccatccccacctctgtgctgctgcaggtggtggagctgctgggcaacttcctgtggaccacagacatggccgcctgtgtgaaggagctggtgttccacctgctggccgagctgctgaggacagtgcacaccctggagcagaggaggcaccctgctggcctgagcagcagcatcgccctgcagctgaacccctgcctggccatgctgatggccctgcagagcgagctgcacaagctgtatgatgaggagacccagaactgggtgtctgggggcgcctgtggcggcagcggcggcgctgctgctggggaccagggccgcttcagcacctacttccacgccctgatggagggctgcctggccgtggccgaggtgaccctgcccaccaacatgtctgtgacagccagcggcgtgaccagcgccacagcccccaacctgagtgacagcagcagcagcagcagcagcagccctggccagaccccccagagccccagcctgctgagcaagaggaagaaggtgaagatgaagcgggagaaggccagcagcagcggcaagaggcagagcagcaggacagtggacagcgaccccaccgtgctgagcattggaggcagcaagccagaggacatgctgtggttccaccgggccctgaccctgctgatcatcctgcggcacctgaccaggaaggacccccagggcctgggcgtgaccagtgatgccatcgcagatgcctgccaggccctggtgggccccacagcccacagccggctgctggtgatcagcggcatccccacccacctggatgaaggagtggtgcggggggccatcaggaaggcctgcaatgcccacggcggcgtcttcaaggatgagatctacatccccctgcaggaggaggacaccaagaagcccaaggacaaggccgagggcggagatggcaaggtggagcctgagaagaccctggccttccctggaacagacagcatggaggtgtccaccagcagcagcctgaccccagccatgagcatcagcgccagcgccagcaccagccaggccagcatctgcagcagccagggcatcagccagacagtgtctgacctgtctgtggaccccctgcctgctggcctggagctgcccatccccccaggcctgctggagccccatgctgtgagcagccaggagagcctggacatcagcctgtgcagcacaggcagcctgggcagcctgggcagcctgggggagcccctggacaatgctgagacagcctctgtgtctgacatgggctccatgtacacagtgaccagcctggacaaccagcccctggccgcccggcccatcaagggctttgctgtggtggagatccgcagccgggccaagattgagaagatccgggccagcctcttcaacaacaatgacctgattggcctgagcagcctggatggagaagatgagctgatggagatgagcacagaggagatcctgactgtgtctgtggtgaaccagagcctgtttgacacccagggcagccctggcctggaggactacttcaatgacaagagcatcaagggggagaagctggtgcctggggcccgggaggtgctgacagagatcttcaagagctgtgcccacagcgagcagaccctgagcctgaccccagccaagcccatccgggtgtctgacatctacctgagcaaggagcagatcaacagccagaccccaggcaacctgctgcacctgttcttcaccaacgtgcggccccccaagaaggtgctggaggaccagctgacccagatcctgaggaaatatggagtgcccaagcccaagtttgacaagagcaagtacagcaaggccggcaaggagcagcaccctgtgaaggtggtgtccaccaagaggcccatcaccaagcccccagccaaggacaaggctgtgctgaacagcgtgtccaggacagccctgtctgagaagaagcccaccgtgaagcccaagagccctgagaagagcaagccagatgagaaggaccctgagaagagccccaccaagaagcaggaggtgcctgaggagaagtacctgaccctggagggcttccacaagtttgtgattgaccgggcccggcaggacatccgctctgtgtggagggccatcctgagctgtggctatgacctgcactttgagcgctgtgcctgcattgatgtgagacatgcccagaaggccagcaggaagtggaccctggagatggatgtggccctggtgcagtacatcaaccagctgtgccgccacctggccatcaccccagcccggctgcacccccatgaggtgtacctggaccctgcagatgctgctgacccccgggtggcctgcctgctgaatgtgcccatcgagagcctgcggctgcgctttgccctgctgcagagcctgaacaccaccctggagaccttcttcctgcccctggtggagctgcggcagacccccatgtacacccacagcattgctgccctgctgaaggaggccaagggcctcatcttctatgacaccaaggtgacagtgatgaacagagtgctgaatgccaccgtgcagaggacagctgaccacgccgcccctgagatcaccctggaccccctggagatcgtgggcggggagatccgggccagcgagaacagctacttctgccaggccgcccggcagctggcctctgtgcccagcagccagctgtgtgtgaagctggccagcggcggggaccccacctacgccttcaacatccgcttcaccggggaggaggtgcacggcaccagcggcagcttccgccacttcctgtggcaggtgtgcaaggagctgcagagcagcagcctgagcctgctgctgctgtgccccagcagcgctgtgaacaagaacaagggcaagtacatcctgacccccagccccatcacctacggggaggagcagctgctgcacttcctgggccagctgctgggcatcgccatccgggcagatgtgcccctgcccctggacctgctgcccagcttctggaagaccctggtgggggagcccctggaccctgagcaggacctgcaggaggccgacatcctgacctacaactacgtgaagaagtttgagagcatcaatgatgaaacagagctggaggccctgtgtgccgagatcgccagccagcacctggccacagagagcccagacagccccaacaagccctgctgccgcttcacctacctgaccatgaccggggaggaggtggagctgtgcagccggggccgccacatcctggtggcctgggagaacaaggacatctatgctgctgccatccgcagcctgcggctgcgggagctgcagaatgtggagtgtgtgacagctgtgcgggccggcctgggcagcatcatccccctgcagctgctgaccatgctgagccccctggagatggagctgcggacctgtggcctgccctacatcaacctggagttcctgaaggcccacaccatgtaccaggtgggcctgatggagacagaccagcacatcgagttcttctggggcgccctggagatgttcacccaggaggagctgtgcaagttcatcaagtttgcctgcaaccaggagcgcatccccttcacctgcccctgcaaggatggcggccctgacacagcccacgtgcccccctaccccatgaagatcgcccccccagatggaacagctggcagcccagacagccgctacatccgggtggagacctgcatgttcatgatcaagctgccccagtacagcagcctggagatcatgctggagaagctgcgctgtgccatccactaccgggaggaccccctgtctggatag

SEQ ID NO: 33107 - DNA, 849 bp, Artificial Sequence
  Description of Artificial Sequence: Synthetic coding sequence
atggagagcaggatgtggccagccctgctgctgagccacctgctgcccctgtggcccctgctgctgctgcccctgcccccaccagcccagggcagcagcagcagccccaggaccccaccagccccagcccggcccccctgtgcccggggcggccccagcgcccccaggcatgtgtgtgtgtgggagcgggcccccccacccagccgcagcccccgggtgcccaggagccggcggcaggtgctgcccggcacagcccccccagccaccccatctggctttgaggagggcccccccagcagccagtacccctgggccatcgtgtggggccccaccgtgtccagagaagatggaggagaccccaacagcgccaaccctggcttcctggactatggctttgctgccccccacggcctggccaccccccaccccaacagcgacagcatgagaggagatggagatggcctcatcctgggggaggccccagccaccctgcggcccttcctgtttggaggccgcggggagggcgtggacccccagctgtatgtgaccatcaccatcagcatcatcatcgtgctggtggccaccggcatcatcttcaagttctgctgggacaggagccagaagagaagaagaccttctggccagcagggcgccctgcggcaggaggagagccagcagcccctgacagacctgagccctgctggggtgacagtgctgggcgccttcggggacagccccacccccaccccagaccacgaggagccccggggcggccccaggcctggcatgccccaccccaagggggccccagccttccagctgaaccgcatccccctggtgaacctgtag

SEQ ID NO: 33108 - DNA, 771 bp, Artificial Sequence
  Description of Artificial Sequence: Synthetic coding sequence
atggagagcaggatgtggccagccctgctgctgagccacctgctgcccctgtggcccctgctgctgctgcccctgcccccagcccccaggcatgtgtgtgtgtgggagcgggcccccccacccagccgcagcccccgggtgcccaggagccggcggcaggtgctgcccggcacagcccccccagccaccccatctggctttgaggagggcccccccagcagccagtacccctgggccatcgtgtggggccccaccgtgtccagagaagatggaggagaccccaacagcgccaaccctggcttcctggactatggctttgctgccccccacggcctggccaccccccaccccaacagcgacagcatgagaggagatggagatggcctcatcctgggggaggccccagccaccctgcggcccttcctgtttggaggccgcggggagggcgtggacccccagctgtatgtgaccatcaccatcagcatcatcatcgtgctggtggccaccggcatcatcttcaagttctgctgggacaggagccagaagagaagaagaccttctggccagcagggcgccctgcggcaggaggagagccagcagcccctgacagacctgagccctgctggggtgacagtgctgggcgccttcggggacagccccacccccaccccagaccacgaggagccccggggcggccccaggcctggcatgccccaccccaagggggccccagccttccagctgaaccgcatccccctggtgaacctgtag

SEQ ID NO: 33109 - DNA, 831 bp, Artificial Sequence
  Description of Artificial Sequence: Synthetic coding sequence
atggagagcaggatgtggccagccctgctgctgagccacctgctgcccctgtggcccctgctgctgctgcccctgcccccaccagcccagggcagcagcagcagccccaggaccccaccagccccagcccggcccccctgtgcccggggcggccccagcgcccccaggcatgtgtgtgtgtgggagcgggcccccccacccagccgcagcccccgggtgcccaggagccggcggcaggtgctgcccggcacagcccccccagccaccccatctggctttgaggagggcccccccagcagccagtacccctgggccatcgtgtggggccccaccgtgtccagagaagatggaggagaccccaacagcgccaaccctggcttcctggactatggctttgctgccccccacggcctggccaccccccaccccaacagcgacagcatgagaggagatggagatggcctcatcctgggggaggccccagccaccctgcggcccttcctgtttggaggccgcggggagggcgtggacccccagctgtatgtgaccatcaccatcagcatcatcatcgtgctggtggccaccggcatcatcttcaagttctgctgggacaggagccagaagagaagaagaccttctggccagcagggcgccctgcggcaggaggagagccagcagcccctgacagacctgagccctgctggggtgacagtgctgggcgccttcggggacagccccacccccaccccagaccacgaggagccccggggcggccccaggcctggcatgccccaccccaagggggccccagccttccagctgaacagatag

SEQ ID NO: 33110 - DNA, 849 bp, Artificial Sequence; identical to SEQ ID NO: 33107
  Description of Artificial Sequence: Synthetic coding sequence

SEQ ID NO: 33111 - DNA, 492 bp, Artificial Sequence
  Description of Artificial Sequence: Synthetic coding sequence
atgtcctggaggccccagccctgctgcatcagcagctgctgcctgaccacagactgggtgcacctgtggtacatctggctgctggtggtgattggagccctgctgctgctgtgtggcctgaccagcctgtgcttccgctgctgctgcctgagccggcagcagaatggagaagatggcggccccccaccctgtgaggtgacagtgattgcctttgaccatgacagcaccctgcagagcaccatcaccagcctgcagagcgtgtttggacctgctgcccggcgcatcctggccgtggcccacagccacagcagcctgggccagctgcccagcagcctggacaccctgcccggctatgaggaggccctgcacatgagccgcttcaccgtggccatgtgtggccagaaggccccagacctgccccctgtgcctgaggagaagcagctgcccccaacagagaaggagagcacccgcatcgtggacagctggaactag

SEQ ID NO: 33112 - DNA, 552 bp, Artificial Sequence
  Description of Artificial Sequence: Synthetic coding sequence
atgggcgtgcgggtgcacgtggtggccgccagcgccctgctgtacttcatcctgctgagcggcacccgctgtgaggagaactgtggcaaccctgagcactgcctgaccacagactgggtgcacctgtggtacatctggctgctggtggtgattggagccctgctgctgctgtgtggcctgaccagcctgtgcttccgctgctgctgcctgagccggcagcagaatggagaagatggcggccccccaccctgtgaggtgacagtgattgcctttgaccatgacagcaccctgcagagcaccatcaccagcctgcagagcgtgtttggacctgctgcccggcgcatcctggccgtggcccacagccacagcagcctgggccagctgcccagcagcctggacaccctgcccggctatgaggaggccctgcacatgagccgcttcaccgtggccatgtgtggccagaaggccccagacctgccccctgtgcctgaggagaagcagctgcccccaacagagaaggagagcacccgcatcgtggacagctggaactag

SEQ ID NO: 33113 - DNA, 552 bp, Artificial Sequence; identical to SEQ ID NO: 33112
  Description of Artificial Sequence: Synthetic coding sequence

SEQ ID NO: 33114 - DNA, 273 bp, Artificial Sequence
  Description of Artificial Sequence: Synthetic coding sequence
atgggcgtgcgggtgcacgtggtggccgccagcgccctgctgtacttcatcctgctgagcggcacccgctgtgaggagaactgtggcaaccctgagcactgcctgaccacagactgggtgcacctgtggtacatctggctgctggtggtgattggagccctgctgctgctgtgtggcctgaccagcctgtgcttccgctgctgctgcctgagccggcagcagaatggagaagatggcggccccccaccctgtgaggtgacagtgattgcctag

SEQ ID NO: 33115 - DNA, 174 bp, Artificial Sequence
  Description of Artificial Sequence: Synthetic coding sequence
atgcccaccgggaagcagctggccgacatcggctacaagaccttcagcacctccatgatgctgctgactgtgtatggaggctacctgtgcagcgtgcgggtgtaccactacttccagtggaggcgggcccagaggcaggccgctgaggagcagaagaccagcggcatcatgtag

SEQ ID NO: 33116 - DNA, 174 bp, Artificial Sequence; identical to SEQ ID NO: 33115
  Description of Artificial Sequence: Synthetic coding sequence

SEQ ID NO: 33117 - DNA, 174 bp, Artificial Sequence; identical to SEQ ID NO: 33115
  Description of Artificial Sequence: Synthetic coding sequence

SEQ ID NO: 33118 - DNA, 174 bp, Artificial Sequence; identical to SEQ ID NO: 33115
  Description of Artificial Sequence: Synthetic coding sequence

SEQ ID NO: 33119 - DNA, 678 bp, Artificial Sequence
  Description of Artificial Sequence: Synthetic coding sequence
atggcccagagcgacttcctgtacccagagaaccccaagaggcgggaggaggtgaaccggctgcaccagcagctgctggactgcctgagtgacagctttgatgtgaccaacaagctgacagaggtgctgaacatgcacctgggctgccgcctggccagcattgagatgaagagagatggcaccatcaaggagaactgtgacctgatcatccaggccatcatgaagatccagaaggagctgcagaaggtggatgaggccctgaaggacaagctggagcccaccctgtacaggaagctgcaggacatcaaggagaaggagacagacaagatcgccatcgtgcagaaggtgatcagcgtcatcctgggggaggccaccagcgctgccagcgctgtggccgtgaagctggtgggcagcaatgtgaccaccggcatcatcaacaagctggtgacagtgctggcccagattggagccagcctgctgggcagcattggagtggccgtgctgggcctgggcatcgacatgattgtgcgggccatcctgggcgctgtggagaagacccagctgcaggccgccatcaagagctatgagaagcacctggtggagttcaagagcgccagcgagaagtacaaccacgccatcacagaggtgatcaacacagtgaagcaccagatgaagtag

SEQ ID NO: 33120 - DNA, 456 bp, Artificial Sequence
  Description of Artificial Sequence: Synthetic coding sequence
atggagtatgtgctggaggtgaagaacagccccaggcacctgctgaagcagttcaccgtgtgtgatgtgcccctgtatgacatctgtgactacaacgtgtcccgggaccgctgccaggagctgggctgctgcttctatgagggcgtgtgctacaagaaggctgtgcccatctacatccacgtgttttctgccctgattgtcatcatcgccggggcctttgtgatcaccatcatctacagagtcatccaggagagcaggaaggagaaggccatccctgtggatgtggccctgccccagaagagcagcgagaaggccgagctggccagcagcagcagcaagctgggcctgaagccagccagccctggccccccatctgctggccccagcatgaagagtgatgaggacaaggatgatgtgacaggcaccatcacagaggccgaggagacagaggactag

SEQ ID NO: 33121 - DNA, 258 bp, Artificial Sequence
  Description of Artificial Sequence: Synthetic coding sequence
atggaggccggggagagaattgatgccagccagctgccccaccgggtgctggagacccggggccacgccatcagcatcctgtttggcttctggaccagcttcatctgtgacacctacatcgtgctggcctggatcagcaagatcaagggcagcccagatgtgtctgccagcagtgatgagccctatgcccgcatccagcagagccggcggcagtgccacgccgaggaggaccagagccaggtgcctgaggccggctag

SEQ ID NO: 33122 - DNA, 2124 bp, Artificial Sequence
  Description of Artificial Sequence: Synthetic coding sequence
atgagcccccatggagatggccggggccaggcccagggccgggctgtgcgggtgggcctgcggcgcagcggcggcatccggggcggcgtggccgtgtttgctgctgtggccgctgtgttcaccttcaccctgcccccatctgtgcctggaggagacagcggggagctgatcacagctgcccacgagctgggcgtggcccaccccccaggctaccccctcttcaccctggtggccaagctggccatcaccctcttccccttcggcagcatcgcctacagagtgaacctgctgtgtggcctgtttggagctgtggccgccagcctgctcttcttcaccgtcttccggctgagcggcagcagcgctgggggcatcctggccgccggggtcttctccttcagccggctgacctggcagtggagcattgctgctgaggtgttcagcctgaacaacctgtttgtgggcctgctgatggccctgactgtgcactttgaggaggccgccacagccaaggagaggagcaaggtggccaagatcggggccttctgctgcggcctgagcctgtgcaaccagcacaccatcatcctgtatgtgctgtgcatcatcccctggatcctcttccagctgctgaagaagaaggagctgagcctgggcagcctgctgaagctgagcctgtacttctctgctggcctgctgccctacgtgcacctgcccatcagcagctacctgaaccacgcccgctggacctggggagaccagaccaccctgcagggcttcctgacccacttcctgcgggaggagtatggcaccttcagcctggccaagtcagaaattggcagctccatgtctgagatcctgctgagccaggtgaccaacatgaggacagagctgtccttcaacatccaggccctggccgtgtgtgccaacatctgcctggccaccaaggaccggcagaaccccagcctggtgtggctgttcaccggcatgttctgcatctacagcctcttctttgcctggagggccaacctggacatcagcaagcccctcttcatgggcgtggtggagcgcttctggatgcagagcaatgctgtggtggccgtgctggccggcatcggcctggccgctgtggtgtctgagaccaacagagtgctgaacagcaatggcctgcagtgcctggagtggctgagcgccaccctgtttgtggtgtaccagatctacagcaactacagcgtgtgtgaccagaggaccaactacgtgattgacaagtttgccaagaacctgctgacctccatgcctcatgatgccatcatcctgctgcggggggacctgcccggcaacagcctgcgctacatgcactactgtgagggcctgcggccagacatcagcctggtggaccaggagatgatgacctatgagtggtacctgcccaagatggccaagcacctgcccggggtgaacttccctggcaaccgctggaaccctgtggagggcatcctgcccagcggcatggtgaccttcaacctgtaccacttcctggaggtgaacaagcagaaggagacctttgtgtgcatcggcatccacgagggggaccccacctggaagaagaactacagcctgtggccctggggcagctgtgacaagctggtgcccctggagatcgtgttcaaccctgaggagtggatcaagctgaccaagagcatctacaactggacagaggagtatggccgctttgaccccagctcctgggagagcgtggccaatgaggagatgtggcaggccaggatgaagacccccttcttcatcttcaacctggccgagacagcccacatgcccagcaaggtgaaggcccagctgtatgcccaggcctatgacctgtacaaggagatcgtgtacctgcagaaggagcaccctgtgaactggcacaagaactatgccatcgcctgtgagaggatgctgcggctgcaggccagagatgctgaccctgaggtgctgctgtctgagaccatccgccacttccggctgtacagccagaaggccccaaatgacccccagcaggccgacatcctgggcgccctgaagcacctgaggaaggagctgcagagcctgaggaacaggaagaatgtgtag

SEQ ID NO: 33123 - DNA, 726 bp, Artificial Sequence
  Description of Artificial Sequence: Synthetic coding sequence
atgatgacctatgagtggtacctgcccaagatggccaagcacctgcccggggtgaacttccctggcaaccgctggaaccctgtggagggcatcctgcccagcggcatggtgaccttcaacctgtaccacttcctggaggtgaacaagcagaaggagacctttgtgtgcatcggcatccacgagggggaccccacctggaagaagaactacagcctgtggccctggggcagctgtgacaagctggtgcccctggagatcgtgttcaaccctgaggagtggatcaagctgaccaagagcatctacaactggacagaggagtatggccgctttgaccccagctcctgggagagcgtggccaatgaggagatgtggcaggccaggatgaagacccccttcttcatcttcaacctggccgagacagcccacatgcccagcaaggtgaaggcccagctgtatgcccaggcctatgacctgtacaaggagatcgtgtacctgcagaaggagcaccctgtgaactggcacaagaactatgccatcgcctgtgagaggatgctgcggctgcaggccagagatgctgaccctgaggtgctgctgtctgagaccatccgccacttccggctgtacagccagaaggccccaaatgacccccagcaggccgacatcctgggcgccctgaagcacctgaggaaggagctgcagagcctgaggaacaggaagaatgtgtag

SEQ ID NO: 33124 - DNA, 1230 bp, Artificial Sequence
  Description of Artificial Sequence: Synthetic coding sequence
atgagcccccatggagatggccggggccaggcccagggccgggctgtgcgggtgggcctgcggcgcagcggcggcatccggggcggcgtggccgtgtttgctgctgtggccgctgtgttcaccttcaccctgcccccatctgtgcctggaggagacagcggggagctgatcacagctgcccacgagctgggcgtggcccaccccccaggctaccccctcttcaccctggtggccaagctggccatcaccctcttccccttcggcagcatcgcctacagagtgaacctgctgtgtggcctgtttggagctgtggccgccagcctgctcttcttcaccgtcttccggctgagcggcagcagcgctgggggcatcctggccgccggggtcttctccttcagccggctgacctggcagtggagcattgctgctgaggtgttcagcctgaacaacctgtttgtgggcctgctgatggccctgactgtgcactttgaggaggccgccacagccaaggagaggagcaaggtggccaagatcggggccttctgctgcggcctgagcctgtgcaaccagcacaccatcatcctgtatgtgctgtgcatcatcccctggatcctcttccagctgctgaagaagaaggagctgagcctgggcagcctgctgaagctgagcctgtacttctctgctggcctgctgccctacgtgcacctgcccatcagcagctacctgaaccacgcccgctggacctggggagaccagaccaccctgcagggcttcctgacccacttcctgcgggaggagtatggcaccttcagcctggccaagtcagaaattggcagctccatgtctgagatcctgctgagccaggtgaccaacatgaggacagagctgtccttcaacatccaggccctggccgtgtgtgccaacatctgcctggccaccaaggaccggcagaaccccagcctggtgtggctgttcaccggcatgttctgcatctacagcctcttctttgcctggagggccaacctggacatcagcaagcccctcttcatgggcgtggtggagcgcttctggatgcagagcaatgctgtggtggccgtgctggccggcatcggcctggccgctgtggtgtctgagaccaacagagtgctgaacagcaatggcctgcagtgcctggagtggctgagcgccaccctgtttgtggtgtaccagatctacagcaactacagatag

SEQ ID NO: 33125 - DNA, 396 bp, Artificial Sequence
  Description of Artificial Sequence: Synthetic coding sequence
atgatgaacttccggcagaggatgggctggattggagtgggcctgtacctgctggccagcgctgctgccttctactacgtgtttgagatcagcgagacctacaaccggctggccctggagcacatccagcagcaccctgaggagcccctggagggcaccacctggacccacagcctgaaggcccagctgctgagcctgcccttctgggtgtggacagtcatcttcctggtgccctacctgcagatgttcctgttcctgtacagctgcaccagggctgaccccaagacagtgggctactgcatcatccccatctgcctggccgtcatctgcaacagacaccaggcctttgtgaaggccagcaaccagatcagccggctgcagctgattgacacctag

SEQ ID NO: 33126 - DNA, 510 bp, Artificial Sequence
  Description of Artificial Sequence: Synthetic coding sequence
atgctggccttcagcgagatgcccaagcccccagactacagcgagctgagtgacagcctgaccctggccgtgggcaccggccgcttcagcggccccctgcaccgggcctggaggatgatgaacttccggcagaggatgggctggattggagtgggcctgtacctgctggccagcgctgctgccttctactacgtgtttgagatcagcgagacctacaaccggctggccctggagcacatccagcagcaccctgaggagcccctggagggcaccacctggacccacagcctgaaggcccagctgctgagcctgcccttctgggtgtggacagtcatcttcctggtgccctacctgcagatgttcctgttcctgtacagctgcaccagggctgaccccaagacagtgggctactgcatcatccccatctgcctggccgtcatctgcaacagacaccaggcctttgtgaaggccagcaaccagatcagccggctgcagctgattgacacctag

SEQ ID NO: 33127 - DNA, 522 bp, Artificial Sequence
  Description of Artificial Sequence: Synthetic coding sequence
atgatggcccagctgttcctgctgcaggccaatgctgtgctgcccctgagccatgagatcaaggtgaagaggcagatccggctgcctgcccccctgtacccacctgagagaaatgacagccgctccttccagatcccccaggacctgcgggagaagggctgggaggagggccagcagcactttgctgggaaggccgcagatgccttccctgcccctgtgcagctggagggcctggaggccggccagaccaccctggccagccctgaggtgggcccctggaggcccaagaggctgtctggagtgtgcctgctgagcgccctgctgcctgacccctgcaagaccaacggcaccttcctgctgcagaagcaccacctgcccagcctgctggccgtcatcctcttccctgtgatcatcctgaccggggccagctttgcccacctgtttgtggccctgtttgtgagccacctgctgctgaagctgcccctgggcgccggcatgaggatgcagagagatgccaggtag

SEQ ID NO: 33128 - DNA, 522 bp, Artificial Sequence; identical to SEQ ID NO: 33127
  Description of Artificial Sequence: Synthetic coding sequence

SEQ ID NO: 33129 - DNA, 2817 bp, Artificial Sequence
  Description of Artificial Sequence: Synthetic coding sequence
atgcctgccctggagcacatgaaccagatcctgcacatcctgtttgtgttcctgcccttcctgtgggccctgggcaccctgcccccaccagatgccctgctgctgtgggccatggagcaggtgctggagtttggcctgggcggcagctccatgagcacccacctgcggctgctggtgatgttcatcatgtctgctggaacagccatcgccagctacttcatccccagcacagtgggcgtggtgctcttcatgactggatttggcttcctgctgagcctgaacctgagtgacatgggccacaagattggcaccaagagcaaggacctgcccagcggccctgagaagcacttctcctggaaggaatgtctcttctacatcatcatcctggtgctggccctgctggagaccagcctgctgcaccactttgctggcttcagccagatcagcaagagcaacagccaggccatcgtgggctacggcctgatgatcctgctgatcatcctgtggatcctgcgggagatccagagcgtgtacatcatcggcatcttcaggaaccccttctaccccaaggatgtgcagacagtgaccgtcttctttgagaagcagacccggctgatgaagattggcatcgtgcggcgcatcctgctgaccctggtgagcccctttgccatgattgccttcctgagcctggacagcagcctgcagggcctgcacagcgtgtctgtgtgcatcggcttcacccgggccttcaggatggtgtggcagaacacagaaaatgccctgctggagaccgtcatcgtgtccacagtgcacctgatcagcagcacagacatctggtggaacagaagcctggacaccggcctgcggctgctgctggtgggcatcatccgggacaggctcatccagttcatcagcaagctgcagtttgctgtgacagtgctgctgacctcctggacagagaagaagcagaggaggaagaccacagccaccctgtgcatcctgaacatcgtgttcagcccctttgtgctggtgatcatcgtgttcagcaccctgctgagcagccccctgctgcccctcttcaccctgcctgtgttcctggtgggcttcccccggcccatccagagctggccaggagctgctggcaccacagcctgtgtgtgtgccgacacagtgtactactaccagatggtgccccggctgacagctgtgctgcagacagccatggccgccggcagcctgggcctgctgctgcccggcagccactacctgggccgcttccaggaccggctgatgtggatcatgatcctggagtgtggctacacctactgcagcatcaacatcaagggcctggagctgcaggagaccagctgccacacagctgaggccaggagagtggatgaggtgtttgaagatgcctttgagcaggagtacaccagggtgtgcagcctgaatgagcactttggaaatgtgctgaccccctgcaccgtgctgcctgtgaagctgtacagtgatgccagaaatgtgctgagcggcatcatcgacagccatgagaacctgaaggagttcaagggggacctgatcaaggtgctggtgtggatcctggtgcagtactgcagcaagaggcctggcatgaaggaaaatgtgcacaacacagagaacaagggcaaggcccccctgatgctgcctgccctgaacaccctgcccccacccaagagccctgaggacatcgacagcctgaacagcgagaccttcaatgactggagcgatgacaacatctttgatgatgagcccaccatcaagaaggtgattgaggagaagcaccagctgaaggacctgcccggcaccaacctcttcatccctggctctgtggagagccagagggtgggggaccacagcactggaacagtgcctgaaaatgacctgtacaaggctgtgctgctgggctacccagctgtggacaagggcaagcaggaggacatgccctacatccccctgatggagttcagctgcagccacagccacctggtgtgcctgcctgctgagtggaggaccagctgcatgcccagcagcaagatgaaggagatgagcagcctcttccctgaggactggtaccagtttgtgctgcggcagctggagtgctaccacagcgaggagaaggccagcaatgtgctggaggagatcgccaaggacaaggtgctgaaggacttctacgtgcacacagtgatgacctgctacttcagcctgtttggaattgacaacatggcccccagccctggccacatcctgcgggtgtatggaggagtgctgccctggagcgtggccctggactggctgacagagaagccagagctgttccagctggccctgaaggccttccgctacaccctgaagctgatgattgacaaggccagcctgggccccatcgaggacttccgggagctgatcaagtacctggaggagtatgagcgggactggtacatcggcctggtgtctgatgagaagtggaaggaggccatcctgcaggagaagccctacctgttcagcctgggctatgacagcaacatgggcatctacacaggccgggtgctgagcctgcaggagctgctgatccaggtgggcaagctgaaccctgaggccgtgcggggccagtgggccaacctgtcctgggagctgctgtatgccaccaatgatgatgaggagcgctacagcatccaggcccaccccctgctgctgaggaacctgactgtgcaggccgctgagccccccctgggctaccccatctacagcagcaagcccctgcacatccacctgtactag

SEQ ID NO: 33130 - DNA, 3519 bp, Artificial Sequence
  Description of Artificial Sequence: Synthetic coding sequence
atgagcccagatgtgcccctgctgaatgactacaagcaggacttcttcctgaagcgcttcccccagacagtgctgggcggcccccgcttcaagctgggctactgtgccccaccctacatctacgtgaaccagatcatcctcttcctgatgccctgggtgtggggcggcgtgggcaccctgctgtaccagctgggcatcctgaaggactactacacagctgccctgagcggcggcctgatgctgttcaccgcctttgtgatccagttcaccagcctgtatgccaagaacaagagcaccaccgtggagcgcatcctgaccacagacatcctggccgaggaggatgagcacgagttcaccagctgcaccggggctgagaccgtgaagttcctgatccctgggaagaagtatgtggccaacacagtgttccacagcatcctggccggcctggcctgtggcctgggcacctggtacctgctgcccaaccgcatcaccctgctgtatggcagcactggaggaacagccctgctcttcttcttcggctggatgaccctgtgcatcgccgagtacagcctcatcgtgaacacagccacagaaacagccaccttccagacccaggacacctatgagatcatccccctgatgaggcccctgtacatcttcttctttgtgtctgtggacctggcccacagatttgtggtgaacatgcctgccctggagcacatgaaccagatcctgcacatcctgtttgtgttcctgcccttcctgtgggccctgggcaccctgcccccaccagatgccctgctgctgtgggccatggagcaggtgctggagtttggcctgggcggcagctccatgagcacccacctgcggctgctggtgatgttcatcatgtctgctggaacagccatcgccagctacttcatccccagcacagtgggcgtggtgctcttcatgactggatttggcttcctgctgagcctgaacctgagtgacatgggccacaagattggcaccaagagcaaggacctgcccagcggccctgagaagcacttctcctggaaggaatgtctcttctacatcatcatcctggtgctggccctgctggagaccagcctgctgcaccactttgctggcttcagccagatcagcaagagcaacagccaggccatcgtgggctacggcctgatgatcctgctgatcatcctgtggatcctgcgggagatccagagcgtgtacatcatcggcatcttcaggaaccccttctaccccaaggatgtgcagacagtgaccgtcttctttgagaagcagacccggctgatgaagattggcatcgtgcggcgcatcctgctgaccctggtgagcccctttgccatgattgccttcctgagcctggacagcagcctgcagggcctgcacagcgtgtctgtgtgcatcggcttcacccgggccttcaggatggtgtggcagaacacagaaaatgccctgctggagaccgtcatcgtgtccacagtgcacctgatcagcagcacagacatctggtggaacagaagcctggacaccggcctgcggctgctgctggtgggcatcatccgggacaggctcatccagttcatcagcaagctgcagtttgctgtgacagtgctgctgacctcctggacagagaagaagcagaggaggaagaccacagccaccctgtgcatcctgaacatcgtgttcagcccctttgtgctggtgatcatcgtgttcagcaccctgctgagcagccccctgctgcccctcttcaccctgcctgtgttcctggtgggcttcccccggcccatccagagctggccaggagctgctggcaccacagcctgtgtgtgtgccgacacagtgtactactaccagatggtgccccggctgacagctgtgctgcagacagccatggccgccggcagcctgggcctgctgctgcccggcagccactacctgggccgcttccaggaccggctgatgtggatcatgatcctggagtgtggctacacctactgcagcatcaacatcaagggcctggagctgcaggagaccagctgccacacagctgaggccaggagagtggatgaggtgtttgaagatgcctttgagcaggagtacaccagggtgtgcagcctgaatgagcactttggaaatgtgctgaccccctgcaccgtgctgcctgtgaagctgtacagtgatgccagaaatgtgctgagcggcatcatcgacagccatgagaacctgaaggagttcaagggggacctgatcaaggtgctggtgtggatcctggtgcagtactgcagcaagaggcctggcatgaaggaaaatgtgcacaacacagagaacaagggcaaggcccccctgatgctgcctgccctgaacaccctgcccccacccaagagccctgaggacatcgacagcctgaacagcgagaccttcaatgactggagcgatgacaacatctttgatgatgagcccaccatcaagaaggtgattgaggagaagcaccagctgaaggacctgcccggcaccaacctcttcatccctggctctgtggagagccagagggtgggggaccacagcactggaacagtgcctgaaaatgacctgtacaaggctgtgctgctgggctacccagctgtggacaagggcaagcaggaggacatgccctacatccccctgatggagttcagctgcagccacagccacctggtgtgcctgcctgctgagtggaggaccagctgcatgcccagcagcaagatgaaggagatgagcagcctcttccctgaggactggtaccagtttgtgctgcggcagctggagtgctaccacagcgaggagaaggccagcaatgtgctggaggagatcgccaaggacaaggtgctgaaggacttctacgtgcacacagtgatgacctgctacttcagcctgtttggaattgacaacatggcccccagccctggccacatcctgcgggtgtatggaggagtgctgccctggagcgtggccctggactggctgacagagaagccagagctgttccagctggccctgaaggccttccgctacaccctgaagctgatgattgacaaggccagcctgggccccatcgaggacttccgggagctgatcaagtacctggaggagtatgagcgggactggtacatcggcctggtgtctgatgagaagtggaaggaggccatcctgcaggagaagccctacctgttcagcctgggctatgacagcaacatgggcatctacacaggccgggtgctgagcctgcaggagctgctgatccaggtgggcaagctgaaccctgaggccgtgcggggccagtgggccaacctgtcctgggagctgctgtatgccaccaatgatgatgaggagcgctacagcatccaggcccaccccctgctgctgaggaacctgactgtgcaggccgctgagccccccctgggctaccccatctacagcagcaagcccctgcacatccacctgtactag

SEQ ID NO: 33131 - DNA, 3519 bp, Artificial Sequence; identical to SEQ ID NO: 33130
  Description of Artificial Sequence: Synthetic coding sequence

SEQ ID NO: 33132 - DNA, 897 bp, Artificial Sequence
  Description of Artificial Sequence: Synthetic coding sequence
atgctgcctgccctgaacaccctgcccccacccaagagcccagaagatattgacagcctgaacagcgagaccttcaatgactggagcgatgacaacatctttgatgatgagcccaccatcaagaaggtgattgaggagaagcaccagctgaaggacctgcccggcaccaacctcttcatccctggctctgtggagagccagagggtgggggaccacagcacaggcaccgtgcctgaaaatgacctgtacaaggctgtgctgctgggctacccagctgtggacaagggcaagcaggaggacatgccctacatccccctgatggagttcagctgcagccacagccacctggtgtgcctgcctgctgagtggaggaccagctgcatgcccagcagcaagatgaaggagatgagcagcctcttccctgaggactggtaccagtttgtgctgcggcagctggagtgctaccacagcgaggagaaggccagcaatgtgctggaggagatcgccaaggacaaggtgctgaaggacttctacgtgcacacagtgatgacctgctacttcagcctgtttggcatcgacaacatggcccccagccctggccacatcctgcgggtgtatggaggagtgctgccctggagcgtggccctggactggctgacagagaagccagagctgttccagctggccctgaaggccttccgctacaccctgaagctgatgattgacaaggccagcctgggccccatcgaggacttccgggagctgatcaagtacctggaggagtatgaaagagactggtacatcggcctggtgtctgatgagaagtggaaggaggccatcctgcaggagaagccctacctgttcagcctgggctatgacagcaacatgtacctgtag

SEQ ID NO: 33133 - DNA, 1584 bp, Artificial Sequence
  Description of Artificial Sequence: Synthetic coding sequence
ctctgcatcctgaacatcgtgttcagcccctttgtgctggtgatcatcgtgttcagcaccctgctgagcagccccctgctgcccctcttcaccctgcctgtgttcctggtgggcttcccccggcccatccagagctggccaggagctgctggcaccacagcctgtgtgtgtgccgacacagtgtactactaccagatggtgccccggctgacagctgtgctgcagacagccatggccgccggcagcctgggcctgctgctgcccggcagccactacctgggccgcttccaggaccggctgatgtggatcatgatcctggagtgtggctacacctactgcagcatcaacatcaagggcctggagctgcaggagaccagctgccacacagctgaggccaggagagtggatgaggtgtttgaagatgcctttgagcaggagtacaccagggtgtgcagcctgaatgagcactttggaaatgtgctgaccccctgcaccgtgctgcctgtgaagctgtacagtgatgccagaaatgtgctgagcggcatcatcgacagccatgagaacctgaaggagttcaagggggacctgatcaaggtgctggtgtggatcctggtgcagtactgcagcaagaggcctggcatgaaggaaaatgtgcacaacacagagaacaagggcaaggcccccctgatgctgcctgccctgaacaccctgcccccacccaagagccctgaggacatcgacagcctgaacagcgagaccttcaatgactggagcgatgacaacatctttgatgatgagcccaccatcaagaaggtgattgaggagaagcaccagctgaaggacctgcccggcaccaacctcttcatccctggctctgtggagagccagagggtgggggaccacagcactggaacagtgcctgaaaatgacctgtacaaggctgtgctgctgggctacccagctgtggacaagggcaagcaggaggacatgccctacatccccctgatggagttcagctgcagccacagccacctggtgtgcctgcctgctgagtggaggaccagctgcatgcccagcagcaagatgaaggagatgagcagcctcttccctgaggactggtaccagtttgtgctgcggcagctggagtgctaccacagcgaggagaaggccagcaatgtgctggaggagatcgccaaggacaaggtgctgaaggacttctacgtgcacacagtgatgacctgctacttcagcctgtttggaattgacaacatggcccccagccctggccacatcctgcgggtgtatggaggagtgctgccctggagcgtggccctggactggctgacagagaagccagagctgttccagctggccctgaaggccttccgctacaccctgaagctgatgattgacaaggccagcctgggccccatcgaggacttccgggagctgatcaagtacctggaggagtatgagcgggactggtacatcggcctggtgtctgatgagaagtggaaggaggccatcctgcaggagaagccctacctgttcagcctgggctatgacagcaacatgtacctgtag

SEQ ID NO: 33134 - DNA, 1866 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagaccaccgtgccctgtgtgacccatgctggcttctgctgccccctggtggtgaccatgaggcccatccccaaggacaagctggagggcctggtgcgggcctgctgcagcctgggcggggagcagggccagcctgtgcacatgggagaccctgagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggaattgatcctggcaacagaggcatcggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagacccccaggtttgaccacctggtggccatcgagcgggccggccgggcagcagatggcaactactacaatgccaggaagatgaacatcaagcacctggtggaccccattgatgacctcttcctggccgccaagaagatccctggcatcagcagcactggagtgggagatggcggcaatgagctgggcatgggcaaggtgaaggaggccgtgcggcggcacatcagacatggagatgtgattgcctgtgatgtggaggccgactttgctgtgattgctggggtgagcaactggggcggctacgccctggcctgtgccctgtacatcctgtacagctgtgctgtgcacagccagtacctgaggaaggctgtgggccccagccgggcccctggggaccaggcctggacccaggccctgcccagcgtcatcaaggaggagaagatgctgggcatcctggtgcagcacaaggtgcgctctggagtgtctggcatcgtgggcatggaggtggatggcctgcccttccacaacacccatgctgagatgatccagaagctggtggatgtgaccacagcccaggtgtag

SEQ ID NO: 33135 - DNA, 480 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccagcctgcgggacctgcacagcgcctggcacaggaccagcctgatgacagtggcccaggagagagctgccctgcccaccgtgctgacccccagccccatcacctggaggctgtcctggctgcggagcctgcgctcctggaggaagagcagccctggagagatccccctggccctgcccagcgtgcacagcatcgcccaggccagaaatcctcctgtgcaggactag

SEQ ID NO: 33136 - DNA, 1866 bp, Artificial Sequence; identical to SEQ ID NO: 33134
  Description of Artificial Sequence: Synthetic coding sequence

SEQ ID NO: 33137 - DNA, 1851 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccagaccaccgtgccctgtgtgacccacgccggcttctgctgccccctggtggtgaccatgaggcccatccccaaggacaagctggagggcctggtgcgggcctgctgcagcctgggcggggagcagggccagcctgtgcacatgggagaccctgagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggcatcgaccccggcaacagaggaattggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagacccccaggtttgaccacctggtggccatcgagagagctggccgggctgctgatggcaactactacaatgccaggaagatgaacatcaagcacctggtggaccccattgatgacctcttcctggccgccaagaagatccctggcatcagcagcactggagtgggagatggcggcaatgagctgggcatgggcaaggtgaaggaggccgtgagaagacacatcagacatggagatgtgattgcctgtgatgtggaggccgactttgctgtgattgctggggtgagcaactggggcggctacgccctggcctgtgccctgtacatcctgtacagctgtgctgtgcacagccagtacctgaggaaggctgtgggccccagccgggcccctggggaccaggcctggacccaggccctgcccagcgtcatcaaggaggagaagatgctgggcatcctggtgcagcacaaggtgcgcagcggcgtgtctggaattgtgggcatggaggtggatggcctgcccttccacaacacccacgccgagatgatccagaagctggtggatgtgaccacagcccaggtgtag

SEQ ID NO: 33138 - DNA, 198 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgtag

SEQ ID NO: 33139 - DNA, 1296 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagaccaccgtgccctgtgtgacccatgctggcttctgctgccccctggtggtgaccatgaggcccatccccaaggacaagctggagggcctggtgcgggcctgctgcagcctgggcggggagcagggccagcctgtgcacatgggagaccctgagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggaattgatcctggcaacagaggcatcggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagaccccctag

SEQ ID NO: 33140 - DNA, 480 bp, Artificial Sequence; identical to SEQ ID NO: 33135
  Description of Artificial Sequence: Synthetic coding sequence

SEQ ID NO: 33141 - DNA, 1866 bp, Artificial Sequence; identical to SEQ ID NO: 33134
  Description of Artificial Sequence: Synthetic coding sequence

SEQ ID NO: 33142 - DNA, 330 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtag

SEQ ID NO: 33143 - DNA, 606 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagaccaccgtgccctgtgtgacccatgctggcttctgctgccccctggtggtgaccatgaggcccatccccaaggacaagctggagggcctggtgcgggcctgctgcagcctgggcggggagcagggccagcctgtgcacatgggagactag

SEQ ID NO: 33144 - DNA, 1695 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccagaccaccgtgccctgtgtgacccacgccggcttctgctgccccctggtggtgaccatgaggcccatccccaaggacaagctggagggcctggtgcgggcctgctgcagcctgggggagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggcatcgaccccggcaacagaggaattggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagacccccaggtttgaccacctggtggccatcgagagagctggccgggctgctgatggcaactactacaatgccaggaagatgaacatcaagcacctggtggaccccattgatgacctcttcctggccgccaagaagatccctggcatcagcagcactggagtgagcaactggggcggctacgccctggcctgtgccctgtacatcctgtacagctgtgctgtgcacagccagtacctgaggaaggctgtgggccccagccgggcccctggggaccaggcctggacccaggccctgcccagcgtcatcaaggaggagaagatgctgggcatcctggtgcagcacaaggtgcgcagcggcgtgtctggaattgtgggcatggaggtggatggcctgcccttccacaacacccacgccgagatgatccagaagctggtggatgtgaccacagcccaggtgtag

SEQ ID NO: 33145 - DNA, 378 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagctag

SEQ ID NO: 33146 - DNA, 1746 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagaccaccgtgccctgtgtgacccatgctggcttctgctgccccctggtggtgaccatgaggcccatccccaaggacaagctggagggcctggtgcgggcctgctgcagcctgggcggggagcagggccagcctgtgcacatgggagaccctgagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggaattgatcctggcaacagaggcatcggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagacccccaggtttgaccacctggtggccatcgagcgggccggccgggcagcagatggcaactactacaatgccaggaagatgaacatcaagcacctggtggaccccattgatgacctcttcctggccgccaagaagatccctggcatcagcagcactggagtgagcaactggggcggctacgccctggcctgtgccctgtacatcctgtacagctgtgctgtgcacagccagtacctgaggaaggctgtgggccccagccgggcccctggggaccaggcctggacccaggccctgcccagcgtcatcaaggaggagaagatgctgggcatcctggtgcagcacaaggtgcgctctggagtgtctggcatcgtgggcatggaggtggatggcctgcccttccacaacacccatgctgagatgatccagaagctggtggatgtgaccacagcccaggtgtag

SEQ ID NO: 33147 - DNA, 78 bp, Artificial Sequence
  Description of Artificial Sequence: Synthetic coding sequence
atgcccttcaccctgcacctgcggagccggctgcccagcgccatccgcagcctcatcctgcagaagaagcccaactag

SEQ ID NO: 33148 - DNA, 459 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagtag

SEQ ID NO: 33149 - DNA, 609 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagaccaggatgggccacccccagttctggaagtatgaatttggagcctgcaccggcagcctggccagcctggagcagtacagcgagcagctgaaggacatggtggccttcttcctgggctgcagcttcagcctggaggaggccctggagaaggccggcctgccccggcgggaccctgctggccacagccaggccggggcctacaagaccaccgtgccctgtgtgacccatgctggcttctgctgccccctggtggtgaccatgaggcccatccccaaggacaagctggagggcctggtgcgggcctgctgcagcctgggcggggagcagggccagcctgtgcacatgggagacccctag

SEQ ID NO: 33150 - DNA, 1851 bp, Artificial Sequence; identical to SEQ ID NO: 33137
  Description of Artificial Sequence: Synthetic coding sequence

SEQ ID NO: 33151 - DNA, 258 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatcagcgagacctag

SEQ ID NO: 33152 - DNA, 1851 bp, Artificial Sequence; identical to SEQ ID NO: 33137
  Description of Artificial Sequence: Synthetic coding sequence

SEQ ID NO: 33153 - DNA, 1851 bp, Artificial Sequence; identical to SEQ ID NO: 33137
  Description of Artificial Sequence: Synthetic coding sequence

SEQ ID NO: 33154 - DNA, 252 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagcctttgagcgcttctgccaggtgaacacaggccccctgcccctgctgggccagagcgagcctgagaagtggatgctgcccccccagggcgccatctcctag

SEQ ID NO: 33155 - DNA, 459 bp, Artificial Sequence; identical to SEQ ID NO: 33148
  Description of Artificial Sequence: Synthetic coding sequence

SEQ ID NO: 33156 - DNA, 159 bp, Artificial Sequence
  Description of Artificial Sequence: Synthetic coding sequence
atgcccttcaccctgcacctgcggagccggctgcccagcgccatccgcagcctcatcctgcagaagaagcccaacatccggaacaccagctccatggccggggagctgcggcctgccagcctggtggtgctgcccaggagcctggccccagccttctag

SEQ ID NO: 33157 - DNA, 1479 bp, Artificial Sequence
  Description of Artificial Sequence: Synthetic coding sequence
atggtggccttcttcctgggctgcagcttcagcctggaggaggccctggagaaggccggggcctacaagaccaccgtgccctgtgtgacccacgccggcttctgctgccccctggtggtgaccatgaggcccatccccaaggacaagctggagggcctggtgcgggcctgctgcagcctgggcggggagcagggccagcctgtgcacatgggagaccctgagctgctgggcatcaaggagctgagcaagccagcctatggagatgccatggtgtgccccccaggagaggtgcctgtgttctggcccagccccctgaccagcctgggcgctgtgagcagctgtgagacccccctggcctttgccagcatccctggctgcaccgtgatgacagacctgaaggatgccaaggcccctcctggctgcctgaccccagagcgcatccctgaggtgcaccacatcagccaggaccccctgcactacagcatcgcctctgtgtctgccagccagaagatccgggagctggagagcatgattggcatcgaccccggcaacagaggaattggccacctgctgtgcaaggatgagctgctgaaggccagcctgagcctgagccacgcccggtctgtgctgatcaccaccggcttccccacccacttcaaccacgagcccccagaggagacagatggccccccaggagctgtggccctggtggccttcctgcaggccctggagaaggaggtggccatcatcgtggaccagagggcctggaacctgcaccagaagatcgtggaggatgctgtggagcagggcgtgctgaagacccagatccccatcctgacctaccagggcggctctgtggaggccgcccaggccttcctgtgcaagaatggagacccccagacccccaggtttgaccacctggtggccatcgagagagctggccgggctgctgatggcaactactacaatgccaggaagatgaacatcaagcacctggtggaccccattgatgacctcttcctggccgccaagaagatccctggcatcagcagcactggagtgggagatggcggcaatgagctgggcatgggcaaggtgaaggaggccgtgagaagacacatcagacatggagatgtgattgcctgtgatgtggaggccgactttgctgtgattgctggggtgagcaactggggcggctacgccctggcctgtgccctgtacatcctgtacagctgtgctgtgcacagccagtacctgaggaaggctgtgggccccagccgggcccctggggaccaggcctggacccaggccctgcccagcgtcatcaaggaggagaagatgctgggcatcctggtgcagcacaaggtgcgcagcggcgtgtctggaattgtgggcatggaggtggatggcctgcccttccacaacacccacgccgagatgatccagaagctggtggatgtgaccacagcccaggtgtag

SEQ ID NO: 33158 - DNA, 483 bp, Artificial Sequence
  Description of Artificial Sequence: Synthetic coding sequence
atgaggacagctgctggagctgtgtccccagacagcaggcctgagacccggcggcagaccaggaagaatgaggaggccgcctggggcccccgggtgtgcagagctgagcgggaggacaacaggaagtgcccccccagcatcctgaagaggagcaggcctgagcaccacaggcctgaggccaagccccagaggaccagcagaagagtgtggttccgggagcccccagctgtgacagtgcactacatcgctgacaagaatgccacagccaccgtgcgggtgcccggccggccccggccccacggcggcagcctgctgctgcagctgtgtgtgtgtgtgctgctggtgctggccctgggcctgtactgcggccgggccaagcctgtggccacagccctggaggacctgcgggcccggctgctgggcctggtgctgcacctgcggcacgtggccctgacctgctggaggggcctgctgcggctgtag

SEQ ID NO: 33159 - DNA, 483 bp, Artificial Sequence; identical to SEQ ID NO: 33158
  Description of Artificial Sequence: Synthetic coding sequence

SEQ ID NO: 33160 - DNA, 2325 bp, Artificial Sequence
  Description of Artificial Sequence: Synthetic coding sequence
atgaggggccccatcgtgctgcacatctgcctggccttctgcagcctgctgctcttctctgtggccacccagtgcctggccttccccaagattgaaagaagaagagaaattgcccacgtgcacgccgagaagggccagagcgacaagatgaacacagatgacctggagaacagctctgtgaccagcaagcagaccccccagctggtggtgtctgaggaccccatgatgatgtctgctgtgcccagcgccaccagcctgaacaaggccttcagcatcaacaaggagacccagcccggccaggccggcctgatgcagacagagaggcctggggtgtccacccccacagaaagtggagtgcccagcgctgaggaggtgtttggcagcagccagcctgagcgcatcagccctgagagcggcctggccaaggccatgctgaccatcgccatcacagccacccccagcctgactgtggatgagaaggaggagctgctgaccagcaccaacttccagcccatcgtggaggagatcacagagaccaccaagggcttcctgaagtacatggacaaccagagctttgccacagagagccaggagggcgtgggcctgggccacagccccagcagctatgtgaacaccaaggagatgctgaccaccaaccccaagacagagaagtttgaagctgacacagaccacaggaccaccagcttccctggagctgagagcacagctggcagcgagcccggcagcctgaccccagacaaggagaagcccagccagatgacagctgacaacacccaggccgccgccaccaagcagcccctggagaccagcgagtacaccctgtctgtggagcctgagacagacagcctgctgggcgcccctgaggtgacagtgtctgtgtccacagctgtgcctgctgccagcgccctgagtgatgagtgggatgacaccaagctggagagcgtgagccgcatccgcacccccaagctgggggacaatgaggagacccaggtgaggacagagatgagccagacagcccaggtgtcccatgagggcatggagggcggccagccctggacagaggccgcccaggtggccctgggcctgcctgagggggagacccacactggaacagccctgctgattgcccacggcaatgaaagaagccctgccttcacagaccagagcagcttcacccccaccagcctgatggaggacatgaaggtgtccatcgtgaacctgctgcagagcactggagacttcacagagagcaccaaggaaaatgatgccctcttcttcctggagaccaccgtgtctgtgtctgtgtatgaaagtgaagctgaccagctgctgggcaacaccatgaaggacatcatcacccaggagatgaccacagctgtgcaggagccagatgccaccctgtccatggtgacccaggagcaggtggccaccctggagctgatccgggacagcggcaagacagaggaggagaaggaggaccccagccctgtgtctgatgtgcctggggtgacccagctgagccgccgctgggagcccctggccaccaccatcagcaccaccgtggtgcccctgagctttgaggtgacccccaccgtggaggagcagatggacacagtgacaggccccaatgaggagttcacccctgtgctgggcagccctgtgaccccacctggcatcatggtgggggagcccagcatcagccctgccctgcctgccctggaggccagcagcgagaggagaacagtggtgcccagcatcaccagggtgaacacagctgccagctatggcctggaccagctggagagcgaggagggccaggaggatgaagatgaagaagatgaggaggatgaagatgaggaggaggaggatgaggaggaggatgaggaggacaaggatgctgacagcctggatgagggcctggatggagacacagagctgcccggcttcaccctgcccggcatcaccagccaggagcccggcctggaggagggcaacatggacctgctggagggcgccacctaccaggtgcctgatgccctggagtgggagcagcagaaccagggcctggtgcgctcctggatggagaagctgaaggacaaggccggctacatgagcggcatgctggtgcctgtgggcgtgggcattgctggggccctcttcatcctgggcgccctgtacagcatcaaggtgatgaacagaagaagaagaaatggcttcaagaggcacaagaggaagcagcgggagttcaacagcatgcaggacagagtgatgctgctggccgacagcagtgaagatgagttctag

SEQ ID NO: 33161 - DNA, 729 bp, Artificial Sequence
  Description of Artificial Sequence: Synthetic coding sequence
atggctgctgccctgtggggcttcttccctgtgctgctgctgctgctgctgtctggagatgtgcagagcagcgaggtgcctggagctgctgctgagggcagcggcggcagcggcgtgggcattggagaccgcttcaagattgagggccgggctgtggtgcctggggtgaagccccaggactggatctctgctgcccgggtgctggtggatggagaggagcacgtgggcttcctgaagacagatggcagctttgtggtgcatgacatccccagcggcagctatgtggtggaggtggtgtccccagcctacagatttgatcctgtgcgggtggacatcaccagcaagggcaagatgagggcccgctacgtgaactacatcaagaccagcgaggtggtgcggctgccctaccccctgcagatgaagagcagcggccccccatcctacttcatcaagcgggagagctggggctggacagacttcctgatgaaccccatggtgatgatgatggtgctgcccctgctgatctttgtgctgctgcccaaggtggtgaacaccagtgaccctgacatgagaagagagatggagcagagcatgaacatgctgaacagcaaccacgagctgcctgatgtgtctgagttcatgaccaggctcttcagcagcaagagcagcggcaagagcagcagcggcagcagcaagacaggcaagagcggggccggcaagagaagatag

SEQ ID NO: 33162 - DNA, 1596 bp, Artificial Sequence
  Description of Artificial Sequence: Synthetic coding sequence
atggctgtggcccccagcttcaacatgaccaacccccagcctgccatcgagggcggcatcagcgaggtggagatcatcagccagcaggtggatgaggagaccaagagcatcgcccctgtgcagctggtgaactttgcctacagagacctgcccctggccgctgtggacctgagcacagctggcagccagctgctgagcaacctggatgaggactaccagcgggagggcagcaactggctgaagccctgctgcggcaagagagctgctgtgtggcaggtgttcctgctgagcgccagcctgaacagcttcctggtggcctgtgtgatcctggtggtgatcctgctgaccctggagctgctgattgacatcaagctgctgcagttcagcagcgccttccagtttgctggggtcatccactggatcagcctggtgatcctgtctgtgttcttcagcgagaccgtgctgagaattgtggtgctgggcatctgggactacatcgagaacaagattgaggtgtttgatggagctgtgatcatcctgagcctggcccccatggtggccagcacagtggccaacggccccaggagcccctgggatgccatcagcctcatcatcatgctgcgcatctggagggtgaagagggtgattgatgcctacgtgctgcctgtgaagctggagatggagatggtgatccagcagtatgagaaggccaaggtgatccaggatgagcagctggagcggctgacccagatctgccaggagcagggctttgagatccggcagctgcgggcccacctggcccagcaggacctggacctggccgctgagcgggaggccgccctgcaggcccctcatgtgctgagccagcccaggagccgcttcaaggtgctggaggccggcacctgggatgaggagacagctgctgagagcgtggtggaggagctgcagcccagccaggaggccaccatgaaggatgacatgaacagctacatcagccagtactacaacggccccagcagtgacagcggcgtgcctgagcctgctgtgtgcatggtgaccacagctgccatcgacatccaccagcccaacatcagcagtgacctcttcagcctggacatgcccctgaagctgggcggcaatggcaccagcgccaccagcgagagcgccagccgcagctctgtgacccgggcccagagcgacagcagccagaccctgggcagctccatggactgcagcacagcccgggaggagcccagcagcgagcccggccccagccccccacccctgcccagccagcagcaggtggaggaggccaccgtgcaggacctgctgagcagcctgtctgaggacccctgccccagccagaaggccctggaccctgcccccctggcccggcccagccctgctggcagcgcccagaccagccctgagctggagcaccgggtgtccctcttcaaccagaagaaccaggagggcttcaccgtcttccagatccggcctgtgatccacttccagcccaccgtgcccatgctggaggacaagttccgcagcctggagagcaaggagcagaagctgcaccgggtgcctgaggcctag

SEQ ID NO: 33163 - DNA, 252 bp, Artificial Sequence
  Description of Artificial Sequence: Synthetic coding sequence
atgtccttcttccagctgctgatgaagaggaaggagctgatccccctggtggtgttcatgacagtggccgccggcggggccagcagctttgctgtgtacagcctgtggaagacagatgtgatcctggacaggaagaagaaccctgagccctgggagaccgtggaccccaccgtgccccagaagctgatcaccatcaaccagcagtggaagcccatcgaggagctgcagaatgtgcagagggtgaccaagtag

SEQ ID NO: 33164 - DNA, 252 bp, Artificial Sequence; identical to SEQ ID NO: 33163
  Description of Artificial Sequence: Synthetic coding sequence

SEQ ID NO: 33165 - DNA, 528 bp, Artificial Sequence
  Description of Artificial Sequence: Synthetic coding sequence
atggagacctggaggaagggcagcttcagaaatgccagcttcttcaagcagctgagcctgggccggccccggcggctgcggcggcagagctctgtgctgagccaggccagcacagctggaggagaccacgaggagtacagcaaccgggaggtgatccgggagctgcagggccgcccagatggccggcggctgcccctgtggggagatgagcagccccgggccaccctgctggccccacccaagccaccccggctgtaccgggagagcagcagctgccccaacatcctggagcccccaccagcctacacagctgcctacagcgccaccctgcccagcgccctgagcctgagcagcgccctgcaccagcacagcgagaagggcctggtggacaccccctgcttccagaggacccccaccccagacctgagtgaccccttcctgtccttcaaggtggacctgggcatcagcctgctggaggaggtgctgcagatgctgcgggagcagttccccagcgagcccagcttctag

SEQ ID NO: 33166 - DNA, 528 bp, Artificial Sequence; identical to SEQ ID NO: 33165
  Description of Artificial Sequence: Synthetic coding sequence

SEQ ID NO: 33167 - DNA, 675 bp, Artificial Sequence
  Description of Artificial Sequence: Synthetic coding sequence
atgcccctgaccccagagcccccatctggccgggtggagggccccccagcctgggaggccgccccctggcccagcctgccctgtggcccctgcatccccatcatgctggtgctggccaccctggccgccctcttcatcctgaccacagctgtgctggccgagcggctcttccggcgggccctgcggccagaccccagccaccgggcccccaccctggtgtggaggcctggaggagagctgtggattgagcccatgggcacagcccgggagaggtctgaggactggtacggcagcgctgtgcccctgctgacagaccgggcccctgagccccccacccaggtgggcaccctggaggcccgggccacagcccccccagcccccagcgcccccaacagcgcccccagcaacctgggcccccagacagtgctggaggtgcctgcccggagcaccttctggggcccccagccctgggagggccggcccccagccaccggcctggtgtcctgggccgagcctgagcagaggcctgaggcctctgtgcagtttggcagcccccaggcccggcggcagaggcctggcagcccagaccctgagtggggcctgcagccccgggtgaccctggagcagatcagcgccttctggaagcgggagggccgcacctctgtgggcttctag

SEQ ID NO: 33168 - DNA, 1407 bp, Artificial Sequence
  Description of Artificial Sequence: Synthetic coding sequence
atggctgatgatgctggcctggagacccccctgtgcagcgagcagtttggcagcggggaggcccggggctgcagagctgctgctgatggcagcctgcagtgggaggtgggcggctggcgctggtggggcctgagccgggccttcaccgtgaagccagagggcagagatgctggggaggtgggcgccagcggggcccccagcccccccctgagcggcctgcaggccgtgttcctgccccagggcttcccagattctgtgtccccagactacctgccctaccagctgtgggacagcgtgcaggcctttgccagcagcctgagcggcagcctggccacccaggccgtgctgctgggcattggagtgggcaatgccaaggccaccgtgtctgctgccacagccacctggctggtgaaggacagcacaggcatgctgggcagaattgtgtttgcctggtggaagggcagcaagctggactgcaatgccaagcagtggaggctgtttgctgacatcctgaatgatgtggccatgttcctggagatcatggcccctgtgtaccccatctgcttcaccatgacagtgtccaccagcaacctggccaagtgcatcgtgtctgtggccggcggggccacccgggccgccctgactgtgcaccaggcccggaggaacaacatggctgatgtgtctgccaaggacagcagccaggagaccctggtgaacctggccggcctgctggtgtccctgctgatgctgcccctggtgtctggctgccccggcttcagcctgggctgcttcttcttcctgacagccctgcacatctatgccaactacagagctgtgcgggccctggtgatggagaccctgaatgaaggccgcctgcggctggtgctgaagcactacctgcagagaggagaggtgctggaccccacagctgccaacaggatggagcccctgtggacaggcttctggccagcccccagcctgagcctgggcgtgcccctgcaccggctggtgtcctctgtgtttgagctgcagcagctggtggagggccaccaggagagctacctgctgtgctgggaccagagccagaaccaggtgcaggtggtgctgaaccagaaggccggccccaagaccatcctgcgggccgccacccacggcctgatgctgggcgccctgcagggagatggccccctgcctgctgagctggaggagctgaggaacagagtgcgggccggccccaagaaggagagctgggtggtggtgaaggagacccatgaggtgctggacatgctgttccccaagttcctgaagggcctgcaggatgctggctggaagacagagaagcaccagctggaggtggatgagtggagggccacctggctgctgagccctgagaagaaggtgctgtag

SEQ ID NO: 33169 - DNA, 585 bp, Artificial Sequence
  Description of Artificial Sequence: Synthetic coding sequence
atgctgggcagaattgtgtttgcctggtggaagggcagcaagctggactgcaatgccaagcagtggaggctgtttgctgacatcctgaatgatgtggccatgttcctggagatcatggcccctgtgtaccccatctgcttcaccatgacagtgtccaccagcaacctggccaagtgcatcgtgtctgtggccggcggggccacccgggccgccctgactgtgcaccaggcccggaggaacaacatggctgatgtgtctgccaaggacagcagccaggagaccctggtgaacctggccggcctgctggtgtccctgctgatgctgcccctggtgtctggctgccccggcttcagcctgggctgcttcttcttcctgacagccctgcacatctatgccaactacagagctgtgcgggccctggtgatggagaccctgaatgaaggccgcctgcggctggtgctgaagcactacctgcagagaggagaggtgctggaccccacagctgccaacaggatggagcccctgtggacaggagaccctgcccctggcctgggcagctgtgtgtccaccagccccacagcctag

SEQ ID NO: 33170 - DNA, 1269 bp, Artificial Sequence
  Description of Artificial Sequence: Synthetic coding sequence
atggctgatgatgctggcctggagacccccctgtgcagcgagcagtttggcagcggggaggcccggggctgcagagctgctgctgatggcagcctgccccagggcttcccagattctgtgtccccagactacctgccctaccagctgtgggacagcgtgcaggcctttgccagcagcctgagcggcagcctggccacccaggccgtgctgctgggcattggagtgggcaatgccaaggccaccgtgtctgctgccacagccacctggctggtgaaggacagcacaggcatgctgggcagaattgtgtttgcctggtggaagggcagcaagctggactgcaatgccaagcagtggaggctgtttgctgacatcctgaatgatgtggccatgttcctggagatcatggcccctgtgtaccccatctgcttcaccatgacagtgtccaccagcaacctggccaagtgcatcgtgtctgtggccggcggggccacccgggccgccctgactgtgcaccaggcccggaggaacaacatggctgatgtgtctgccaaggacagcagccaggagaccctggtgaacctggccggcctgctggtgtccctgctgatgctgcccctggtgtctggctgccccggcttcagcctgggctgcttcttcttcctgacagccctgcacatctatgccaactacagagctgtgcgggccctggtgatggagaccctgaatgaaggccgcctgcggctggtgctgaagcactacctgcagagaggagaggtgctggaccccacagctgccaacaggatggagcccctgtggacaggcttctggccagcccccagcctgagcctgggcgtgcccctgcaccggctggtgtcctctgtgtttgagctgcagcagctggtggagggccaccaggagagctacctgctgtgctgggaccagagccagaaccaggtgcaggtggtgctgaaccagaaggccggccccaagaccatcctgcgggccgccacccacggcctgatgctgggcgccctgcagggagatggccccctgcctgctgagctggaggagctgaggaacagagtgcgggccggccccaagaaggagagctgggtggtggtgaaggagacccatgaggtgctggacatgctgttccccaagttcctgaagggcctgcaggatgctggctggaagacagagaagcaccagctggaggtggatgagtggagggccacctggctgctgagccctgagaagaaggtgctgtag

SEQ ID NO: 33171 - DNA, 471 bp, Artificial Sequence
  Description of Artificial Sequence: Synthetic coding sequence
atggctgatgatgctggcctggagacccccctgtgcagcgagcagtttggcagcggggaggcccggggctgcagagctgctgctgatggcagcctgcagtgggaggtgggcggctggcgctggtggggcctgagccgggccttcaccgtgaagccagagggcagagatgctggggaggtgggcgccagcggggcccccagcccccccctgagcggcctgcaggccgtgttcctgccccagggcttcccagattctgtgtccccagactacctgccctaccagctgtgggacagcgtgcaggcctttgccagcagcctgagcggcagcctggccacccaggccgtgctgctgggcattggagtgggcaatgccaaggccaccgtgtctgctgccacagccacctggctggtgaaggacagcacaggcatgctgggcagaattgtgtttgcctggtggaagggggccagctag

SEQ ID NO: 33172 - DNA, 2892 bp, Artificial Sequence
  Description of Artificial Sequence: Synthetic coding sequence
atggctgtgttcccctggcacagcaggaacagaaactacaaggccgagtttgccagctgccgcctggaggccgtgcccctggagtttggagactaccaccccctgaagcccatcaccgtgacagagagcaagaccaagaaggtgaacaggaagggcagcaccagcagcaccagcagcagcagcagcagctctgtggtggaccccctgagctctgtgctggatggaacagaccccctgtccatgtttgctgccacagctgaccctgctgccctggccgccgccatggacagcagcaggaggaagagggacagagatgacaacagcgtggtgggcagtgactttgagccctggaccaacaagagaggagagatcctggcccgctacaccaccacagagaagctgagcatcaacctcttcatgggcagcgagaagggcaaggccggcacagccaccctggccatgtctgagaaggtgaggacccggctggaggagctggatgactttgaggagggcagccagaaggagctgctgaacctgacccagcaggactatgtgaaccgcatcgaggagctgaaccagagcctgaaggatgcctgggccagtgaccagaaggtgaaggccctgaagatcgtcatccagtgcagcaagctgctgagtgacaccagcgtcatccagttctaccccagcaagtttgtgctgatcacagacatcctggacaccttcggcaagctggtgtatgaaagaatcttctccatgtgtgtggacagccgctctgtgctgcctgaccacttctccccagaaaatgccaatgacacagccaaggagacctgcctgaactggttcttcaagatcgccagcatccgggagctgatcccccgcttctacgtggaggccagcatcctgaagtgcaacaagttcctgagcaagacaggcatcagcgagtgcctgccccggctgacctgcatgatccggggcatcggggaccccctggtgtctgtgtatgcccgggcctacctgtgccgggtgggcatggaggtggccccccacctgaaggagaccctgaacaagaacttctttgacttcctgctgaccttcaagcagatccatggagacacagtgcagaaccagctggtggtgcagggcgtggagctgcccagctacctgcccctgtaccccccagccatggactggatcttccagtgcatctcctaccacgcccctgaggccctgctgacagagatgatggagcgctgcaagaagctgggcaacaatgccctgctgctgaacagcgtgatgtctgccttccgggcagagttcatcgccaccaggtccatggacttcatcggcatgatcaaggaatgtgatgaaagtggcttccccaagcacctgctcttccgcagcctgggcctgaacctggccctggccgaccccccagagagtgaccggctgcagatcctgaatgaggcctggaaggtgatcaccaagctgaagaacccccaggactacatcaactgtgccgaggtgtgggtggagtacacctgcaagcacttcaccaagcgggaggtgaacacagtgctggctgatgtgatcaagcacatgaccccagaccgggcctttgaggacagctacccccagctgcagctgatcatcaagaaggtgattgcccacttccatgacttctctgtgctcttctctgtggagaagttcctgcccttcctggacatgttccagaaggagagcgtgcgggtggaggtgtgcaagtgcatcatggatgccttcatcaagcaccagcaggagcccaccaaggaccccgtcatcctgaatgccctgctgcacgtgtgcaagaccatgcatgacagcgtgaatgccctgaccctggaggatgagaagaggatgctgagctacctgatcaatggcttcatcaagatggtgtcctttggccgggactttgagcagcagctgtccttctacgtggagagccgctccatgttctgcaacctggagcctgtgctggtgcagctgatccacagcgtgaaccggctggccatggagaccaggaaggtgatgaagggcaaccacagcaggaagacagctgcctttgtgcgggcctgtgtggcctactgcttcatcaccatccccagcctggccggcatcttcacccggctgaacctgtacctgcacagcggccaggtggccctggccaaccagtgcctgagccaggctgatgccttcttcaaggccgccatcagcctggtgcctgaggtgcccaagatgatcaacattgatggcaagatgaggcccagcgagagcttcctgctggagttcctgtgcaacttcttcagcaccctgctgattgtgcctgaccaccctgagcacggcgtgctcttcctggtgcgggagctgctgaatgtcatccaggactacacctgggaggacaacagtgatgagaagatccgcatctacacctgtgtgctgcacctgctgagcgccatgagccaggagacctacctgtaccacatcgacaaggtggacagcaatgacagcctgtatggaggagacagcaagttcctggccgagaacaacaagctgtgtgagaccgtgatggcccagatcctggagcacctgaagaccctggccaaggatgaggccctgaagaggcagagcagcctgggcctgtccttcttcaacagcatcctggcccatggagacctgaggaacaacaagctgaaccagctgtctgtgaacctgtggcacctggcccagagacatggctgtgccgacaccaggaccatggtgaagaccctggagtacatcaagaagcagagcaagcagcctgacatgacccacctgacagagctggccctgcggctgcccctgcagaccaggacatag

SEQ ID NO: 33173 - DNA, 2613 bp, Artificial Sequence
  Description of Artificial Sequence: Synthetic coding sequence
atggctgtgttcccctggcacagcaggaacagaaactacaaggccgagtttgccagctgccgcctggaggccgtgcccctggagtttggagactaccaccccctgaagcccatcaccgtgacagagagcaagaccaagaaggtgaacaggaagggcagcaccagcagcaccagcagcagcagcagcagctctgtggtggaccccctgagctctgtgctggatggaacagaccccctgtccatgtttgctgccacagctgaccctgctgccctggccgccgccatggacagcagcaggaggaagagggacagagatgacaacagcgtggtgggcagtgactttgagccctggaccaacaagagaggagagatcctggcccgctacaccaccacagagaagctgagcatcaacctcttcatgggcagcgagaagggcaaggccggcacagccaccctggccatgtctgagaaggtgaggacccggctggaggagctggatgactttgaggagggcagccagaaggagctgctgaacctgacccagcaggactatgtgaaccgcatcgaggagctgaaccagagcctgaaggatgcctgggccagtgaccagaaggtgaaggccctgaagatcgtcatccagtgcagcaagctgctgagtgacaccagcgtcatccagttctaccccagcaagtttgtgctgatcacagacatcctggacaccttcggcaagctggtgtatgaaagaatcttctccatgtgtgtggacagccgctctgtgctgcctgaccacttctccccagaaaatgccaatgacacagccaaggagacctgcctgaactggttcttcaagatcgccagcatccgggagctgatcccccgcttctacgtggaggccagcatcctgaagtgcaacaagttcctgagcaagacaggcatcagcgagtgcctgccccggctgacctgcatgatccggggcatcggggaccccctggtgtctgtgtatgcccgggcctacctgtgccgggccctgctgacagagatgatggagcgctgcaagaagctgggcaacaatgccctgctgctgaacagcgtgatgtctgccttccgggcagagttcatcgccaccaggtccatggacttcatcggcatgatcaaggaatgtgatgagagcggcttccccaagcacctgctcttccgcagcctgggcctgaacctggccctggccgaccccccagagagtgaccggctgcagatcctgaatgaggcctggaaggtgatcaccaagctgaagaacccccaggactacatcaactgtgccgaggtgtgggtggagtacacctgcaagcacttcaccaagcgggaggtgaacacagtgctggctgatgtgatcaagcacatgaccccagaccgggcctttgaagattcctacccccagctgcagctgatcatcaagaaggtgattgcccacttccatgacttctctgtgctcttctctgtggagaagttcctgcccttcctggacatgttccagaaggagagcgtgcgggtggaggtgtgcaagtgcatcatggatgccttcatcaagcaccagcaggagcccaccaaggaccctgtgatcctgaatgccctgctgcacgtgtgcaagaccatgcatgattctgtgaatgccctgaccctggaggatgagaagaggatgctgagctacctgatcaatggcttcatcaagatggtgtcctttggccgggactttgagcagcagctgtccttctacgtggagagccgctccatgttctgcaacctggagcctgtgctggtgcagctgattcatgcctgtgtggcctactgcttcatcaccatccccagcctggccggcatcttcacccggctgaacctgtacctgcacagcggccaggtggccctggccaaccagtgcctgagccaggctgatgccttcttcaaggccgccatcagcctggtgcctgaggtgcccaagatgatcaacattgatggcaagatgaggccttctgagagcttcctgctggagttcctgtgcaacttcttcagcaccctgctgattgtgcctgaccaccctgagcacggcgtgctcttcctggtgcgggagctgctgaatgtcatccaggactacacctgggaggacaacagtgatgagaagatccgcatctacacctgtgtgctgcacctgctgagcgccatgagccaggagacctacctgtaccacatcgacaaggtggacagcaatgacagcctgtatggaggagacagcaagttcctggccgagaacaacaagctgtgtgaaacagtgatggcccagatcctggagcacctgaagaccctggccaaggatgaggccctgaagaggcagagcagcctgggcctgtccttcttcaacagcatcctggcccacggggacctgaggaacaacaagctgaaccagctgtctgtgaacctgtggcacctggcccagagacatggctgtgccgacaccaggaccatggtgaagaccctggagtacatcaagaagcagagcaagcagcctgacatgacccacctgacagagctggccctgcggctgcccctgcagaccaggacatag

SEQ ID NO: 33174 - DNA, 3159 bp, Artificial Sequence
  Description of Artificial Sequence: Synthetic coding sequence
atggccccagctggggtggtgaccagggctgtgcgctctggagagctgcccctgacctccatggccagcgcagaaaatgaggcctgtgctgtgcgctctgtggcctgccccagccaggcctggaggctgcagaaggtgctgtgtggccgctgtggggccgccagctgccccagccagacctggaggcccaggggggccggcagcggcggcgtgaggatgggcagcagagcagatggccccaggaccagcggccacgtgacaggcaagatggctgtgttcccctggcacagcaggaacagaaactacaaggccgagtttgccagctgccgcctggaggccgtgcccctggagtttggagactaccaccccctgaagcccatcaccgtgacagagagcaagaccaagaaggtgaacaggaagggcagcaccagcagcaccagcagcagcagcagcagctctgtggtggaccccctgagctctgtgctggatggaacagaccccctgtccatgtttgctgccacagctgaccctgctgccctggccgccgccatggacagcagcaggaggaagagggacagagatgacaacagcgtggtgggcagtgactttgagccctggaccaacaagagaggagagatcctggcccgctacaccaccacagagaagctgagcatcaacctcttcatgggcagcgagaagggcaaggccggcacagccaccctggccatgtctgagaaggtgaggacccggctggaggagctggatgactttgaggagggcagccagaaggagctgctgaacctgacccagcaggactatgtgaacagaattgaggagctgaaccagagcctgaaggatgcctgggccagtgaccagaaggtgaaggccctgaagatcgtcatccagtgcagcaagctgctgagtgacaccagcgtcatccagttctaccccagcaagtttgtgctgatcacagacatcctggacaccttcggcaagctggtgtatgagcgcatcttctccatgtgtgtggacagccgctctgtgctgcctgaccacttctccccagaaaatgccaatgacacagccaaggagacctgcctgaactggttcttcaagatcgccagcatccgggagctgatcccccgcttctacgtggaggccagcatcctgaagtgcaacaagttcctgagcaagacaggcatcagtgaatgtctgccccggctgacctgcatgatccggggcattggagaccccctggtgtctgtgtatgcccgggcctacctgtgccgggtgggcatggaggtggccccccacctgaaggagaccctgaacaagaacttctttgacttcctgctgaccttcaagcagatccacggggacacagtgcagaaccagctggtggtgcagggcgtggagctgcccagctacctgcccctgtaccccccagccatggactggatcttccagtgcatctcctaccacgcccctgaggccctgctgacagagatgatggagcgctgcaagaagctgggcaacaatgccctgctgctgaacagcgtgatgtctgccttccgggcagagttcatcgccaccaggtccatggacttcatcggcatgatcaaggaatgtgatgagagcggcttccccaagcacctgctcttccgcagcctgggcctgaacctggccctggccgaccccccagagagtgaccggctgcagatcctgaatgaggcctggaaggtgatcaccaagctgaagaacccccaggactacatcaactgtgccgaggtgtgggtggagtacacctgcaagcacttcaccaagcgggaggtgaacacagtgctggctgatgtgatcaagcacatgaccccagaccgggcctttgaagattcctacccccagctgcagctgatcatcaagaaggtgattgcccacttccatgacttctctgtgctcttctctgtggagaagttcctgcccttcctggacatgttccagaaggagagcgtgcgggtggaggtgtgcaagtgcatcatggatgccttcatcaagcaccagcaggagcccaccaaggaccctgtgatcctgaatgccctgctgcacgtgtgcaagaccatgcatgattctgtgaatgccctgaccctggaggatgagaagaggatgctgagctacctgatcaatggcttcatcaagatggtgtcctttggccgggactttgagcagcagctgtccttctacgtggagagccgctccatgttctgcaacctggagcctgtgctggtgcagctgatccacagcgtgaaccggctggccatggagaccaggaaggtgatgaagggcaaccacagcaggaagacagctgcctttgtgcgggcctgtgtggcctactgcttcatcaccatccccagcctggccggcatcttcacccggctgaacctgtacctgcacagcggccaggtggccctggccaaccagtgcctgagccaggctgatgccttcttcaaggccgccatcagcctggtgcctgaggtgcccaagatgatcaacattgatggcaagatgaggccttctgagagcttcctgctggagttcctgtgcaacttcttcagcaccctgctgattgtgcctgaccaccctgagcacggcgtgctcttcctggtgcgggagctgctgaatgtcatccaggactacacctgggaggacaacagtgatgagaagatccgcatctacacctgtgtgctgcacctgctgagcgccatgagccaggagacctacctgtaccacatcgacaaggtggacagcaatgacagcctgtatggaggagacagcaagttcctggccgagaacaacaagctgtgtgaaacagtgatggcccagatcctggagcacctgaagaccctggccaaggatgaggccctgaagaggcagagcagcctgggcctgtccttcttcaacagcatcctggcccacggggacctgaggaacaacaagctgaaccagctgtctgtgaacctgtggcacctggcccagagacatggctgtgccgacaccaggaccatggtgaagaccctggagtacatcaagaagcagagcaagcagcctgacatgacccacctgacagagctggccctgcggctgcccctgcagaccaggacatag

SEQ ID NO: 33175 - DNA, 2442 bp, Artificial Sequence
  Description of Artificial Sequence: Synthetic coding sequence
atgccacccctgggcgtgctggtgcatgagaagagccacctgtgtgatgtgaacagcttctgcctgggcaaggccggcacagccaccctggccatgtctgagaaggtgaggacccggctggaggagctggatgactttgaggagggcagccagaaggagctgctgaacctgacccagcaggactatgtgaaccgcatcgaggagctgaaccagagcctgaaggatgcctgggccagtgaccagaaggtgaaggccctgaagatcgtcatccaggccgagctggtgtatgaaagaatcttctccatgtgtgtggacagccgctctgtgctgcctgaccacttctccccagaaaatgccaatgacacagccaaggagacctgcctgaactggttcttcaagatcgccagcatccgggagctgatcccccgcttctacgtggaggccagcatcctgaagtgcaacaagttcctgagcaagacaggcatcagcgagtgcctgccccggctgacctgcatgatccggggcatcggggaccccctggtgtctgtgtatgcccgggcctacctgtgccgggtgggcatggaggtggccccccacctgaaggagaccctgaacaagaacttctttgacttcctgctgaccttcaagcagatccatggagacacagtgcagaaccagctggtggtgcagggcgtggagctgcccagctacctgcccctgtaccccccagccatggactggatcttccagtgcatctcctaccacgcccctgaggccctgctgacagagatgatggagcgctgcaagaagctgggcaacaatgccctgctgctgaacagcgtgatgtctgccttccgggcagagttcatcgccaccaggtccatggacttcatcggcatgatcaaggaatgtgatgaaagtggcttccccaagcacctgctcttccgcagcctgggcctgaacctggccctggccgaccccccagagagtgaccggctgcagatcctgaatgaggcctggaaggtgatcaccaagctgaagaacccccaggactacatcaactgtgccgaggtgtgggtggagtacacctgcaagcacttcaccaagcgggaggtgaacacagtgctggctgatgtgatcaagcacatgaccccagaccgggcctttgaggacagctacccccagctgcagctgatcatcaagaaggtgattgcccacttccatgacttctctgtgctcttctctgtggagaagttcctgcccttcctggacatgttccagaaggagagcgtgcgggtggaggtgtgcaagtgcatcatggatgccttcatcaagcaccagcaggagcccaccaaggaccccgtcatcctgaatgccctgctgcacgtgtgcaagaccatgcatgacagcgtgaatgccctgaccctggaggatgagaagaggatgctgagctacctgatcaatggcttcatcaagatggtgtcctttggccgggactttgagcagcagctgtccttctacgtggagagccgctccatgttctgcaacctggagcctgtgctggtgcagctgatccacagcgtgaaccggctggccatggagaccaggaaggtgatgaagggcaaccacagcaggaagacagctgcctttgtgcgggcctgtgtggcctactgcttcatcaccatccccagcctggccggcatcttcacccggctgaacctgtacctgcacagcggccaggtggccctggccaaccagtgcctgagccaggctgatgccttcttcaaggccgccatcagcctggtgcctgaggtgcccaagatgatcaacattgatggcaagatgaggcccagcgagagcttcctgctggagttcctgtgcaacttcttcagcaccctgctgattgtgcctgaccaccctgagcacggcgtgctcttcctggtgcgggagctgctgaatgtcatccaggactacacctgggaggacaacagtgatgagaagatccgcatctacacctgtgtgctgcacctgctgagcgccatgagccaggagacctacctgtaccacatcgacaaggtggacagcaatgacagcctgtatggaggagacagcaagttcctggccgagaacaacaagctgtgtgagaccgtgatggcccagatcctggagcacctgaagaccctggccaaggatgaggccctgaagaggcagagcagcctgggcctgtccttcttcaacagcatcctggcccatggagacctgaggaacaacaagctgaaccagctgtctgtgaacctgtggcacctggcccagagacatggctgtgccgacaccaggaccatggtgaagaccctggagtacatcaagaagcagagcaagcagcctgacatgacccacctgacagagctggccctgcggctgcccctgcagaccaggacatag

SEQ ID NO: 33176 - DNA, 822 bp, Artificial Sequence
  Description of Artificial Sequence: Synthetic coding sequence
atggccccagctggggtggtgaccagggctgtgcgctctggagagctgcccctgacctccatggccagcgcagaaaatgaggcctgtgctgtgcgctctgtggcctgccccagccaggcctggaggctgcagaaggtgctgtgtggccgctgtggggccgccagctgccccagccagacctggaggcccaggggggccggcagcggcggcgtgaggatgggcagcagagcagatggccccaggaccagcggccacgtgacaggcaagatggctgtgttcccctggcacagcaggaacagaaactacaaggccgagtttgccagctgccgcctggaggccgtgcccctggagtttggagactaccaccccctgaagcccatcaccgtgacagagagcaagaccaagaaggtgaacaggaagggcagcaccagcagcaccagcagcagcagcagcagctctgtggtggaccccctgagctctgtgctggatggaacagaccccctgtccatgtttgctgccacagctgaccctgctgccctggccgccgccatggacagcagcaggaggaagagggacagagatgacaacagcgtggtgggcagtgactttgagccctggaccaacaagagaggagagatcctggcccgctacaccaccacagagaagctgagcatcaacctcttcatgggcagcgagaaggatggcggctacagcgagcccaggagccgccacaggaccccagcctggaccacagagcagagctgggactgccacatcggaaatgtgcgggagggcgctgaccctgctggaggagctggatag

SEQ ID NO: 33177 - DNA, 2880 bp, Artificial Sequence
  Description of Artificial Sequence: Synthetic coding sequence
atggccccagctggggtggtgaccagggctgtgcgctctggagagctgcccctgacctccatggccagcgcagaaaatgaggcctgtgctgtgcgctctgtggcctgccccagccaggcctggaggctgcagaaggtgctgtgtggccgctgtggggccgccagctgccccagccagacctggaggcccaggggggccggcagcggcggcgtgaggatgggcagcagagcagatggccccaggaccagcggccacgtgacaggcaagatggctgtgttcccctggcacagcaggaacagaaactacaaggccgagtttgccagctgccgcctggaggccgtgcccctggagtttggagactaccaccccctgaagcccatcaccgtgacagagagcaagaccaagaaggtgaacaggaagggcagcaccagcagcaccagcagcagcagcagcagctctgtggtggaccccctgagctctgtgctggatggaacagaccccctgtccatgtttgctgccacagctgaccctgctgccctggccgccgccatggacagcagcaggaggaagagggacagagatgacaacagcgtggtgggcagtgactttgagccctggaccaacaagagaggagagatcctggcccgctacaccaccacagagaagctgagcatcaacctcttcatgggcagcgagaagggcaaggccggcacagccaccctggccatgtctgagaaggtgaggacccggctggaggagctggatgactttgaggagggcagccagaaggagctgctgaacctgacccagcaggactatgtgaacagaattgaggagctgaaccagagcctgaaggatgcctgggccagtgaccagaaggtgaaggccctgaagatcgtcatccagtgcagcaagctgctgagtgacaccagcgtcatccagttctaccccagcaagtttgtgctgatcacagacatcctggacaccttcggcaagctggtgtatgagcgcatcttctccatgtgtgtggacagccgctctgtgctgcctgaccacttctccccagaaaatgccaatgacacagccaaggagacctgcctgaactggttcttcaagatcgccagcatccgggagctgatcccccgcttctacgtggaggccagcatcctgaagtgcaacaagttcctgagcaagacaggcatcagtgaatgtctgccccggctgacctgcatgatccggggcattggagaccccctggtgtctgtgtatgcccgggcctacctgtgccgggccctgctgacagagatgatggagcgctgcaagaagctgggcaacaatgccctgctgctgaacagcgtgatgtctgccttccgggcagagttcatcgccaccaggtccatggacttcatcggcatgatcaaggaatgtgatgaaagtggcttccccaagcacctgctcttccgcagcctgggcctgaacctggccctggccgaccccccagagagtgaccggctgcagatcctgaatgaggcctggaaggtgatcaccaagctgaagaacccccaggactacatcaactgtgccgaggtgtgggtggagtacacctgcaagcacttcaccaagcgggaggtgaacacagtgctggctgatgtgatcaagcacatgaccccagaccgggcctttgaggacagctacccccagctgcagctgatcatcaagaaggtgattgcccacttccatgacttctctgtgctcttctctgtggagaagttcctgcccttcctggacatgttccagaaggagagcgtgcgggtggaggtgtgcaagtgcatcatggatgccttcatcaagcaccagcaggagcccaccaaggaccccgtcatcctgaatgccctgctgcacgtgtgcaagaccatgcatgacagcgtgaatgccctgaccctggaggatgagaagaggatgctgagctacctgatcaatggcttcatcaagatggtgtcctttggccgggactttgagcagcagctgtccttctacgtggagagccgctccatgttctgcaacctggagcctgtgctggtgcagctgatccacgcctgtgtggcctactgcttcatcaccatccccagcctggccggcatcttcacccggctgaacctgtacctgcacagcggccaggtggccctggccaaccagtgcctgagccaggctgatgccttcttcaaggccgccatcagcctggtgcctgaggtgcccaagatgatcaacattgatggcaagatgaggcccagcgagagcttcctgctggagttcctgtgcaacttcttcagcaccctgctgattgtgcctgaccaccctgagcacggcgtgctcttcctggtgcgggagctgctgaatgtcatccaggactacacctgggaggacaacagtgatgagaagatccgcatctacacctgtgtgctgcacctgctgagcgccatgagccaggagacctacctgtaccacatcgacaaggtggacagcaatgacagcctgtatggaggagacagcaagttcctggccgagaacaacaagctgtgtgagaccgtgatggcccagatcctggagcacctgaagaccctggccaaggatgaggccctgaagaggcagagcagcctgggcctgtccttcttcaacagcatcctggcccatggagacctgaggaacaacaagctgaaccagctgtctgtgaacctgtggcacctggcccagagacatggctgtgccgacaccaggaccatggtgaagaccctggagtacatcaagaagcagagcaagcagcctgacatgacccacctgacagagctggccctgcggctgcccctgcagaccaggacatag

SEQ ID NO: 33178 - DNA, 759 bp, Artificial Sequence
  Description of Artificial Sequence: Synthetic coding sequence
atgggcagcgagctgattggccgcctggccccccggctgggcctggccgagccagacatgctgaggaaggccgaggagtacctgcggctgagccgggtgaagtgtgtgggcctgagcgcccggaccacagagaccagcagcgctgtgatgtgcctggacctggccgcctcctggatgaagtgccccctggaccgggcctacctgatcaagctgagcggcctgaacaaggagacctaccagagctgcctgaagagctttgaatgtctgctgggcctgaacagcaacatcggcatccgggacctggccgtgcagttcagctgcatcgaggccgtgaacatggccagcaagatcctgaagagctatgagagcagcctgccccagacccagcaggtggacctggacctgagccggcccctcttcaccagcgctgccctgctgagcgcctgcaagatcctgaagctgaaggtggacaagaacaagatggtggccaccagcggcgtgaagaaggccatctttgaccggctgtgcaagcagctggagaagattggccagcaggtggaccgggagcctggagatgtggccaccccacccaggaagaggaagaagatcgtggtggaggccccagccaaggagatggagaaggtggaggagatgccccacaagccccagaaggatgaggacctgacccaggactatgaggagtggaagaggaagatcctggagaatgctgccagcgcccagaaggccacagctgagtag

SEQ ID NO: 33179 - DNA, 1071 bp, Artificial Sequence
  Description of Artificial Sequence: Synthetic coding sequence
atgggcctgatggtgcggggcggcgtgacctgccgcagccaggagcggctgctgggcgtgggcaccggcacagccagcgcccagccccctgtgacagccagcccctactgcagcttcaccggccgcagcagagcagatgccccagcccgggctgctggaaatggccagccccggctgcgggcccaggtggacctgagcagcgccagctctgtgctggtgacagtgctggatgccaaggccctgcccctgaccctgctgtcctggggcagcctgtgtgccacagcccagaaccacaacaaccaggagggcgccccagcccagcccaagggctccatggccaaccagagggccctgcgcttccccccacccagcggcagccccccaggcctgcacaccaggatgaggctgaccagccccccccagccccactttgagcccccaccacccaccaccgtgggcgcccccaggagcctgcagggcgactggtttggaagtgacagcagagctgtgcgggccctgcggctcatcggctgggccagccgcagcctgcaccccctgcccggcagccgggaccgggcccaccctgctgctgaggaggaggatgatcctgaccggcccatcgagttcagcagcagcaaggccaacccccaccgctggagcgtgggccacaccatgggcaagggccaccagaggccctggtggaaggtgctgcccctgagctgcttcctggtggccctgatcatctggtgctacctgcgggaggagagcgaggccgaccagtggctgcggcaggagggcagccggcagccccccttcggctttgatgtgacctttgcccgggactgccccggctacgcctgtgtgctgagcacagagggcctgggctggtggatgggccacctggccatgctgatccgggtgaaggccgagcagaacctgagccgctcagaaacagccccccggctggccctggatgtgcagggcttccaccggcaggacttcagtgacccctggggccgcttccagctgcactgcatgctgctggacctgcccagcctgtgcatcacctag

SEQ ID NO: 33180 - DNA, 399 bp, Artificial Sequence
  Description of Artificial Sequence: Synthetic coding sequence
atgaacagagtgctgtgtgccccagctgctggagctgtgcgggccctgcggctgattggctgggccagccgcagcctgcaccccctgcccggcagccgggaccgggcccaccctgctgctgaggaggaggatgatcctgaccggcccatcgagttcagcagcagcaaggccaacccccaccgctggagcgtgggccacaccatgggcaagggccaccagaggccctggtggaaggtgctgcccctgagctgcttcctggtggccctgatcatctggtgctacctgcgggaggagagcgaggccgaccagtggctgcggcaggtgtggggcgaggtgcctgagcccagcgacagaagtgaggagcctgagaccccagctgcctaccgggcccggacctag

SEQ ID NO: 33181 - DNA, 399 bp, Artificial Sequence
  Description of Artificial Sequence: Synthetic coding sequence
atgggcgccggcgtgggcgtggccggctgcacccggggccacaggaactgggtgcccagccagctgcccccccgggagatcaaggccggcgtgtccctggccgtggtgacagaatttgcctgggtgctggccccccggcccaagagggccacagccagcgccctgggcacagagagcccccgcttcctggacagaccagacttctttgactacccagacagcgaccaggcccggctgctggccgtggcccagttcatcggggagaagcccatcgtgttcatcaacagcggcagcagccctggcctcttccaccacatcctggtgggcctgctggtggtggccttcttcttcctgctcttccagttctgcacccacatcaacttccagaagggggcctag

SEQ ID NO: 33182 - DNA, 960 bp, Artificial Sequence
  Description of Artificial Sequence: Synthetic coding sequence
atggccccccagaggagagctgccaccaaggcccctgagggcaatggagctgctgagaggaggaacagaagcagcaccaagaaggaccgggccccccgggaggtgcagaggctgtggcagaggccctggctgaggacagctggcctgggcgccggctttgtgctgacagccctgctgctgtggagcagcctgggcgcagatgatggagtggccgaggtgctggcccggcggggggaggtggtggccggccgcttcatcgaggtgccctgcagcgaggactatgacagccacagaagatttgagggctgcacccccaggaaatgtggccggggcgtgacagatgtggtgatcacccgggaggaggccgagcgcatccgctctgtggccgagaagggcctgagcctgggcggcagtgatggaggagccagcatcctggacctgcacagcggggccctgtctgtgggcaagcactttgtgaacctgtaccgctactttggagacaagatccagaacatcttcagcgaggaggacttccggctgtaccgggaggtgcggcagaaggtgcagctgaccatcgccgaggccttcggcatcagcgccagcagcctgcacctgaccaagcccaccttcttcagccgcatcaacagcacagaggccaggacagcccatgatgagtactggcacgcccacgtggacaaggtgacctacggcagctttgactacaccagcctgctgtacctgagcaactacctggaggactttggaggcggccgcttcatgttcatggaggagggcgccaacaagacagtggagccccgggccggccgggtgtccttcttcaccagcggcagcgagaacctgcaccgggtggagaaggtgcactggggcaccaggtatgccatcaccatcgccttcagctgcaacccagaccatggaattgaggaccctgccttcccctag

SEQ ID NO: 33183 - DNA, 996 bp, Artificial Sequence
  Description of Artificial Sequence: Synthetic coding sequence
atggccccccagaggagagctgccaccaaggcccctgagggcaatggagctgctgagaggaggaacagaagcagcaccaagaaggaccgggccccccgggaggtgcagaggctgtggcagaggccctggctgaggacagctggcctgggcgccggctttgtgctgacagccctgctgctgtggagcagcctgggcgcagatgatggagtggccgaggtgctggcccggcggggggaggtggtggccggccgcttcatcgaggtgccctgcagcgaggactatgacagccacagaagatttgagggctgcacccccaggaaatgtggccggggcgtgacagatgtggtgatcacccgggaggaggccgagcgcatccgctctgtggccgagaagggcctgagcctgggcggcagtgatggaggagccagcatcctggacctgcacagcggggccctgtctgtgggcaagcactttgtgaacctgtaccgctactttggagacaagatccagaacatcttcagcgaggaggacttccggctgtaccgggaggtgcggcagaaggtgcagctgaccatcgccgaggccttcggcatcagcgccagcagcctgcacctgaccaagcccaccttcttcagccgcatcaacagcacagaggccaggacagcccatgatgagtactggcacgcccacgtggacaaggtgacctacggcagctttgactacaccagcctgctgtacctgagcaactacctggaggactttggaggcggccgcttcatgttcatggaggagggcgccaacaagacagtggagccccgggccggctgcttctgcttcaggatgatgagctgtggcttccaggaggtgaatggcccccgggccagcgaggccgccggggccaaggccggcgtgcgctgccccccaggcacccaccaccccccagagcggggggagacccacgccatcctggaggccgagagcatcgcctactgctag

SEQ ID NO: 33184 - DNA, 234 bp, Artificial Sequence
  Description of Artificial Sequence: Synthetic coding sequence
atggccgccacagactttgtgcaggagatgagagctgtgggggagcggctgctgctgaagctgcagaggctgccccaggccgagcctgtggagatcgtggccttcagcgtcatcatcctcttcaccgccaccgtgctgctgctgctgctgattgcctgcagctgctgctgcacccactgctgctgcccagagcggcggggcaggaaggtgcaggtgcagcccaccccaccctag

SEQ ID NO: 33185 - DNA, 1578 bp, Artificial Sequence
  Description of Artificial Sequence: Synthetic coding sequence
atggctgctgccccacccctgcgggaccggctgtccttcctgcaccggctgcccatcctgctgaagggcaccagtgatgatgatgtgccctgccccggctacctgtttgaggagatcgccaagatcagccatgagagccctggcagcagccagtgcctgctggagtacctgctgagccggctgcacagcagcagcggccacggcaagctgaaggtgctgaagatcctgctgtacctgtgcagccacggcagcagcttcttcctgctgatcctgaagagaaattctgccttcatccaggaggccgccgcctttgctggccccccagaccccctgcacggcaacagcctgtaccagaaggtgcgggctgctgcccaggacctgggcagcaccctcttcagtgacacagtgctgcccctggcccccagccagcccctgggcaccccaccagccaccggcatgggcagccaggcccggccccacagcaccctgcagggcttcggctacagcaaggagcacggccgcacagctgtgcgccaccagcccggccaggccggcggcggctgggatgagctggacagcggccccagcagccagaacagcagccagaacagcgacctgagccgggtgtctgacagcggcagccacagcggcagtgacagccacagcggggccagccgggagcccggggacctggccgagcgggtggaggtggtggccctgagtgactgccagcaggagctgagcctggtgaggacagtgacccggggcccccgggccttcctgagccgggaggaggcccagcacttcatcaaggcctgtggcctgctgaactgtgaggccgtgctgcagctgctgacctgccacctgcggggcaccagcgagtgcacccagctgcgggccctgtgtgccatcgccagcctgggcagcagtgacctgctgccccaggagcacatcctgctgcggacccggccctggctgcaggagctgtccatgggcagccctggccctgtgaccaacaaggccaccaagatcctgcggcactttgaggccagctgtggccagctgagccctgcccggggcaccagcgctgagcccggccccacagctgccctgcccggccccagcgacctgctgacagatgctgtgcccctgcccggcagccaggtgttcctgcagcccctgagcagcacccctgtgagcagccgcagccctgcccccagcagcggcatgcccagcagccctgtgcccaccccacctccagatgccagccccatcccagcccctggggaccccagcgaggccgaggcccggctggccgagagccgccgctggaggcctgagcgcatccctgggggcacagacagccccaagaggggccccagcagctgtgcctggagccgggacagcctgtttgctggcatggagctggtggcctgcccccggctggtgggcgctggagctgctgctggggagagctgcccagatgccccccgggccccccagaccagcagccagaggacagctgccaaggagcccccaggcagcgagcccagcgcctttgccttcctgaatgcctag

SEQ ID NO: 33186 - DNA, 1326 bp, Artificial Sequence
  Description of Artificial Sequence: Synthetic coding sequence
atgggcagccaggcccggccccacagcaccctgcagggcttcggctacagcaaggagcacggccgcactggatctgctggggaggccttcctgagcaccatccagaaggctgctgaggtggtggccagcgccatgaggcctggccctgagagccccagcacccggcggctgctgcccaggggggacacctaccagcctgccatgatgcccagcgccagccacggcccccccaccctgggcaacctgctgcccggggccatccctggccccagggctgtgcgccaccagcccggccaggccggcggcggctgggatgagctggacagcggccccagcagccagaacagcagccagaacagcgacctgagccgggtgtctgacagcggcagccacagcggcagtgacagccacagcggggccagccgggagcccggggacctggccgagcgggtggaggtggtggccctgagtgactgccagcaggagctgagcctggtgaggacagtgacccggggcccccgggccttcctgagccgggaggaggcccagcacttcatcaaggcctgtggcctgctgaactgtgaggccgtgctgcagctgctgacctgccacctgcggggcaccagcgagtgcacccagctgcgggccctgtgtgccatcgccagcctgggcagcagtgacctgctgccccaggagcacatcctgctgcggacccggccctggctgcaggagctgtccatgggcagccctggccctgtgaccaacaaggccaccaagatcctgcggcactttgaggccagctgtggccagctgagccctgcccggggcaccagcgctgagcccggccccacagctgccctgcccggccccagcgacctgctgacagatgctgtgcccctgcccggcagccaggtgttcctgcagcccctgagcagcacccctgtgagcagccgcagccctgcccccagcagcggcatgcccagcagccctgtgcccaccccacctccagatgccagccccatcccagcccctggggaccccagcgaggccgaggcccggctggccgagagccgccgctggaggcctgagcgcatccctgggggcacagacagccccaagaggggccccagcagctgtgcctggagccgggacagcctgtttgctggcatggagctggtggcctgcccccggctggtgggcgctggagctgctgctggggagagctgcccagatgccccccgggccccccagaccagcagccagaggacagctgccaaggagcccccaggcagcgagcccagcgcctttgccttcctgaatgcctag

SEQ ID NO: 33187 - DNA, 1074 bp, Artificial Sequence
  Description of Artificial Sequence: Synthetic coding sequence
atggagagcagccggggccggcccggccctgagacagacctgctggccgtggccgagcaccaggccctggtgtttggaggcggccctggccgcaccagcagcgagcccccagctggcctgcgggtgtctggagaggaggagacagaaaatgtgggcggggccaacagacaccccaggaccagccccaagaccagcagctgtggggtggtgcacaggcctgagcgggaggccctggagaatgagcccggcccccagggcaccctgtctggagctggcagccggcggggggcccctggagctgagcacgagcccagcctgagcagccgccacaagaacccagcccctcctgagggcaagcccagcagcggccgggactgcagaagaggaggccctgggggcggcatggatgtggagcagcaggaggaggaggacaatgatgaggaggccgctgctggcagcagagctggccgctccttcagcagccggctgcaggacagccgcagcctggatggcctgtctgaggcctgtggcggggccggcagcagcggcagcgctgagagcggggccggcggcggcagaagagccaccatcagcagccccctggagctggagggcaccgtgagccgccacggggacctgacccactttgtggccaacaacctgcagctgaagatccggctgagcggggcccctcctcctccacccagcgccccagcccggccctgcccagccccagcccccacccccaccccagccatcccccccatcgaccctgaggtgctgcgggacctggagcggctgagccgggagctgggcggccgggtggaccggctgctgcggggcctgggcggcgctgtgcaggagctgacagccctgtctgtgggctgcatccagacctacagagatgctgtggacagcctgggggaggccgtggacatgagcatcaagggcatgtacaccctgctggcccgctgtgaggagctggagcgggccctgcagcctgtgcagggcctggcccggcaggtgcgggacatccggaggaccctggaggtgctggaggccctgtgcaagtag

SEQ ID NO: 33188 - DNA, 342 bp, Artificial Sequence
  Description of Artificial Sequence: Synthetic coding sequence
atggccggccctgctgctgccttccggcggctgggcgccctgtctggagctgctgccctgggctttgccagctatggagcccacggggcccagttcccagatgcctacggcaaggagctgtttgacaaggccaacaagcaccacttcctgcacagcctggccctgctgggcgtgccccactgcaggaagcccctgtgggccggcctgctgctggccagcggcaccaccctcttctgcaccagcttctactaccaggccctgagcggggaccccagcatccagaccctggccccagctgggggcaccctgctgctgctgggctggctggccctggccctgtag

SEQ ID NO: 33189 - DNA, 564 bp, Artificial Sequence
  Description of Artificial Sequence: Synthetic coding sequence
atgtacctgcaggtggagaccaggaccagcagccggctgcacctgaagagggcccctggcatccgctcctggagcctgctggtgggcatcctgagcatcggcctggccgccgcctactacagcggggacagcctgggctggaagctgttctacgtgacaggctgcctgtttgtggccgtgcagaacctggaggactgggaggaggccatctttgacaagagcacaggcaaggtggtgctgaagaccttcagcctgtacaagaagctgctgaccctcttccgggccggccatgaccaggtggtggtgctgctgcatgatgtgagagatgtgtctgtggaggaggagaaggtgcgctactttgggaagggctacatggtggtgctgcggctggccaccggcttcagccaccccctgacccagagcgctgtgatgggccacagaagtgatgtggaggccatcgccaagctgatcaccagcttcctggagctgcactgcctggagagccccacagagctgagccagagcagtgacagcgaggccggggaccctgccagccagagctag

SEQ ID NO: 33190 - DNA, 672 bp, Artificial Sequence
  Description of Artificial Sequence: Synthetic coding sequence
atgtggaagcccagccccagcagcagccctgcctcctggagctgcacagccctgcgggccccccagagctgcctgcgggccgccaccgtgcggcctgtgaccctgcaggcccgggctgacagccccaccgtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggccctggctgcagctggtgcccccagctgagctggcctactgcctgctgatgctgctgctggcccactgcatgaagcagcaggcccggcccggccacccagacttcctgcaccgggaggcctgggcctgcctgtctgctgctgggggcctggccagccctggcctgctgctgtgggccacagcccggccccgggccagcggggaggccggccctggccgggccctggtgggcgcagatgctgcctgctgccccaggcacagcgtgctgagcctggtggacatccccagcggccaggtgctgccccagggccagtag

SEQ ID NO: 33191 - DNA, 786 bp, Artificial Sequence
  Description of Artificial Sequence: Synthetic coding sequence
gcctggaggagaagaagaagtggcaccagcggcaaggccacctggtggtgcagcggcctgcggcgggccagccccacccccagcagaagagtgcagagctgggccacagctgtgatgtggaagcccagccccagcagcagccctgcctcctggagctgcacagccctgcgggccccccagagctgcctgcgggccgccaccgtgcggcctgtgaccctgcaggcccgggctgacagccccaccgtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggccctggctgcagctggtgcccccagctgagctggcctactgcctgctgatgctgctgctggcccactgcatgaagcagcaggcccggcccggccacccagacttcctgcaccgggaggcctgggcctgcctgtctgctgctgggggcctggccagccctggcctgctgctgtgggccacagcccggccccgggccagcggggaggccggccctggccgggccctggtgggcgcagatgctgcctgctgccccaggcacagcgtgctgagcctggtggacatccccagcggccaggtgctgccccagggccagtag

SEQ ID NO: 33192 - DNA, 522 bp, Artificial Sequence
  Description of Artificial Sequence: Synthetic coding sequence
atgtacctgcaggtggagaccaggaccagcagccggctgcacctgaagagggcccctggcatccgctcctggagcctgctggtggacagcctgggctggaagctgttctacgtgacaggctgcctgtttgtggccgtgcagaacctggaggactgggaggaggccatctttgacaagagcacaggcaaggtggtgctgaagaccttcagcctgtacaagaagctgctgaccctcttccgggccggccatgaccaggtggtggtgctgctgcatgatgtgagagatgtgtctgtggaggaggagaaggtgcgctactttgggaagggctacatggtggtgctgcggctggccaccggcttcagccaccccctgacccagagcgctgtgatgggccacagaagtgatgtggaggccatcgccaagctgatcaccagcttcctggagctgcactgcctggagagccccacagagctgagccagagcagtgacagcgaggccggggaccctgccagccagagctag

SEQ ID NO: 33193 - DNA, 564 bp, Artificial Sequence; identical to SEQ ID NO: 33189
  Description of Artificial Sequence: Synthetic coding sequence

SEQ ID NO: 33194 - DNA, 684 bp, Artificial Sequence
  Description of Artificial Sequence: Synthetic coding sequence
atgggccacagaagtgatgtggaggccatcgccagcagcagccctgcctcctggagctgcacagccctgcgggccccccagagctgcctgcgggccgccaccgtgcggcctgtgaccctgcaggcccgggctgacagccccaccgtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggcacatccctggggtgcctgagcctgtgcaccggccccaggacccctggccctggctgcagctggtgcccccagctgagctggcctactgcctgctgatgctgctgctggcccactgcatgaagcagcaggcccggcccggccacccagacttcctgcaccgggaggcctgggcctgcctgtctgctgctggggtgtccccagccctggacagctgcttcggcccccagcaggacctgggccgggtggagcggcgggcccggcctgccctggtgggcgcagatgctgcctgctgccccaggcacagcgtgctgagcctggtggacatccccagcggccaggtgctgccccagggccagtag

SEQ ID NO: 33195 - DNA, 828 bp, Artificial Sequence
  Description of Artificial Sequence: Synthetic coding sequence
atggacaccatcctggtgttcagcctcatcatcgccagctatgatgccaacaagaaggacctgcgggacagcagctgccgcctggagcagctgcccggcatcttccccaaggatgtgcgcagcatccgggagctgcagatgcaggagacccacacagagaccaagaggaccaccttcatccagaacagaaccatcgccaccctgcagtgcctgggcagtgacagcaaggtgaaggtgaacctggtgtacctggagcggcggcccaaggtgaagcacatcctgaagaacctgcgcatcatcgccgcccccaggaggaacagcagcgccagcagcagctgccacctgatccccaccagcaagttccagacaggcagcctgctgaagggcaaggccttcctgcccggcatcagccagtgcaaggtgctgggcgccagcagcgagaccttccccaccacagcccccagcatcaccccaggcaacaaggagggggagaagaccaccagcacagacacagatgagaacctggagaagaggcagaagtggagcatcgtggtgaagatcctgattgctgtgaccctgctgctgagcggcgtggccatcatcgtgtttgtgatctttgaggtgccctgcccctaccagtgcctgggcgccaggaagctgtgccagtgccagtggctgtggcgctggcagaagaagggcggccagcccccaggcacagctgagagcaagccagacagccagccccagaaggtgggccaggatgctgccaacagcagcaaccccaagaaggctgctgagatcaccgtcatccaccagacctacttctag

SEQ ID NO: 33196 - DNA, 480 bp, Artificial Sequence
  Description of Artificial Sequence: Synthetic coding sequence
atggacaccatcctggtgttcagcctcatcatcgccagctatgatgccaacaagaaggacctgcgggacagcagctgccgcctggagcagctgcccggcatcttccccaaggatgtgcgcagcatccgggagctgcagatgcaggagacccacacagagaccaagaggaccaccttcatccagaacagaaccatcgccaccctgcagtgcctgggcagtgacagcaaggtgaaggtgaacctggtgtacctggagcggcggcccaaggtgaagcacatcctgaagaacctgcgcatcatcgccgcccccaggaggaacagcagcgccagcagcagctgccacctgatccccaccagcaagttccagacaggcagcctgctgaagggcaaggtgtccatgcccaggagccaggaggccgtgcccatgcctgtggtggtggagatggccaaggagggccggcctgccacctgggacagctag

SEQ ID NO: 33197 - DNA, 1644 bp, Artificial Sequence
  Description of Artificial Sequence: Synthetic coding sequence
atgtctgacaacccccccaggatggaggtgtgcccctactgcaagaagcccttcaagaggctgaagagccacctgccctactgcaagatgattggccccaccatccccacagaccagaaggtgtaccagagcaagccagccaccctgccccgggccaagaagatgaagggccccatcaaggacctgatcaaggccaagggcaaggagctggagacagaaaatgaggagaggaacagcaagctggtggtggacaagccagagcagacagtgaagaccttccccctgcctgctgtgggcctggagagagctgccaccaccaaggctgacaaggacatcaagaaccccatccagcccagcttcaagatgctgaagaacaccaagcccatgaccaccttccaggaggagaccaaggcccagttctacgccagcgagaagaccagccccaagcgggagctggccaaggacctgcccaagtctggagagagccgctgcaaccccagcgaggccggggccagcctgctggtgggcagcattgagcccagcctgagcaaccaggacaggaagtacagcagcaccctgcccaatgatgtgcagaccaccagcggggacctgaagctggacaagattgacccccagaggcaggagctgctggtgaagctgctggatgtgcccactggagactgccacatcagccccaagaatgtgtctgatggagtgaagagggtgaggaccctgctgagcaatgaaagagacagcaagggccgggaccacctgtctggagtgcccacagatgtgacagtgacagagaccccagagaagaacacagagagcctcatcctgagcctgaagatgagcagcctgggcaagatccaggtgatggagaagcaggagaagggcctgaccctgggcgtggagacctgtggcagcaaaggaaatgctgagaagtccatgtctgccacagagaagcaggagaggacagtgatgagccacggctgtgagaacttcaacacccgggacagcgtgacaggcaaggagagccagggcgagcggccccacctgagcctcttcatcccccgggagaccacctaccagttccacagcgtgtcccagagcagcagccagagcctggccagcctggccaccaccttcctgcaggagaagaaggccgaggcccagaaccaccactgtgtgcctgatgtgaaggccctgatggagagccctgagggccagctgagcctggagcccaagagtgacagccagttccaggccagccacacaggctgccagagccccctgtgcagcgcccagaggcacaccccccagagccccttcaccaaccacgccgctgctgctggcaggaagaccctgcggagctgcatgggcctggagtggttccctgagctgtacccaggctacctgggcctgggcgtgctgcccgggaagccccagtgctggaatgccatgacccagaagccccagctgatcagcccccagggcgagcggctgagccagggctggatccgctgcaacaccaccatcaggaagagcggctttggaggcatcaccatgctgttcaccggctactttgtgctgtgctgctcctggagcttccggcggctgaagctgcagcgctggaggaagtag

SEQ ID NO: 33198 - DNA, 1722 bp, Artificial Sequence
  Description of Artificial Sequence: Synthetic coding sequence
atgtctgacaacccccccaggatggaggtgtgcccctactgcaagaagcccttcaagaggctgaagagccacctgccctactgcaagatgattggccccaccatccccacagaccagaaggtgtaccagagcaagccagccaccctgccccgggccaagaagatgaagggccccatcaaggacctgatcaaggccaagggcaaggagctggagacagaaaatgaggagaggaacagcaagctggtggtggacaagccagagcagacagtgaagaccttccccctgcctgctgtgggcctggagagagctgccaccaccaaggctgacaaggacatcaagaaccccatccagcccagcttcaagatgctgaagaacaccaagcccatgaccaccttccaggaggagaccaaggcccagttctacgccagcgagaagaccagccccaagcgggagctggccaaggacctgcccaagtctggagagagccgctgcaaccccagcgaggccggggccagcctgctggtgggcagcattgagcccagcctgagcaaccaggacaggaagtacagcagcaccctgcccaatgatgtgcagaccaccagcggggacctgaagctggacaagattgacccccagaggcaggagctgctggtgaagctgctggatgtgcccactggagactgccacatcagccccaagaatgtgtctgatggagtgaagagggtgaggaccctgctgagcaatgaaagagacagcaagggccgggaccacctgtctggagtgcccacagatgtgacagtgacagagaccccagagaagaacacagagagcctcatcctgagcctgaagatgagcagcctgggcaagatccaggtgatggagaagcaggagaagggcctgaccctgggcgtggagacctgtggcagcaaaggaaatgctgagaagtccatgtctgccacagagaagcaggagaggacagtgatgagccacggctgtgagaacttcaacacccgggacagcgtgacaggcaaggagagccagggcgagcggccccacctgagcctcttcatcccccgggagaccacctaccagttccacagcgtgtcccagagcagcagccagagcctggccagcctggccaccaccttcctgcaggagaagaaggccgaggcccagaaccaccactgtgtgcctgatgtgaaggccctgatggagagccctgagggccagctgagcctggagcccaagagtgacagccagttccaggccagccacacaggctgccagagccccctgtgcagcgcccagaggcacaccccccagagccccttcaccaaccacgccgctgctgctggcaggaagaccctgcggagctgcatgggcctggagtggttccctgagctgtacccaggctacctgggcctgggcgtgctgcccgggaagccccagtgctggaatgccatgacccagaagccccagctgatcagcccccagggcgagcggctgagccagggctggatccgctgcaacaccaccatcaggaagagcggctttggaggcatcaccatgctgttcaccggctactttgtgctgtgctgctcctggagcttccggcggctgaagaagctgtgccggcccctgccctggaagagcacagtgcccccctgcattggagtggccaagaccactggagactgccgcagcaagacctgcctggactag

SEQ ID NO: 33199 - DNA, 1830 bp, Artificial Sequence
  Description of Artificial Sequence: Synthetic coding sequence
atgtctgacaacccccccaggatggaggtgtgcccctactgcaagaagcccttcaagaggctgaagagccacctgccctactgcaagatgattggccccaccatccccacagaccagaaggtgtaccagagcaagccagccaccctgccccgggccaagaagatgaagggccccatcaaggacctgatcaaggccaagggcaaggagctggagacagaaaatgaggagaggaacagcaagctggtggtggacaagccagagcagacagtgaagaccttccccctgcctgctgtgggcctggagagagctgccaccaccaaggctgacaaggacatcaagaaccccatccagcccagcttcaagatgctgaagaacaccaagcccatgaccaccttccaggaggagaccaaggcccagttctacgccagcgagaagaccagccccaagcgggagctggccaaggacctgcccaagtctggagagagccgctgcaaccccagcgaggccggggccagcctgctggtgggcagcattgagcccagcctgagcaaccaggacaggaagtacagcagcaccctgcccaatgatgtgcagaccaccagcggggacctgaagctggacaagattgacccccagaggcaggagctgctggtgaagctgctggatgtgcccactggagactgccacatcagccccaagaatgtgtctgatggagtgaagagggtgaggaccctgctgagcaatgaaagagacagcaagggccgggaccacctgtctggagtgcccacagatgtgacagtgacagagaccccagagaagaacacagagagcctcatcctgagcctgaagatgagcagcctgggcaagatccaggtgatggagaagcaggagaagggcctgaccctgggcgtggagacctgtggcagcaaaggaaatgctgagaagtccatgtctgccacagagaagcaggagaggacagtgatgagccacggctgtgagaacttcaacacccgggacagcgtgacaggcaaggagagccagggcgagcggccccacctgagcctcttcatcccccgggagaccacctaccagttccacagcgtgtcccagagcagcagccagagcctggccagcctggccaccaccttcctgcaggagaagaaggccgaggcccagaaccaccactgtgtgcctgatgtgaaggccctgatggagagccctgagggccagctgagcctggagcccaagagtgacagccagttccaggccagccacacaggctgccagagccccctgtgcagcgcccagaggcacaccccccagagccccttcaccaaccacgccgctgctgctggcaggaagaccctgcggagctgcatgggcctggagtggttccctgagctgtacccaggctacctgggcctgggcgtgctgcccgggaagccccagtgctggaatgccatgacccagaagccccagctgatcagcccccagggcgagcggctgagccaggtgtccctgctggagaggagcagcacccacatccgcagcctggagcccccagctggcctgaccaccagcaacttcagcctgatgaggctgctgggcgctgtgcagaagggctggatccgctgcaacaccaccatcaggaagagcggctttggaggcatcaccatgctgttcaccggctactttgtgctgtgctgctcctggagcttccggcggctgaagaagctgtgccggcccctgccctggaagagcacagtgcccccctgcattggagtggccaagaccactggagactgccgcagcaagacctgcctggactag

SEQ ID NO: 33200 - DNA, 1752 bp, Artificial Sequence
  Description of Artificial Sequence: Synthetic coding sequence
atgtctgacaacccccccaggatggaggtgtgcccctactgcaagaagcccttcaagaggctgaagagccacctgccctactgcaagatgattggccccaccatccccacagaccagaaggtgtaccagagcaagccagccaccctgccccgggccaagaagatgaagggccccatcaaggacctgatcaaggccaagggcaaggagctggagacagaaaatgaggagaggaacagcaagctggtggtggacaagccagagcagacagtgaagaccttccccctgcctgctgtgggcctggagagagctgccaccaccaaggctgacaaggacatcaagaaccccatccagcccagcttcaagatgctgaagaacaccaagcccatgaccaccttccaggaggagaccaaggcccagttctacgccagcgagaagaccagccccaagcgggagctggccaaggacctgcccaagtctggagagagccgctgcaaccccagcgaggccggggccagcctgctggtgggcagcattgagcccagcctgagcaaccaggacaggaagtacagcagcaccctgcccaatgatgtgcagaccaccagcggggacctgaagctggacaagattgacccccagaggcaggagctgctggtgaagctgctggatgtgcccactggagactgccacatcagccccaagaatgtgtctgatggagtgaagagggtgaggaccctgctgagcaatgaaagagacagcaagggccgggaccacctgtctggagtgcccacagatgtgacagtgacagagaccccagagaagaacacagagagcctcatcctgagcctgaagatgagcagcctgggcaagatccaggtgatggagaagcaggagaagggcctgaccctgggcgtggagacctgtggcagcaaaggaaatgctgagaagtccatgtctgccacagagaagcaggagaggacagtgatgagccacggctgtgagaacttcaacacccgggacagcgtgacaggcaaggagagccagggcgagcggccccacctgagcctcttcatcccccgggagaccacctaccagttccacagcgtgtcccagagcagcagccagagcctggccagcctggccaccaccttcctgcaggagaagaaggccgaggcccagaaccaccactgtgtgcctgatgtgaaggccctgatggagagccctgagggccagctgagcctggagcccaagagtgacagccagttccaggccagccacacaggctgccagagccccctgtgcagcgcccagaggcacaccccccagagccccttcaccaaccacgccgctgctgctggcaggaagaccctgcggagctgcatgggcctggagtggttccctgagctgtacccaggctacctgggcctgggcgtgctgcccgggaagccccagtgctggaatgccatgacccagaagccccagctgatcagcccccagggcgagcggctgagccaggtgtccctgctggagaggagcagcacccacatccgcagcctggagcccccagctggcctgaccaccagcaacttcagcctgatgaggctgctgggcgctgtgcagaagggctggatccgctgcaacaccaccatcaggaagagcggctttggaggcatcaccatgctgttcaccggctactttgtgctgtgctgctcctggagcttccggcggctgaagctgcagcgctggaggaagtag

SEQ ID NO: 33201 - DNA, 1740 bp, Artificial Sequence
  Description of Artificial Sequence: Synthetic coding sequence
atgtctgacaacccccccaggatggaggtgtgcccctactgcaagaagcccttcaagaggctgaagagccacctgccctactgcaagatgattggccccaccatccccacagaccagaaggtgtaccagagcaagccagccaccctgccccgggccaagaagatgaagggccccatcaaggacctgatcaaggccaagggcaaggagctggagacagaaaatgaggagaggaacagcaagctggtggtggacaagccagagcagacagtgaagaccttccccctgcctgctgtgggcctggagagagctgccaccaccaaggctgacaaggacatcaagaaccccatccagcccagcttcaagatgctgaagaacaccaagcccatgaccaccttccaggaggagaccaaggcccagttctacgccagcgagaagaccagccccaagcgggagctggccaaggacctgcccaagtctggagagagccgctgcaaccccagcgaggccggggccagcctgctggtgggcagcattgagcccagcctgagcaaccaggacaggaagtacagcagcaccctgcccaatgatgtgcagaccaccagcggggacctgaagctggacaagattgacccccagaggcaggagctgctggtgaagctgctggatgtgcccactggagactgccacatcagccccaagaatgtgtctgatggagtgaagagggtgaggaccctgctgagcaatgaaagagacagcaagggccgggaccacctgtctggagtgcccacagatgtgacagtgacagagaccccagagaagaacacagagagcctcatcctgagcctgaagatgagcagcctgggcaagatccaggtgatggagaagcaggagaagggcctgaccctgggcgtggagacctgtggcagcaaaggaaatgctgagaagtccatgtctgccacagagaagcaggagaggacagtgatgagccacggctgtgagaacttcaacacccgggacagcgtgacaggcaaggagagccagggcgagcggccccacctgagcctcttcatcccccgggagaccacctaccagttccacagcgtgtcccagagcagcagccagagcctggccagcctggccaccaccttcctgcaggagaagaaggccgaggcccagaaccaccactgtgtgcctgatgtgaaggccctgatggagagccctgagggccagctgagcctggagcccaagagtgacagccagttccaggccagccacacaggctgccagagccccctgtgcagcgcccagaggcacaccccccagagccccttcaccaaccacgccgctgctgctggcaggaagaccctgcggagctgcatgggcctggagtggttccctgagctgtacccaggctacctgggcctgggcgtgctgcccgggaagccccagtgctggaatgccatgacccagaagccccagctgatcagcccccagggcgagcggctgagccaggtgtccctgctggagaggagcagcacccacatccgcagcctggagcccccagctggcctgaccaccagcaacttcagcctgatgaggctgctgggcgctgtgcagaagggctggatccgctgcaacaccaccatcaggaagagcggctttggaggcatcaccatgctgttcaccggctactttgtgctgtgctgctcctggagcttccggcggctgaccctgcagtag

SEQ ID NO: 33202 - DNA, 225 bp, Artificial Sequence
  Description of Artificial Sequence: Synthetic coding sequence
atgtctgccaacggggctgtgtggggccgggtgcgcagccggctgcgggccttccctgagcggctggccgcctgtggggctgaggccgccgcctacggccgctgtgtgcaggccagcacagcccctgggggccgcctgagcaaggacttctgtgcccgggagtttgaggccctgcggagctgctttgctgctgctgccaagaagaccctggagggcggctgctag

SEQ ID NO: 33203 - DNA, 444 bp, Artificial Sequence
  Description of Artificial Sequence: Synthetic coding sequence
atgctgctgcggcgggtggtggagggcggccgggctgtggccgctgctgtgcggggcagcggggcccggcgcttcagcagcccagactgctgccagaggctgcccggcggcggcagcttcctgcagaggcaccaccctggggcccaggccccagatggccgcaggaagtttggaacagaccacgtggaggtgggcagccaggccggggctgatggcaccaggcctcccaaggccagcctgcccccagagctgcagccccccaccaactgctgcatgagcggctgccccaactgtgtgtgggtggagtatgctgaccggctgctgcagcacttccaggatggaggagagcgggccctggccgccctggaggagcacgtggctgatgagaacctgaaggccttcctgaggatggagatccggctgcacacccgctgtggcggctag

SEQ ID NO: 33204 - DNA, 633 bp, Artificial Sequence
  Description of Artificial Sequence: Synthetic coding sequence
atggtggccgacatcaagggaaatgagcagatcgagaagtacagctggagggaggcctgtgacaccggcagcagcaggatggacaggaagcacggcaagtacatcctgaatgtggagcacagcgagaaccagccccccatcacccaccccaatgaccaggaggcccacagcagcatctgctggtgcctgcccagcaatgacatcaccagtgatgtgagccccaacctgactggagtgtgtgtgaaccctggcatcctggcccacagccgctgcctgcagagcgagagctgcaacacccaggtgaaggagtactgcagaaatgactggagcatgtggaaggtgttcctggcctgcctgctggcctgcgtcatcatgacagccatcggcgtgctgatcatctgcctggtgaacaacaagggcagcgccaacagcagcatcgtcatccagctgagcaccaatgatggagaatgtgtgacagtgaagccaggcacccccagccctgcctgcccccccaccatgaccaccaccagcacagtgcctgccagcacagccacagagagcaccaccagcacagccacagctgccaccaccagcacagagcccatcaccgtggcccccacagaccacctgtag

SEQ ID NO: 33205 - DNA, 306 bp, Artificial Sequence
  Description of Artificial Sequence: Synthetic coding sequence
atggaccagtatgtgtccacagccccaccccgcttccccatcgcccagctgggcaccttcaagcaggacagcgctggcatgggccgcatcttcaagggcaacctgctgcagaagaaggccctgaccacctttgaaaatgagcaccacatccgcttcttcaccctgctggtgctcttccacgtgatggtgctgctgaggaaccacagccgcatccagggcgtgtctgaggactggaagagggccaacagcatcttcaggaacttcctgcggctgaagagcagcaggaacacagctgaggccgagtag

SEQ ID NO: 33206 - DNA, 306 bp, Artificial Sequence; identical to SEQ ID NO: 33205
  Description of Artificial Sequence: Synthetic coding sequence

SEQ ID NO: 33207 - DNA, 648 bp, Artificial Sequence
  Description of Artificial Sequence: Synthetic coding sequence
atggacaaggtgcagagcggcttcctgatcctcttcctgttcctgatggagtgccagctgcacctgtgcctgccctatgcagatggcctgcaccccactggaaacatcaccggcctgcccggcagcaagaggagccagcccccaagaaacatcaccaaggagcccaaggtgttcttccacaagacccagctgcccggcatccagggcgccgccagccgcagcacagctgccagccccaccaaccccatgaagttcctgaggaacaaggccatcatccgccacaggcctgccctggtgaaggtgatcctgatcagctctgtggccttcagcatcgccctgatctgtggcatggccatctcctacatgatctaccgcctggcccaggccgaggagcggcagcagctggagagcctgtacaagaacctgcgcatccccctgctgggagatgaggaggagggctctgaagatgaaggagagagcacccacctgctgcctgaaaatgaaaatgagctggagaagttcatccacagcgtcatcatcagcaagaggagcaagaacatcaagaagaagctgaaggaggagcagaacagcgtgacagagaacaagaccaagaatgccagccacaacgggaagatggaggacctgtag

SEQ ID NO: 33208 - DNA, 2178 bp, Artificial Sequence
  Description of Artificial Sequence: Synthetic coding sequence
atggccacagctgccaccaccaccaccaccaccacagccaccgtggccctgaccacctcctgggacaatgccaccggccggcccacagctgagccagaccccatcctggacaactacgtgctgctggtggtggtgatgagcctgtttgtgggcggcaccctggtggtgctgagcggcgtgctgctgctgtgcaagcgctgctgggatgtgcaccagaggctgaacagagccatggaggaggccgagaagaccaccaccacctacctggacaatggcacccacccagcccaggaccctgacttccggggggaggaccctgagtgccaggatgctgagacagagcgcttcctgagcaccagcagcacaggccggcgggtgtccttcaatgaagctgccctgtttgagcagagcaggaagacccaggacaagggccggcagggcggctggcagagcacagctgctggggccagcggcatgggcggcggccgggccctgatggcccgctgctgccgccgctacaccctgacagaaggagacttccaccacctgaagaatgcccggctgacccacctgcacctgccccccctgaagatcgtgaccatccatgaatgtgacagcggggaggccagcagcgccaccaccccccacccagccaccagccccaaggccaccctggccatcttccagcccccaggcaaggccctgaccggccgctctgtgggccccagcagcgccctgcccggggacccctacaacagcgctgctggggccacagactttgctgagatcagccccagcgccagcagtgacagcggggagggcaccagcctggatgctggcaccaggagcaccaaggccggcggccctggagctgctgctggccctggagaggccggccctggcagcggggccggcaccgtgctgcagttcctgacccggctgcggagacatgccagcctggatggagccagcccctacttcaaggtgaagaagtggaagctggagcccagccagagagctgccagcctggacacccggggcagccccaagaggcaccacttccagaggcagagagctgccagcgagagcacagagcaggaggagggagatgccccccaggaggacttcatccagtacatcgcccgggctggagatgctgtggccttcccccacccccggcccttcctggccagccccccaccagccctgggccgcctggaggccgctgaggccgccggcggggccagcccagacagccccccagagagaggagctggcagcgctggccctgagcagcagcagccccccctggagccagatgctgagagagatgctggccctgagcaggcccagaccagctacagagacctgtggagcctgcgggccagcctggagctgcacgccgccgccagtgaccacagcagcagtggaaatgaccgggacagcgtgcgcagcggggacagcagcggcagcggcagcggcggggccgccccagccttccccccacccagccccccagccccccggcccaaggatggagaggcccggcggctgctgcagatggattctggctacgccagcattgagggcagaggagctggagatgacacagagcccccagctgccccagcccggcccaggagcccccgggcctggccccggcggccccggcgggactacagcattgatgagaagacagatgccctcttccacgagttcctgcggcatgacccccactttgatgacaccccagctgctgcccggcaccgggcccgggcccacccccacgccaggaagcagtggcagaggggccggcagcacagcgaccccggggcccgggccgccccagccctggccggcaccccagcccccccagctggggccgcccggcctgcccgggcccccctgcggcggggggacagcgtggatggccccccagatggccgcaccctgggcggcgctggagatgatcctgccatccctgtgattgaggaggagcccggcggcggcggctgccccggcagcggcctgtgtgtgctgcccagcggctctgtgctggacaagctggccgccggcctggatgagcggctcttccccccccggctggccgagcctgtggtggccaccccagccctggtggccgccgcccccaccagcccagaccacagccctgcctag

SEQ ID NO: 33209 - DNA, 693 bp, Artificial Sequence
  Description of Artificial Sequence: Synthetic coding sequence
atgccctggaccatcctgctgtttgctgctggcagcctggccatcccagcccccagcatccggctggtgcccccctaccccagcagccaggaggaccccatccacatcgcctgcatggcccctggcaacttccctggggccaacttcaccctgtaccggggcggccaggtggtgcagctgctgcaggcccccacagaccagaggggcgtgaccttcaacctgagcggcggcagcagcaaggcccctgggggccccttccactgccagtatggagtgctgggggagctgaaccagagccagctgagtgacctgtctgagcctgtgaatgtgtccttccctgtgcccacctggatcctggtgctgagcctgagcctggccggggccctcttcctgctggccggcctggtggccgtggccctggtggtgaggaaggtgaagctgaggaacctgcagaagaagagggaccgggagagctgctgggcccagatcaactttgacagcacagacatgagctttgacaacagcctcttcaccgtgtctgccaagaccatgccagaagaagatcctgccaccctggatgaccacagcggcaccacagccacccccagcaacagcaggaccaggaagaggcccaccagcaccagcagcagccctgagaccccagagttcagcaccttccgggcctgccagtag

SEQ ID NO: 33210 - DNA, 1215 bp, Artificial Sequence
  Description of Artificial Sequence: Synthetic coding sequence
atggccctgagcctgcccctgggcccccggctgggcagcgagcccctgaaccaccccccaggggccccccgggaggccgacatcgtgggctgcaccgtgtgcccagccagcggggaggagagcaccagccctgagcaggcccagaccctgggccaggacagcctgggccccccagagcacttccagggcggccccagaggaaatgaacctgctgcccaccccccacgctggagcacccccagcagctatgaggaccctgctgggggcaagcactgtgagcaccccatcagcggcctggaggtgctggaggccgagcagaacagcctgcacctgtgcctgctgggcctgggccggcggctgcaggacctggagcagggcctgggccactgggccctggcccagagcggcatggtgcagctgcaggccctgcaggtggacctgcggggagctgctgagcgggtggaggccctgctggccttcggggagggcctggcccagaggtctgagccccgggcctgggccgccctggagcagatcctgcgggccctgggcgcctacagagacagcatcttccggcggctgtggcagctgcaggcccagctggtgtcctacagcctggtgtttgaggaggccaacaccctggaccaggacctggaggtggagggggacagcgactggccaggccctggaggagtgtggggcccctgggcccccagcagcctgcccaccagcacagagctggagtgggaccctgctggggacattggaggcctgggccccctgggccagaagacagcccggaccctgggcgtgccctgtgagctgtgtggccagaggggcccccagggccggggccagggcctggaggaggccgacaccagccacagccggcaggacatgctggagagcggcctgggccaccagaagaggctggcccggcaccagaggcacagcctgctgaggaagccccaggacaagaagaggcaggccagcccccacctgcaggatgtgcggctggagggcaaccctggggccccagaccctgccagccggcagcccctgaccttcctgctgatcctcttcctgctcttcctgctgctggtgggcgccatgttcctgctgcctgccagcggcggcccctgctgcagccacgcccgcatccccaggaccccctacctggtgctgtcctatgtgaatggcctgccccctgtgtag

SEQ ID NO: 33211 - DNA, 876 bp, Artificial Sequence
  Description of Artificial Sequence: Synthetic coding sequence
atggccctgagcctgcccctgggcccccggctgggcagcgagcccctgaaccaccccccaggggccccccgggaggccgacatcgtgggctgcaccgtgtgcccagccagcggggaggagagcaccagccctgagcaggcccagaccctgggccaggacagcctgggccccccagagcacttccagggcggccccagaggaaatgaacctgctgcccaccccccacgctggagcacccccagcagctatgaggaccctgctgggggcaagcactgtgaggtgtttgaggaggccaacaccctggaccaggacctggaggtggagggggacagcgactggccaggccctgggggcgtgtggggcccctgggcccccagcagcctgcccaccagcacagagctggagtgggaccctgctggggacatcggcggcctgggccccctgggccagaagacagcccggaccctgggcgtgccctgtgagctgtgtggccagaggggcccccagggccggggccagggcctggaggaggccgacaccagccacagccggcaggacatgctggagagcggcctgggccaccagaagaggctggcccggcaccagaggcacagcctgctgaggaagccccaggacaagaagaggcaggccagcccccacctgcaggatgtgcggctggagggcaaccctggggccccagaccctgccagccggcagcccctgaccttcctgctgatcctcttcctgctcttcctgctgctggtgggcgccatgttcctgctgcctgccagcggcggcccctgctgcagccacgcccgcatccccaggaccccctacctggtgctgtcctatgtgaatggcctgccccctgtgtag

SEQ ID NO: 33212 - DNA, 564 bp, Artificial Sequence
  Description of Artificial Sequence: Synthetic coding sequence
atggaggtggaggagatctacaagcaccaggaggtgaagatgcaggccccagccttccgggacaagaagcagggcgtgtctgccaagaaccagggcgcccatgaccctgactatgagaacatcaccctggccttcaagaaccaggaccacgccaagggcggccacagccggcccaccagccaggtgcctgcccagtgccggccccccagcgacagcacccaggtgccctgctggctgtaccgggccatcctgagcctgtacatcctgctggccctggcctttgtgctgtgcatcatcctgagcgccttcatcatggtgaagaatgctgagatgagcaaggagctgctgggcttcaagcgggagctgtggaatgtgagcaacagcgtgcaggcctgtgaggagcggcagaagaggggctgggacagcgtgcagcagagcatcaccatggtgcgcagcaagattgaccggctggagaccaccctggccggcatcaagaacatcgacaccaaggtgcagaagatcctggaggtgctgcagaagatgccccagagcagcccccagtag

SEQ ID NO: 33213 - DNA, 357 bp, Artificial Sequence
  Description of Artificial Sequence: Synthetic coding sequence
atggtggcccgggtgtggagcctgatgaggttcctgatcaagggctctgtggccggcggcgctgtgtacctggtgtatgaccaggagctgctgggccccagcgacaagagccaggccgccctgcagaaggccggggaggtggtgcccccagccatgtaccagttcagccagtatgtgtgccagcagacaggcctgcagatcccccagctgcctgccccacccaagatctacttccccatccgggacagctggaatgccggcatcatgacagtgatgtctgccctgtctgtggcccccagcaaggcccgggagtacagcaaggagggctgggagtatgtgaaggcccggaccaagtag

SEQ ID NO: 33214 - DNA, 594 bp, Artificial Sequence
  Description of Artificial Sequence: Synthetic coding sequence
atgctgcccctgctgcagctggtgcctgccaagctgctgaacagcagctgcagcctggagaagaccctgcagtgcagctgcagcttccacggcatccccacccccagcgtgcagtggtggatgggcggcgtgcctgtgggcgtggatggcatggatggcagcctgcaggtgaccagcaccatgctgggcccctgggccaacagcaccatcagcctgacagaggagcctgagatgggcatgaggctgctgtgtgagggcaagaaccagaatggcacccacgccctgagcatcctgctgatgagcaggaagagcagcctggccgcccaggcctttgtgaagggcctcatccagggcgccatctatgccggcatcgtcatcgccctgctcttcctgtgcctgctgcccctgattgtgaagcacatcaggaagaagcaggccaagaaggccgccgccatccgggccaagaagagcagcaaggtgcgggccagccaggagctggagatgagcctgaagccagaggagcccgggaagcctgtggtggccaccttcagcgagagccgcatcctggagaagcaggacaagagggccagctag

SEQ ID NO: 33215 - DNA, 513 bp, Artificial Sequence
  Description of Artificial Sequence: Synthetic coding sequence
atgagaagaaggctgtggctgggcctggcctggctgctgctggcccgggccccagatgctgctggcaccccatctgccagccggggccccaggagctacccccacctggagggagatgtgcgctggaggaggctcttcagcagcacccacttcttcctgcgggtggaccccggcggccgggtgcagggcacccgctggaggcatggccaggacagcatcctggagatccgctctgtgcacgtgggcgtggtggtgatcaaggctgtgagcagcggcttctacgtggccatgaacagaagaggccgcctgtatggcagccggctgtacacagtggactgccgcttccgggagagaattgaagaaaatggccacaacacctacgccagccagcgctggaggcggcggggccagcccatgttcctggccctggacagaagaggaggccccaggcctgggggccgcacccggcgctaccacctgagcgcccacttcctgcctgtgctggtgtcctag

SEQ ID NO: 33216 - DNA, 1116 bp, Artificial Sequence
  Description of Artificial Sequence: Synthetic coding sequence
atggcctggaccaagtaccagctgttcctggccggcctgatgctggtgacaggcagcatcaacaccctgagcgccaagtgggccgacaacttcatggccgagggctgcggcggcagcaaggagcacagcttccagcaccccttcctgcaggccgtgggcatgttcctgggggagttcagctgcctggccgccttctacctgctgcgctgcagagctgctggccagagcgacagctctgtggacccccagcagcccttcaaccccctgctcttcctgcccccagccctgtgtgacatgacaggcaccagcctgatgtatgtggccctgaacatgaccagcgccagcagcttccagatgctgcggggagctgtgatcatcttcaccggcctcttctctgtggccttcctgggccggcggctggtgctgagccagtggctgggcatcctggccaccatcgccggcctggtggtggtgggcctggccgacctgctgagcaagcatgacagccagcacaagctgtctgaggtgatcaccggggacctgctgatcatcatggcccagatcatcgtggccatccagatggtgctggaggagaagtttgtgtacaagcacaacgtgcaccccctgcgggctgtgggcacagagggcctgtttggcttcgtcatcctgagcctgctgctggtgcccatgtactacatcccagctggcagcttcagcggcaacccccggggcaccctggaggatgccctggatgccttctgccaggtgggccagcagcccctgattgctgtggccctgctgggcaacatcagcagcatcgccttcttcaactttgctggcatctctgtgaccaaggagctgagcgccaccaccaggatggtgctggacagcctgaggacagtggtgatctgggccctgagcctggccctgggctgggaggccttccacgccctgcagatcctgggcttcctgatcctgctgattggaacagccctgtacaacggcctgcaccggcccctgctgggccgcctgagccggggccggcccctggccgaggagagcgagcaggagcggctgctgggcggcaccaggacccccatcaatgatgccagctag

SEQ ID NO: 33217 - DNA, 867 bp, Artificial Sequence
  Description of Artificial Sequence: Synthetic coding sequence
atgggcggccagttccacggccggggcctgtggagggagcagggcgcccagctgcctgccagcctgcccccagccctgaacatgaccagcgccagcagcttccagatgctgcggggggccgtcatcatcttcaccggcctcttctctgtggccttcctgggccgccgcctggtgctgagccagtggctgggcatcctggccaccatcgccggcctggtggtggtgggcctggccgacctgctgagcaagcatgacagccagcacaagctgtctgaggtgatcactggagacctgctgatcatcatggcccagatcatcgtggccatccagatggtgctggaggagaagtttgtgtacaagcacaacgtgcaccccctgcgggctgtgggcacagagggcctgtttggatttgtgatcctgagcctgctgctggtgcccatgtactacatcccagctggcagcttcagcggcaacccccggggcaccctggaggatgccctggatgccttctgccaggtgggccagcagcccctgattgctgtggccctgctgggcaacatcagcagcatcgccttcttcaactttgctggcatctctgtgaccaaggagctgagcgccaccaccaggatggtgctggacagcctgaggacagtggtgatctgggccctgagcctggccctgggctgggaggccttccacgccctgcagatcctgggcttcctgatcctgctgattggaacagccctgtacaacggcctgcaccggcccctgctgggccgcctgagccggggccggcccctggccgaggagagcgagcaggagcggctgctgggcggcaccaggacccccatcaatgatgccagctag

SEQ ID NO: 33218 - DNA, 855 bp, Artificial Sequence
  Description of Artificial Sequence: Synthetic coding sequence
atgaagaccagcgctgagctgcacgagcaggagaagccacccagcagcccccgggccaccggccctggccgcctgggccacgcccggggccggggcccagatgccctgcggggcggcgctgctggccctggccgggccagcagcggggccccccgggagaggaagatggcccctcatgaccccggcagcctgaccaccctggtgccctgggccgccgccctgctgctggccctgggcgtggagcgggccctggccctgcctgagatctgcacccagtgccccggctctgtgcagaacctgagcaaggtggccttctactgcaagaccacccgggagctgatgctgcacgcccgctgctgcctgaaccagaagggcaccatcctgggcctggacctgcagaactgcagcctggaggaccccggccccaacttccaccaggcccacaccaccgtcatcatcgacctgcaggccaaccccctgaagggggacctggccaacaccttccggggcttcacccagctgcagaccctcatcctgccccagcacgtgaactgccctgggggcatcaatgcctggaacaccatcaccagctacatcgacaaccagatctgccagggccagaagaacctgtgcaacaacacaggagaccctgagatgtgcccagaaaatggcagctgtgtgcctgatggccctggcctgctgcagtgtgtgtgtgctgatggcttccacggctacaagtgcatgaggcagggcagcttcagcctgctgatgttcttcggcatcctgggcgccaccaccctgtctgtgtccatcctgctgtgggccacccagaggaggaaggccaagaccagctag

SEQ ID NO: 33219 - DNA, 516 bp, Artificial Sequence
  Description of Artificial Sequence: Synthetic coding sequence
atgctgcacgcccgctgctgcctgaaccagaagggcaccatcctgggcctggacctgcagaactgcagcctggaggaccccggccccaacttccaccaggcccacaccaccgtcatcatcgacctgcaggccaaccccctgaagggggacctggccaacaccttccggggcttcacccagctgcagaccctcatcctgccccagcacgtgaactgccctgggggcatcaatgcctggaacaccatcaccagctacatcgacaaccagatctgccagggccagaagaacctgtgcaacaacacaggagaccctgagatgtgcccagaaaatggcagctgtgtgcctgatggccctggcctgctgcagtgtgtgtgtgctgatggcttccacggctacaagtgcatgaggcagggcagcttcagcctgctgatgttcttcggcatcctgggcgccaccaccctgtctgtgtccatcctgctgtgggccacccagaggaggaaggccaagaccagctag

SEQ ID NO: 33220 - DNA, 228 bp, Artificial Sequence
  Description of Artificial Sequence: Synthetic coding sequence
atgctgcacgcccgctgctgcctgaaccagaagggcaccatcctgggcctggacctgcagaactgcagcctggaggaccccggccccaacttccaccaggcccacaccaccgtcatcatcgacctgcaggccaaccccctgaagggggacctggccaacaccttccggggcttcacccagctgcagaccctcatcctgccccagcacgtgaactgccctgggggctag

SEQ ID NO: 33221 - DNA, 876 bp, Artificial Sequence
  Description of Artificial Sequence: Synthetic coding sequence
atggccctggccgcccggctgctgccccagttcctgcacagccgcagcctgccctgtggggctgtgcggctgcggaccccagctgtggccgaggtgcggctgcccagcgccaccctgtgctacttctgccgctgccgcctgggcctgggcgccgccctcttccccaggtctgcccgggccctggccgccagcgccctgcctgcccagggcagccgctggcctgtgctgagcagccctggcctgcctgctgcctttgccagcttccctgcctgcccccagaggagctacagcacagaggagaagccccagcagcaccagaagaccaagatgattgtgctgggcttcagcaaccccatcaactgggtgaggacccgcatcaaggccttcctgatctgggcctactttgacaaggagttcagcatcacagagttcagcgagggcgccaagcaggcctttgcccacgtgtccaagctgctgagccagtgcaagtttgacctgctggaggagctggtggccaaggaggtgctgcacgccctgaaggagaaggtgaccagcctgcctgacaaccacaagaatgccctggccgccaacattgatgaaattgtgttcaccagcactggagacatcagcatctactatgatgagaagggcaggaagtttgtgaacatcctgatgtgcttctggtacctgaccagcgccaacatccccagcgagaccctgcggggggccagcgtcttccaggtgaagctgggcaaccagaatgtggagaccaagcagctgctgagcgccagctatgagttccagcgggagttcacccagggcgtgaagccagactggaccatcgcccgcatcgagcacagcaagctgctggagtag

SEQ ID NO: 33222 - DNA, 876 bp, Artificial Sequence; identical to SEQ ID NO: 33221
  Description of Artificial Sequence: Synthetic coding sequence

SEQ ID NO: 33223 - DNA, 1326 bp, Artificial Sequence
  Description of Artificial Sequence: Synthetic coding sequence
atgtctgtgctgctgcggagcggcctgggccccctgtgtgctgtggcccgggccgccatccccttcatctggaggggcaagtacttcagcagtggaaatgaaccagcagaaaatcctgtgacccccatgctgcggcacctgatgtacaagatcaagagcacaggccccatcaccgtggccgagtacatgaaggaggtgctgaccaacccagccaagggctactacgtgtacagagacatgctgggggagaagggggacttcatcaccagccctgagatcagccagatctttggagagctgctgggcatctggttcatcagcgagtggatggccaccgggaagagcacagccttccagctggtggagctgggccctggccggggcaccctggtgggggacatcctgcgggtcttcacccagctgggctctgtgctgaagaactgtgacatctctgtgcacctggtggaggtgtcccagaagctgtctgagatccaggccctgaccctgaccaaggagaaggtgcccctggagagaaatgccggcagccctgtgtacatgaagggcgtgaccaagagcggcatccccatctcctggtacagagacctgcatgatgtgcccaagggctacagcttctacctggcccacgagttctttgatgtgctgcctgtgcacaagttccagaagaccccccagggctggagggaggtgtttgtggacatcgacccccaggtgtctgacaagctgcgctttgtgctggcccccagcgccaccccagctgaggccttcatccagcatgatgagacccgggaccacgtggaggtgtgcccagatgctggggtcatcatcgaggagctgagccagagaattgccctgaccggcggggccgccctggtggccgactatggccatgatggcaccaagacagacaccttccggggcttctgtgaccacaagctgcatgatgtgctgattgcccctggaacagctgacctgacagcagatgtggacttctcctacctgcggaggatggcccagggcaaggtggccagcctgggccccatcaagcagcacaccttcctgaagaacatgggcattgatgtgcggctgaaggtgctgctggacaagagcaatgagcccagcgtgcggcagcagctgctgcagggctatgacatgctgatgaaccccaagaagatgggagagcgcttcaacttctttgccctgctgccccaccagaggctgcagggcggccgctaccagagaaatgcccggcagagcaagccctttgcctctgtggtggccggcttcagcgagctggcctggcagtag

SEQ ID NO: 33224 - DNA, 1593 bp, Artificial Sequence
  Description of Artificial Sequence: Synthetic coding sequence
atgcaccctggccgcaccaccgggaagggccccagcacccacacccagattgaccagcagcccccccggctgctgattgtgcacatcgccctgcccagctgggccgacatctgcaccaacctgtgtgaggccctgcagaacttcttcagcctggcctgcagcctgatgggccccagcaggatgagcctcttcagcctgtacatggtgcaggaccagcacgagtgcatcctgccctttgtgcaggtgaagggcaactttgcccggctgcagacctgcatcagcgagctgaggatgctgcagcgggagggctgcttccgcagccagggcgccagcctgcggctggccgtggaggatggcctgcagcagttcaagcagtacagcagacatgtgaccacccgggccgccctgacctacaccagcctggagatcaccatcctgaccagccagcccgggaaggaggtggtgaagcagctggaggagggcctgaaggacacagacctggcccgggtgcggcgcttccaggtggtggaggtgaccaagggcatcctggagcacgtggacagcgccagccctgtggaggacaccagcaatgatgagagcagcatcctgggcacagacatcgacctgcagaccatcgacaatgacatcgtgtccatggagatcttcttcaaggcctggctgcacaacagcggcacagaccaggagcagatccacctgctgctgagcagccagtgcttcagcaacatcagccggccccgggacaaccccatgtgcctgaagtgtgacctgcaggagcggctgctgtgccccagcctgctggccggcacagcagatggcagcctgaggatggatgaccccaagggggacttcatcaccctgtaccagatggccagccagagcagcgccagccactacaagctgcaggtgatcaaggccctgaagagcagcggcctgtgtgagagcctgacctacggcctgcccttcatcctgcggcccaccagctgctggcagctggactgggatgagctggagaccaaccagcagcacttccacgccctgtgccacagcctgctgaagcgggagtggctgctgctggccaagggggagcccccaggccctggccacagccagaggatcccagccagcaccttctacgtgatcatgcccagccacagcctgaccctgctggtgaaggctgtggccacccgggagctgatgctgcccagcaccttccccctgctgcctgaggacccccatgatgacagcctgaagaatgtggagagcatgctggacagcctggagctggagcccacctacaaccccctgcacgtgcagagccacctgtacagccacctgagcagcatctatgccaagccccagggccgcctgcacccccactgggagagccgggcccccaggaagcacccctgcaagacaggccagctgcagaccaacagagcccgggccaccgtggcccccctgcccatgacccctgtgcccggccgggccagcaagatgcctgctgccagcaagagcagcagtgatgccttcttcctgcccagcgagtgggagaaggaccccagccggccctag

SEQ ID NO: 33225 - DNA, 540 bp, Artificial Sequence
  Description of Artificial Sequence: Synthetic coding sequence
atggatgaccccaagggggacttcatcaccctgtaccagatggccagccagagcagcgccagccactacaagctgcaggtgatcaaggccctgaagagcagcggcctgtgtgagagcctgacctacggcctgcccttcatcctgcggcccaccagctgctggcagctggactgggatgagctggagaccaaccagcagcacttccacgccctgtgccacagcctgctgtccatgctggacagcctggagctggagcccacctacaaccccctgcacgtgcagagccacctgtacagccacctgagcagcatctatgccaagccccagggccgcctgcacccccactgggagagccgggcccccaggaagcacccctgcaagacaggccagctgcagaccaacagagcccgggccaccgtggcccccctgcccatgacccctgtgcccggccgggccagcaagatgcctgctgccagcaagagcagcagtgatgccttcttcctgcccagcgagtgggagaaggaccccagccggccctag

SEQ ID NO: 33226 - DNA, 429 bp, Artificial Sequence
  Description of Artificial Sequence: Synthetic coding sequence
atgcaccctggccgcaccaccgggaagggccccagcacccacacccagattgaccagcagcccccccggctgctgattgtgcacatcgccctgcccagctgggccgacatctgcaccaacctgtgtgaggccctgcagaacttcttcagcctggcctgcagcctgatgggccccagcaggatgagcctcttcagcctgtacatggtgcaggaccagcacgagtgcatcctgccctttgtgcaggtgaagggcaactttgcccggctgcagacctgcatcagcgagctgaggatgctgcagcgggagggctgcttccgcagccagggcgccagcctgcggctggccgtggaggatggcctgcagcagttcaagcagtacagcagacatgtgaccacccgggccgccctgacctacaccagcctggagtag

SEQ ID NO: 33227 - DNA, 1581 bp, Artificial Sequence
  Description of Artificial Sequence: Synthetic coding sequence
atgcaccctggccgcaccaccgggaagggccccagcacccacacccagattgaccagcagcccccccggctgctgattgtgcacatcgccctgcccagctgggccgacatctgcaccaacctgtgtgaggccctgcagaacttcttcagcctggcctgcagcctgatgggccccagcaggatgagcctcttcagcctgtacatggtgcaggaccagcacgagtgcatcctgccctttgtgcaggtgaagggcaactttgcccggctgcagacctgcatcagcgagctgaggatgctgcagcgggagggctgcttccgcagccagggcgccagcctgcggctggccgtggaggatggcctgcagcagttcaagcagtacagcagacatgtgaccacccgggccgccctgacctacaccagcctggagatcaccatcctgaccagccagcccgggaaggaggtggtgaagcagctggaggagggcctgaaggacacagacctggcccgggtgcggcgcttccaggtggtggaggtgaccaagggcatcctggagcacgtggacagcgccagccctgtggaggacaccagcaatgatgagagcagcatcctgggcacagacatcgacctgcagaccatcgacaatgacatcgtgtccatggagatcttcttcaaggcctggctgcacaacagcggcacagaccaggagcagatccacctgctgctgagcagccagtgcttcagcaacatcagccggccccgggacaaccccatgtgcctgaagtgtgacctgcaggagcggctgctgtgccccagcctgctggccggcacagcagatggcagcctgaggatggatgaccccaagggggacttcatcaccctgtaccagatggccagccagagcagcgccagccactacaagctgcaggtgatcaaggccctgaagagcagcggcctgtgtgagagcctgacctacggcctgcccttcatcctgcggcccaccagctgctggcagctggactgggatgagctggagaccaaccagcagcacttccacgccctgtgccacagcctgctgaagcgggagtggctgctgctggccaagggggagcccccaggccctggccacagccagaggatcccagccagcaccttctacgtgatcatgcccagccacagcctgaccctgctggtgaaggctgtggccacccgggagctgatgctgcccagcaccttccccctgctgcctgaggacccccatgatgacagcctgaagaatgtggagagcatgctggacagcctggagctggagcccacctacaaccccctgcacgtgcagagccacctgtacagccacctgagcagcatctatgccaagccccagggccgcctgcacccccactgggagagccgggcccccaggaagacaggccagctgcagaccaacagagcccgggccaccgtggcccccctgcccatgacccctgtgcccggccgggccagcaagatgcctgctgccagcaagagcagcagtgatgccttcttcctgcccagcgagtgggagaaggaccccagccggccctag

SEQ ID NO: 33228 - DNA, 864 bp, Artificial Sequence
  Description of Artificial Sequence: Synthetic coding sequence
atggaggagaaggaggacaagcaccagcagcacaagattgaagatgctgccatcacctacgtgtctgaaaatgaggagatcaagcatgaggagaagccaggcaagagcatccaccacagcaagagccacgtgggccggggccgcatctactatgccaagttcatcaacaccaatgcccggacctacaatgagcccttcccctacatcgaccccaagaagggccctgagatccagggcgactggtggagccacggcaaggccctggagcccgtcttcctgcccccctatgacagcaagagcacccagaggagtgacttccagaagcccagctgccccctggtgctgcctgtgaagcacagcaagatgcagaagcccagctgtggcatcgtgcccctggccagccctggcaccagcgctgagctgcagaacaacttcatcgagtacatctccttcatccaccagtatgatgccaggaagaccccaaatgagcccctgcagggcaagagacatggagcctttgtgcagcgggagatcaagccaggcagccggcccaccgtgcccaagggagctgaggtgctgctgaacaccccaggcagccgcagcagcgagcagagcaagaagacagagaagggcaacagcgctgagagcaggatgatcagccctggcctgtgccagcagaacagccaggagctgctggagcccaagacccacctgtctgaaacagatgtgcggcaggccgccaaggcctgccccagcaccccagagagccgggagaagaccagcggggccacccagaccaccgtgggagatgccctcttcaccaggcacaagcccctgaacccccccatcaagaagtctgagtag

SEQ ID NO: 33229 - DNA, 366 bp, Artificial Sequence
  Description of Artificial Sequence: Synthetic coding sequence
atggccagctgcctggccctgaggatggccctgctgctggtgtctggagtgctggccccagctgtgctgacagatgatgtgccccaggagcctgtgcccaccctgtggaatgaacctgctgagctgcccagcggggagggccctgtggagagcaccagccctggccgggagcctgtggacaccggccccccagcccccaccgtggcccctggccctgaggacagcacagcccaggagcggctggaccagggcggcggcagcctgggccctggggccatcgccgccatcgtgattgctgccctgctggccacctgtgtggtgctggccctggtggtggtggccctgaggaagttcagcgccagctag

SEQ ID NO: 33230 - DNA, 366 bp, Artificial Sequence; identical to SEQ ID NO: 33229
  Description of Artificial Sequence: Synthetic coding sequence

SEQ ID NO: 33231 - DNA, 366 bp, Artificial Sequence; identical to SEQ ID NO: 33229
  Description of Artificial Sequence: Synthetic coding sequence

SEQ ID NO: 33232 - DNA, 1371 bp, Artificial Sequence
  Description of Artificial Sequence: Synthetic coding sequence
atgagcccctggagctggttcctgctgcagaccctgtgcctgctgcccactggagctgccagccggcggggggcccctggaacagccaactgtgagctgaagccccagcagagcgagctgaacagcttcctgtggaccatcaagagggaccccccatcctacttcttcggcaccatccacgtgccctacaccagggtgtgggacttcatcccagacaacagcaaggaggccttcctgcagagcagcatcgtgtactttgagctggacctgacagacccctacaccatcagcgccctgaccagctgccagatgctgccccagggcgagaacctgcaggatgtgctgccccgggacatctactgccgcctgaagaggcacctggagtatgtgaagctgatgatgcccctgtggatgaccccagaccagaggggcaagggcctgtatgctgactacctgttcaatgccatcgccggcaactgggagaggaagaggcctgtgtgggtgatgctgatggtgaacagcctgacagaggtggacatcaagagccggggcgtgcctgtgctggacctcttcctggcccaggaggccgagcggctgaggaagcagacaggagctgtggagaaggtggaggagcagtgccaccccctgaatggcctgaacttcagccaggtgcccaacttcatcaatgccaccctgcccccccaggagcgcatcacagcccaggagattgacagctacctgcggcgggagctgatctacaagagaaatgaaagaattggcaagagggtgaaggccctgctggaggagttcccagacaagggcttcttctttgcctttggagctggccacttcatgggcaacaacacagtgctggatgtgctgcggcgggagggctatgaggtggagcacgccccagctggccggcccatccacaagggcaagagcaagaagaccagcacccggcccaccctgagcaccatctttgcccccaaggtgcccaccctggaggtgcctgcccctgaggccgtgagcagcggccacagcaccctgccccccctggtgtccaggcctggcagcgctgacacccccagcgaggccgagcagcgcttcaggaagaagagaagaagaagccagaggcggccccggctgcggcagttcagtgacctgtgggtgcggctggaggagagtgacatcgtgccccagctgcaggtgcctgtgctggacagacacatcagcacagagctgcggctgccccggcggggccacagccaccacagccagatggtggccagcagcgcctgcctgagcctgtggacccctgtgttctgggtgctggtgctggccttccagacagagacccccctgctgtag

SEQ ID NO: 33233 - DNA, 1518 bp, Artificial Sequence
  Description of Artificial Sequence: Synthetic coding sequence
atgagcccctggagctggttcctgctgcagaccctgtgcctgctgcccactggagctgccagccggcggggggcccctggaacagccaactgtgagctgaagccccagcagagcgagctgaacagcttcctgtggaccatcaagagggaccccccatcctacttcttcggcaccatccacgtgccctacaccagggtgtgggacttcatcccagacaacagcaaggaggccttcctgcagagcagcatcgtgtactttgagctggacctgacagacccctacaccatcagcgccctgaccagctgccagatgctgccccagggcgagaacctgcaggatgtgctgccccgggacatctactgccgcctgaagaggcacctggagtatgtgaagctgatgatgcccctgtggatgaccccagaccagaggggcaagggcctgtatgctgactacctgttcaatgccatcgccggcaactgggagaggaagaggcctgtgtgggtgatgctgatggtgaacagcctgacagaggtggacatcaagagccggggcgtgcctgtgctggacctcttcctggcccaggaggccgagcggctgaggaagcagacaggagctgtggagaaggtggaggagcagtgccaccccctgaatggcctgaacttcagccaggtgatctttgccctgaaccagaccctgctgcagcaggagagcctgcgggccggcagcctgcagatcccctacaccacagaggacctgatcaagcactacaactgtggggacctgagcagcgtcatcctgagccatgacagcagccaggtgcccaacttcatcaatgccaccctgcccccccaggagcgcatcacagcccaggagattgacagctacctgcggcgggagctgatctacaagagaaatgaaagaattggcaagagggtgaaggccctgctggaggagttcccagacaagggcttcttctttgccttcggggccggccacttcatgggcaacaacacagtgctggatgtgctgcggcgggagggctatgaggtggagcacgccccagctggccggcccatccacaagggcaagagcaagaagaccagcacccggcccaccctgagcaccatctttgcccccaaggtgcccaccctggaggtgcctgcccctgaggccgtgagcagcggccacagcaccctgccccccctggtgtcccggcccggcagcgctgacaccccatctgaggccgagcagcgcttcaggaagaagagaagaagaagccagaggcggccccggctgcggcagttcagtgacctgtgggtgcggctggaggagagtgacatcgtgccccagctgcaggtgcctgtgctggacagacacatcagcacagagctgcggctgccccggcggggccacagccaccacagccagatggtggccagcagcgcctgcctgagcctgtggacccctgtgttctgggtgctggtgctggccttccagacagagacccccctgctgtag

SEQ ID NO: 33234 - DNA, 1878 bp, Artificial Sequence
  Description of Artificial Sequence: Synthetic coding sequence
atgtgtgagaccagcgccttctacgtgcctggggtggcccccatcaacttccaccagaatgaccctgtggagatcaaggctgtgaagctgaccagcagcaggacccagctgccctatgagtactacagcctgcccttctgccagcccagcaagatcacctacaaggccgagaacctgggggaggtgctgcggggggaccgcatcgtgaacacccccttccaggtgctgatgaacagcgagaagaagtgtgaggtgctgtgcagccagagcaacaagcctgtgaccctgactgtggagcagagccggctggtggccgagcgcatcacagaggactactacgtgcacctgattgctgacaacctgcctgtggccacccggctggagctgtacagcaacagagacagtgatgacaagaagaaggagaaggatgtgcagtttgagcacggctaccgcctgggcttcacagatgtgaacaagatctacctgcacaaccacctgtccttcatcctgtactaccaccgggaggacatggaggaggaccaggagcacacctacagagtggtgcgctttgaggtgatcccccagagcatccggctggaggacctgaaggcagatgagaagagcagctgcaccctgcctgagggcaccaacagcagcccccaggagattgaccccaccaaggagaaccagctgtacttcacctacagcgtgcactgggaggagagtgacatcaagtgggccagccgctgggacacctacctgaccatgtctgatgtgcagatccactggttcagcatcatcaacagcgtggtggtggtgttcttcctgagcggcatcctgtccatgatcatcatccgcaccctgaggaaggacatcgccaactacaacaaggaggatgacatcgaggacaccatggaggagagcggctggaagctggtgcatggagatgtgttccggcccccccagtaccccatgatcctgagcagcctgctgggcagcggcatccagctgttctgcatgatcctgattgtcatctttgtggccatgctgggcatgctgagccccagcagcagaggagccctgatgaccacagcctgcttcctgttcatgttcatgggcgtgtttggaggcttctctgctggccgcctgtaccgcaccctgaagggccaccgctggaagaagggggccttctgcacagccaccctgtacccaggagtggtgtttggcatctgctttgtgctgaactgcttcatctggggcaagcacagcagcggggctgtgcccttccccaccatggtggccctgctgtgcatgtggtttggcatcagcctgcccctggtgtacctgggctactacttcggcttcaggaagcagccctatgacaaccctgtgaggaccaaccagatcccccggcagatccctgagcagcgctggtacatgaacagatttgtgggcatcctgatggccggcatcctgccctttggagccatgtttattgagctgttcttcatcttcagcgccatctgggagaaccagttctactacctgtttggcttcctgttcctggtgttcatcatcctggtggtgtcctgcagccagatcagcatcgtgatggtgtacttccagctgtgtgccgaggactaccgctggtggtggaggaacttcctggtgtctgggggcagcgccttctacgtgctggtgtatgccatcttctactttgtgaacaagctggacatcgtggagttcatccccagcctgctgtacttcggctacacagccctgatggtgctgtccttctggctgctgaccggcaccatcggcttctacgccgcctacatgtttgtgaggaagatctatgctgctgtgaagattgattag

SEQ ID NO: 33235 - DNA, 1701 bp, Artificial Sequence
  Description of Artificial Sequence: Synthetic coding sequence
atgcctggccaccctggagctgctgagcagctggtgaagacaggctggaggtcctggcacctgggcttctggaaggccctggcccccctgcaggccgcctgggatgccttcagccagcctgtgcctgccagctgtggccagctgctgacccagctgctgctgtgtgccagcctggccgctgctgctgctggcctggtgtaccactggctggccagcctgctgctgtacccacctggccccagcgccatggtggccaccgtgtgtggcctgctggtgttcctgagcctgggcctggtgccccctgtgcgctgcctgtttgccctgtctgtgcccaccctgggcatggagcagggccgccgcctgctgctgagctacagcacagccaccctggccatcgctgtggtgcccaacgtgctggccaacgtgggcgctgctggccaggtgctgcgctgtgtgacagagggcagcctggagagcctgctgaacaccacccaccagctgcatgctgccagccgggccctgggccccaccggccaggccggcagccggggcctgacctttgaggcccaggacaatggcagcgccttctacctgcacatgctgcgggtgacccagcaggtgctggaggacttcagcggcctggagagcctggcccgggctgctgccctgggcacccagagggtggtgacaggcctcttcatgctgggcctgctggtggagagcgcctggtacctgcactgctacctgacagacctgcgctttgacaacatctatgccacccagcagctgacccagaggctggcccaggcccaggccacccacctgctggcccccccacccacctggctgctgcaggccgcccagctgcggctgagccaggaggagctgctgagctgcctgctgcggctgggcctgctggccctgctgctggtggccacagctgtggccgtggccacagaccacgtggccttcctgctggcccaggccaccgtggactgggcccagaagctgcccaccgtgcccatcaccctgactgtgaagtatgatgtggcctacacagtgctgggcttcatccccttcctgttcaaccagctggcccctgagagccccttcctgtctgtgcacagcagctaccagtgggagctgcggctgaccagcgcccgctgccccctgctgcctgcccggcggcccagggctgctgcccccctggccgccggggccctgcagctgctggccggcagcacagtgctgctggaggcctatgcccggcggctgcggcatgccatcgccgccagcttcttcaccgcccaggaggcccggcgggtgcgccacctgcacgcccggctgcagaggagacatgacagacaccagggccagcagctgcccctgggggaccccagctgtgtgcccacccccaggcctgcctgcaagcccccagcctggattgactaccgcctggatgccctgaggacagagagcagcgagggggagggcaaggagctgtggagctgccgggacctgagctgcaacctgggccctgtgcccccaccctgtgtgaccctgggcaagagcctgcacctgtctgagccccgcttcctgcacctgcacaatgacagcatcttcaccattgatgtgacctacttccccaggagagatgtggtgaggatggagggcaacacaggccatgacaggcctggatag

SEQ ID NO: 33236 - DNA, 432 bp, Artificial Sequence
  Description of Artificial Sequence: Synthetic coding sequence
atgtctgggggccgcaggaaggaggagcccccccagccccagctggccaatggagccctgaaggtgtctgtgtggagcaaggtgctgcggagtgatgctgcctgggaggacaaggatgagttcctggatgtgatctactggttccggcagatcatcgctgtggtgctgggcgtcatctggggcgtgctgcccctgcggggcttcctgggcattgctggcagctttggcagcagcttcaccctgcccagcatcatgacagatggagtgcagctgcccagcgccccctaccctgtgcagaggaccctgctgatcacagcccaggagctggaccgctggggcaccccagccccctggaacctggaggacccctgcttcctggaccgggagagcgtgtgctgggcctctgtgttcagcgcccgggtggtgacctag

SEQ ID NO: 33237 - DNA, 390 bp, Artificial Sequence
  Description of Artificial Sequence: Synthetic coding sequence
atgtctgggggccgcaggaaggaggagcccccccagccccagctggccaatggagccctgaaggtgtctgtgtggagcaaggtgctgcggagtgatgctgcctgggaggacaaggatgagttcctggatgtgatctactggttccggcagatcatcgctgtggtgctgggcgtcatctggggcgtgctgcccctgcggggcttcctgggcattgctggcttctgcctgatcaatgccggcgtgctgtacctgtacttcagcaactacctgcagattgatgaggaggagtatggaggcacctgggagctgaccaaggagggcttcatgaccagctttgccctcttcatggtgatctggatcatcttctacacagccatccactatgactag

SEQ ID NO: 33238 - DNA, 414 bp, Artificial Sequence
  Description of Artificial Sequence: Synthetic coding sequence
atgtctgggggccgcaggaaggaggagcccccccagccccagctggccaatggagccctgaaggtgtctgtgtggagcaaggtgctgcggagtgatgctgcctgggaggacaaggatgagttcctggatgtgatctactggttccggcagatcatcgctgtggtgctgggcgtcatctggggcgtgctgcccctgcggggcttcctgggcattgctggcttctgcctgatcaatgccggcgtgctgtacctgtacttcagcaactacctgcagattgatgaggaggagtatggaggcacctgggagctgaccaaggagggcttcatgaccagctttgccctcttcatggtgtgtgtggccgacagcttcaccaccggccacctggaccacctgctgcactgccaccccctgtag

SEQ ID NO: 33239 - DNA, 960 bp, Artificial Sequence
  Description of Artificial Sequence: Synthetic coding sequence
atgagcagcccccaggccccagaagatggccagggctgtggggacagaggagaccccccaggggacctgcggtctgtgctggtgaccaccgtgctgaacctggagcccctggatgaagatctcttccggggccgccactactgggtgcctgccaagaggctgtttggaggccagatcgtgggccaggccctggtggccgccgccaagtctgtgtctgaagatgtgcacgtgcacagcctgcactgctactttgtgcgggccggggaccccaagctgcctgtgctgtaccaggtggagaggaccaggacaggcagcagcttctctgtgcgctctgtgaaggctgtgcagcacggcaagcccatcttcatctgccaggccagcttccagcaggcccagcccagccccatgcagcaccagttctccatgcccaccgtgcccccacctgaggagctgctggactgtgagaccctgattgaccagtacctgcgggaccccaacctgcagaagcgctaccccctggccctgaacagaattgctgcccaggaggtgcccatcgagatcaagcctgtgaaccccagccccctgagccagctgcagaggatggagcccaagcagatgttctgggtgcgggcccggggctacatcggggagggggacatgaagatgcactgctgcgtggccgcctacatcagtgactatgccttcctgggcacagccctgctgccccaccagtggcagcacaaggtgcacttcatggtgtccctggaccacagcatgtggttccacgcccccttccgggctgaccactggatgctgtatgaatgtgagagcccctgggccggcggcagccggggcctggtgcacggccgcctgtggaggcaggatggagtgctggccgtgacctgtgcccaggagggcgtcatccgggtgaagccccaggtgtctgagagcaagctgtag

SEQ ID NO: 33240 - DNA, 870 bp, Artificial Sequence
  Description of Artificial Sequence: Synthetic coding sequence
atgtctgaggctgatggcctgcggcagaggcggcccctgcggccccaggtggtgacagatgatgatggccaggcccctgaggccaaggatggcagcagcttcagcggccgggtcttccgggtgaccttcctgatgctggccgtgtccctgactgtgcccctgctgggcgccatgatgctgctggagagccccatcgacccccagcccctgtccttcaaggagccccccctgctgctgggcgtgctgcaccccaacaccaagctgcggcaggccgagcggctgtttgagaaccagctggtgggccctgagagcatcgcccacatcggagatgtgatgttcaccggcacagcagatggccgggtggtgaagctggagaatggagaaattgagaccatcgccaggtttggaagtggcccctgcaagaccagagatgatgagcctgtgtgtggccggcccctgggcatccgggccggccccaacggcaccctgtttgtggctgatgcctacaagggcctgtttgaggtgaacccctggaagcgggaggtgaagctgctgctgagcagcgagacccccatcgagggcaagaacatgagctttgtgaatgacctgactgtgacccaggacggcaggaagatctacttcacagacagcagcagcaagtggcagaggcgggactacctgctgctggtgatggagggcacagatgatggccgcctgctggagtatgacacagtgacccgggaggtgaaggtgctgctggaccagctgcgcttccccaacggggtgcagctgagccctgctgaggactttgtgctggtggccgagaccaccatggcccgcatccgcagcagcctggtgaagagaagatag

SEQ ID NO: 33241 - DNA, 1230 bp, Artificial Sequence
  Description of Artificial Sequence: Synthetic coding sequence
tgagtggtgacagatgatgatggccaggcccctgaggccaaggatggcagcagcttcagcggccgggtcttccgggtgaccttcctgatgctggccgtgtccctgactgtgcccctgctgggcgccatgatgctgctggagagccccatcgacccccagcccctgtccttcaaggagccccccctgctgctgggcgtgctgcaccccaacaccaagctgcggcaggccgagcggctgtttgagaaccagctggtgggccctgagagcatcgcccacatcggagatgtgatgttcaccggcacagcagatggccgggtggtgaagctggagaatggagaaattgagaccatcgcccgcttcggcagcggcccctgcaagaccagagatgatgagcctgtgtgtggccggcccctgggcatccgggccggccccaacggcaccctgtttgtggctgatgcctacaagggcctgtttgaggtgaacccctggaagcgggaggtgaagctgctgctgagcagcgagacccccatcgagggcaagaacatgagctttgtgaatgacctgactgtgacccaggacggcaggaagatctacttcacagacagcagcagcaagtggcagaggcgggactacctgctgctggtgatggagggcacagatgatggccgcctgctggagtatgacacagtgacccgggaggtgaaggtgctgctggaccagctgcgcttccccaatggagtgcagctgagccctgcagaagattttgtgctggtggccgagaccaccatggcccgcatcagaagagtgtatgtgtctggcctgatgaagggcggcgctgacctgtttgtggagaacatgcctggcttcccagacaacatccggcccagcagcagcggcggctactgggtgggcatgagcaccatccggcccaaccctggcttctccatgctggacttcctgtctgagcggccctggatcaagaggatgatcttcaagggcagctgtgccggctgtgacctgctcttcagccaggagaccgtgatgaagtttgtgccccgctacagcctggtgctggagctgagtgacagcggggccttcagaagaagcctgcatgaccctgatggcctggtggccacctacatcagcgaggtgcatgaacatgatggccacctgtacctgggcagcttccgcagccccttcctgtgccgcctgagcctgcaggccgtgtag

SEQ ID NO: 33242 - DNA, 363 bp, Artificial Sequence
  Description of Artificial Sequence: Synthetic coding sequence
atgatgcccagcaggaccaacctggccaccggcatccccagcagcaaggtgaagtacagccggctgagcagcacagatgatggctacatcgacctgcagttcaagaagaccccacccaagatcccctacaaggccatcgccctggccaccgtgctcttcctgattggagccttcctgatcatcatcggcagcctgctgctgagcggctacatcagcaaaggaggagctgacagagctgtgcctgtgctgatcatcggcatcctggtgttcctgcccggcttctaccacctgagaattgcctactatgccagcaagggctaccggggctacagctatgatgacatcccagactttgatgactag

SEQ ID NO: 33243 - DNA, 552 bp, Artificial Sequence
  Description of Artificial Sequence: Synthetic coding sequence
atgcagccctgggccctgcccaccgtgggggagctgtgggtgtgtggccggcctggggccgccctgcgctggagcctggtgctgagcccccggctggagcccagcggggtcatcagcgcccactgcaacctgcacctgctggccagcagtgacagcagcgccagcgccagccggctgtgccagagggtgatgatgcccagcaggaccaacctggccaccggcatccccagcagcaaggtgaagtacagccggctgagcagcacagatgatggctacatcgacctgcagttcaagaagaccccacccaagatcccctacaaggccatcgccctggccaccgtgctcttcctgattggagccttcctgatcatcatcggcagcctgctgctgagcggctacatcagcaagggcggcgctgacagagctgtgcctgtgctgatcatcggcatcctggtgttcctgcccggcttctaccacctgcgcatcgcctactatgccagcaagggctaccggggctacagctatgatgacatcccagactttgatgactag

SEQ ID NO: 33244 - DNA, 225 bp, Artificial Sequence
  Description of Artificial Sequence: Synthetic coding sequence
atgatgcccagcaggaccaacctggccaccggcatccccagcagcaaggtgaagtacagccggctgagcagcacagatgatggctacatcgacctgcagttcaagaagaccccacccaagatcccctacaaggccatcgccctggccaccgtgctcttcctgattggagccttcctgatcatcatcggcagcctgctgctgagcggctacatcagcaaaggatag

SEQ ID NO: 33245 - DNA, 363 bp, Artificial Sequence; identical to SEQ ID NO: 33242
  Description of Artificial Sequence: Synthetic coding sequence

SEQ ID NO: 33246 - DNA, 363 bp, Artificial Sequence; identical to SEQ ID NO: 33242
  Description of Artificial Sequence: Synthetic coding sequence

SEQ ID NO: 33247 - DNA, 363 bp, Artificial Sequence; identical to SEQ ID NO: 33242
  Description of Artificial Sequence: Synthetic coding sequence

SEQ ID NO: 33248 - DNA, 363 bp, Artificial Sequence; identical to SEQ ID NO: 33242
  Description of Artificial Sequence: Synthetic coding sequence

SEQ ID NO: 33249 - DNA, 363 bp, Artificial Sequence; identical to SEQ ID NO: 33242
  Description of Artificial Sequence: Synthetic coding sequence

SEQ ID NO: 33250 - DNA, 759 bp, Artificial Sequence
  Description of Artificial Sequence: Synthetic coding sequence
atgaagatgaagctgttccagaccatctgccggcagctgcggagcagcaagttctctgtggagagcgctgccctggtggccttcagcaccagcagctacagctgtggcaggaagaagaaggtgaacccctatgaggaggtggaccaggagaagtacagcaacctggtgcagagcgtgctgagcagccggggcgtggcccagaccccaggctctgtggaggaggatgccctgctgtgtggccctgtgtccaagcacaagctgcccaaccagggcgaggaccggcgggtgccccagaactggttccccatcttcaaccctgagaggagtgacaagcccaatgccagtgaccccagcgtgcccctgaagatccccctgcagagaaatgtcatccccagcgtgaccagggtgctgcagcagaccatgaccaagcagcaggtgttcctgctggagcgctggaagcagaggatgatcctggagctgggggaggatggcttcaaggagtacaccagcagctccatgtggctgaactgtggcggcctgcagcgctggatcacctgcccccccaccttccacggctgccgggccctcttccctgtgctggaccaggtggccagcagcacccggcgcatctacggcaaggagaaggagcctgagtacagcgagacccgcatcttcagaattggcagcaagctgctgtttggaaacatccagcacctgctgactgtgtgggagcacatcctgctcttcacccctgtgtag

SEQ ID NO: 33251 - DNA, 795 bp, Artificial Sequence
  Description of Artificial Sequence: Synthetic coding sequence
atgaagatgaagctgttccagaccatctgccggcagctgcggagcagcaagttctctgtggagagcgctgccctggtggccttcagcaccagcagctacagctgtggcaggaagaagaaggtgaacccctatgaggaggtggaccaggagaagtacagcaacctggtgcagagcgtgctgagcagccggggcgtggcccagaccccaggctctgtggaggaggatgccctgctgtgtggccctgtgtccaagcacaagctgcccaaccaggatgtgttcctgcagggcaagcgcttccacgaggccctggagagcatcctgagcccccaggagaccctgaaggagagagatgagaacctgctgaagagcggctacatcgagagcgtgcagcacatcctgaaggatgtgtctggagtgcgggccctggagagcgctgtgcagcacgagaccctgaactacatcggcctgctggactgtgtggccgagtaccagggcaagctgtgtgtgattgactggaagaccagcgagaagcccaagcccttcatccagagcacctttgacaaccccctgcaggtggtggcctacatgggcgccatgaaccacgacaccaactacagcttccaggtgcagtgtggcctcatcgtggtggcctacaaggatggcagccctgcccacccccacttcatggatgctgagctgtgcagccagtactggaccaagtggctgctgcggctggaggagtacacagagaagaagaagaaccagaacatccagaagccagagtacagcgagtag

SEQ ID NO: 33252 - DNA, 1035 bp, Artificial Sequence
  Description of Artificial Sequence: Synthetic coding sequence
atgaagatgaagctgttccagaccatctgccggcagctgcggagcagcaagttctctgtggagagcgctgccctggtggccttcagcaccagcagctacagctgtggcaggaagaagaaggtgaacccctatgaggaggtggaccaggagaagtacagcaacctggtgcagagcgtgctgagcagccggggcgtggcccagaccccaggctctgtggaggaggatgccctgctgtgtggccctgtgtccaagcacaagctgcccaaccagggcgaggaccggcgggtgccccagaactggttccccatcttcaaccctgagaggagtgacaagcccaatgccagtgaccccagcgtgcccctgaagatccccctgcagagaaatgtcatccccagcgtgaccagggtgctgcagcagaccatgaccaagcagcaggtgttcctgctggagcgctggaagcagaggatgatcctggagctgggggaggatggcttcaaggagtacaccagcaatgtgttcctgcagggcaagcgcttccacgaggccctggagagcatcctgagcccccaggagaccctgaaggagagagatgagaacctgctgaagagcggctacatcgagagcgtgcagcacatcctgaaggatgtgtctggagtgcgggccctggagagcgctgtgcagcacgagaccctgaactacatcggcctgctggactgtgtggccgagtaccagggcaagctgtgtgtgattgactggaagaccagcgagaagcccaagcccttcatccagagcacctttgacaaccccctgcaggtggtggcctacatgggcgccatgaaccacgacaccaactacagcttccaggtgcagtgtggcctcatcgtggtggcctacaaggatggcagccctgcccacccccacttcatggatgctgagctgtgcagccagtactggaccaagtggctgctgcggctggaggagtacacagagaagaagaagaaccagaacatccagaagccagagtacagcgagtag

SEQ ID NO: 33253 - DNA, 1326 bp, Artificial Sequence
  Description of Artificial Sequence: Synthetic coding sequence
atgctgctgcccggccgggcccggcagccccccaccccccagcctgtgcagcaccctggcctgcggcggcaggtggagcccccaggccagctgctgcggctcttctactgcaccgtgctggtgtgcagcaaggagatcagcgccctgacagacttcagcggctacctgaccaagctgctgcagaaccacaccacctacgcctgtgatggagactacctgaacctgcagtgccccaggcacagcaccatctctgtgcagagcgccttctacggccaggactaccagatgtgcagcagccagaagccagccagccagcgggaggacagcctgacctgtgtggccgccaccaccttccagaaggtgctggatgagtgccagaaccagagggcctgccacctgctggtgaacagccgggtgtttggaccagacctgtgccccggcagcagcaagtacctgctggtgtccttcaagtgccagcccaatgagctgaagaacaagacagtgtgtgaggaccaggagctgaagctgcactgccacgagagcaagttcctgaacatctacagcgccacctatggaagaaggacccaggagcgggacatctgcagcagcaaggccgagcggctgcccccatttgactgcctgagctacagcgccctgcaggtgctgagccgccgctgctacggcaagcagcgctgcaagatcatcgtgaacaaccaccacttcggcagcccctgcctgcccggggtgaagaagtacctgactgtgacctacgcctgtgtgcccaagaacatcctgacagccatcgaccctgccatcgccaacctgaagcccagcctgaagcagaaggatggagaatatggcatcaactttgaccccagcggcagcaaggtgctgaggaaggatggcatcctggtgagcaacagcctggccgcctttgcctacatccgggcccaccctgagcgggccgccctgctgtttgtgtcctctgtgtgcatcggcctggccctgaccctgtgtgccctggtgatccgggagagctgtgccaaggacttccgggacctgcagctgggccgggagcagctggtgcccggcagtgacaaggtggaggaggacagtgaagatgaggaggaggaggaggaccccagcgagagtgacttccctggagagctgagcggcttctgcaggaccagctaccccatctacagcagcattgaggccgctgagctggccgagagaattgaaagaagagagcagatcatccaggagatctggatgaacagcggcctggacaccagcctgcccaggaacatgggccagttctactag

SEQ ID NO: 33254 - DNA, 615 bp, Artificial Sequence
  Description of Artificial Sequence: Synthetic coding sequence
atgggctgggactgcaggaggaccaccgtggagaaccccagccccatccggaactgtgtgaaccaggagtggccagagggcagcagccctggcctgacagagggcaacacaggcctggtgcgggacctgcggcctgcccaccaggacagaagtggcaccagagaagatcctgctggccaggagaccacagccatcaccaaccccagccccagcctggccgctgacctggccggagatgccctgcccggctgcctgggcgccgccgcccaccagggccccctgctggacaggagcagcgagagcaccctgggcccccaggccctggagctggagcactgccacgagcggggctgctgccggggctgtgccagcttcagccccttccctgccccccgctgccccagcgagcggctgggcgcccacagcagccgctgggccatccggggccgcagcaagatcaaccccccaccctgggccccagcctgcctgcccggcggcttccctgcctgcctgcctgcccccaagagcagcacagacagcgccagcagctgcttcaagggcggccgggagttcagtgaccccctggacatccctggggccggggccatgggctag

SEQ ID NO: 33255 - DNA, 249 bp, Artificial Sequence
  Description of Artificial Sequence: Synthetic coding sequence
atgggctgggactgcaggaggaccaccgtggagaaccccagccccatccggaactgtgtgaaccaggagtggccagagggcagcagccctggcctgacagagggcaacacaggcctggtgcgggacctgcggcctgcccaccaggacagaagtggcaccagagaagatcctgctggccaggagaccacagccatcaccaaccccagccccagctgcaccagcggggccagcgctggccagaagctgtag

SEQ ID NO: 33256 - DNA, 483 bp, Artificial Sequence
  Description of Artificial Sequence: Synthetic coding sequence
atgaccacccaggaggacaccaccggcctgcaccagaagaccagcctgtggaccatgagcaggcctggggccaagaaggtgatgaacagctacttcatcgccggctgcggccctgctgtgtgctactatgctgtgtcctggctgcggcagggcttcagcatcaacctgaccagctttggccgcatcccctggccccatgctggggtgggcacctgccccagcccccagagctggatcagccccttcctgcagagccaccgggagcaccactacgccaagaccagcagccacagccagcccagcccccagagcctggccctgtgcctggcctacagccgctgcagcatcaacatctgccagatgacagagtgcatcagcctggccagcggctgccaccaggccctgcgggagcccggccgctctgaggagagcttctggatcccagccaccccctacatcagcaacatcttcagcgagagctag

SEQ ID NO: 33257 - DNA, 684 bp, Artificial Sequence
  Description of Artificial Sequence: Synthetic coding sequence
atggtgcccaccggctgggccggcctgggcggcgctgtggtgcacggccctgggaagctggagaaggctgtgcccagcccccgggccctggacttcctgtctgtgaagtgggaggccgccatgatgaatggcaaggtgcccttcttcttcagcagcgagagcctgggctactttgccaccggccggcctgctgacaacgtgatgaccacccaggaggacaccaccggcctgcaccagaagaccagcctgtggaccatgagcaggcctggggccaagaaggtgatgaacagctacttcatcgccggctgcggccctgctgtgtgctactatgctgtgtcctggctgcggcagggcttcagcatcaacctgaccagctttggccgcatcccctggccccacgccggcgtgggcacctgccccagcccccagagctggatcagccccttcctgcagagccaccgggagcaccactacgccaagaccagcagccacagccagcccagcccccagagcctggccctgtgcctggcctacagccgctgcagcatcaacatctgccagatgacagagtgcatcagcctggccagcggctgccaccaggccctgcgggagcccggccgctctgaggagagcttctggatcccagccaccccctacatcagcaacatcttcagcgagagctag

SEQ ID NO: 33258 - DNA, 831 bp, Artificial Sequence
  Description of Artificial Sequence: Synthetic coding sequence
atgtgcatcatcttcttcaagtttgaccccaggcctgtgtccaagaatgcctaccgcctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgcggggagctggtgacccacttcctgaccacagatgtggacagcctgagctacctgaagaaggtgtccatggagggccacctgtacaacggcttcaacctgattgctgctgacctgagcacagccaagggagatgtgatctgctactacggcaacagaggagagccagaccccatcgtgctgaccccaggcacctacggcctgagcaatgccctgctggagaccccctggaggaagctgtgcttcggcaagcagctgttcctggaggccgtggagaggagccaggccctgcccaaggatgtgctgattgccagcctgctggatgtgctgaacaatgaggaggcccagctgcctgaccctgccatcgaggaccagggcggggagtatgtgcagcccatgctgagcaaatatgctgctgtgtgtgtgcgctgccccggctacggcaccaggaccaacaccatcatcctggtggatgctgatggccacgtgaccttcacagagaggtccatgatggacaaggacctgagccactgggagaccaggacctatgagttcaccctgcagagctag

SEQ ID NO: 33259 - DNA, 645 bp, Artificial Sequence
  Description of Artificial Sequence: Synthetic coding sequence
atgtgcatcatcttcttcaagtttgaccccaggcctgtgtccaagaatgcctaccgcctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccggggcacctacggcctgagcaatgccctgctggagaccccctggaggaagctgtgcttcggcaagcagctgttcctggaggccgtggagaggagccaggccctgcccaaggatgtgctgattgccagcctgctggatgtgctgaacaatgaggaggcccagctgcctgaccctgccatcgaggaccagggcggggagtatgtgcagcccatgctgagcaaatatgctgctgtgtgtgtgcgctgccccggctacggcaccaggaccaacaccatcatcctggtggatgctgatggccacgtgaccttcacagagaggtccatgatggacaaggacctgagccactgggagaccaggacctatgagttcaccctgcagagctag

SEQ ID NO: 33260 - DNA, 645 bp, Artificial Sequence; identical to SEQ ID NO: 33259
  Description of Artificial Sequence: Synthetic coding sequence

SEQ ID NO: 33261 - DNA, 537 bp, Artificial Sequence
  Description of Artificial Sequence: Synthetic coding sequence
atggccggccaccagcacacctggcaggccggcagcacccaccagctgcctgctgctgctgctggcctggccggcccccgggccagcacagccaagggagatgtgatctgctactacggcaacagaggagagccagaccccatcgtgctgaccccaggcacctacggcctgagcaatgccctgctggagaccccctggaggaagctgtgcttcggcaagcagctgttcctggaggccgtggagaggagccaggccctgcccaaggatgtgctgattgccagcctgctggatgtgctgaacaatgaggaggcccagctgcctgaccctgccatcgaggaccagggcggggagtatgtgcagcccatgctgagcaaatatgctgctgtgtgtgtgcgctgccccggctacggcaccaggaccaacaccatcatcctggtggatgctgatggccacgtgaccttcacagagaggtccatgatggacaaggacctgagccactgggagaccaggacctatgagttcaccctgcagagctag

SEQ ID NO: 33262 - DNA, 267 bp, Artificial Sequence
  Description of Artificial Sequence: Synthetic coding sequence
atgtgcatcatcttcttcaagtttgaccccaggcctgtgtccaagaatgcctaccgcctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgctag

SEQ ID NO: 33263 - DNA, 645 bp, Artificial Sequence; identical to SEQ ID NO: 33259
  Description of Artificial Sequence: Synthetic coding sequence

SEQ ID NO: 33264 - DNA, 681 bp, Artificial Sequence
  Description of Artificial Sequence: Synthetic coding sequence
atgtgcatcatcttcttcaagtttgaccccaggcctgtgtccaagaatgcctaccgcctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgcggggagctggtgacccacttcctgaccacagatgtggacagcctgagctacctgaagaaggtgtccatggagggccacctgtacaacggcttcaacctgattgctgctgacctgagcacagccaagggagatgtgatctgctactacggcaacagaggagagccagaccccatcgtgctgaccccaggcacctacggcctgagcaatgccctgctggagaccccctggaggaagctgtgcttcggcaagcagctgttcctggaggccgtggagaggagccaggccctgcccaaggatgtgctgattgccagcctgctggatgtgctgaacaatgaggaggcccagctgcctgaccctgccatcgaggaccagggcggggagtatgtgcagcccatgctgagcaaatatgctgcctag

SEQ ID NO: 33265 - DNA, 597 bp, Artificial Sequence
  Description of Artificial Sequence: Synthetic coding sequence
atgccacccaagctgctgtgtgccggccgctgtgtgggccaggatggagctgcccaggcctggcactgccccccaggccagggccacagcgtgtgggatgctgtgaggatgcccctgggcgccggcacccctgtgaatgtgcagaggagagaagattctgccacagagggcagccacaggctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgcggggagctggtgacccacttcctgaccacagatgtggacagcctgagctacctgaagaaggtgtccatggagggccacctgtacaacggcttcaacctgattgctgctgacctgagcacagccaagggagatgtgatctgctactacggcaacagaggagagccagaccccatcgtgctgaccccagagcccaccctgagctcctggtag

SEQ ID NO: 33266 - DNA, 831 bp, Artificial Sequence; identical to SEQ ID NO: 33258
  Description of Artificial Sequence: Synthetic coding sequence

SEQ ID NO: 33267 - DNA, 498 bp, Artificial Sequence
  Description of Artificial Sequence: Synthetic coding sequence
atgtgcatcatcttcttcaagtttgaccccaggcctgtgtccaagaatgcctaccgcctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgcggggagctggtgacccacttcctgaccacagatgtggacagcctgagctacctgaagaaggtgtccatggagggccacctgtacaacggcttcaacctgattgctgctgacctgagcacagccaagggagatgtgatctgctactacggcaacagaggagagccagaccccatcgtgctgaccccaggcacctacggcctgagcaatgccctgctggagaccccctggaggtag

SEQ ID NO: 33268 - DNA, 846 bp, Artificial Sequence
  Description of Artificial Sequence: Synthetic coding sequence
atgcccctgggcgccggcacccctgtgaatgtgcagaggagagaagattctgccacagagggcagccacaggctcatcctggccgccaacagagatgagttctacagccggcccagcaagctggccgacttctggggcaacaacaatgagatcctgagcggcctggacatggaggagggcaaggagggcggcacctggctgggcatcagcacccggggcaagctggccgccctgaccaactacctgcagccccagctggactggcaggcccggggccgcggggagctggtgacccacttcctgaccacagatgtggacagcctgagctacctgaagaaggtgtccatggagggccacctgtacaacggcttcaacctgattgctgctgacctgagcacagccaagggagatgtgatctgctactacggcaacagaggagagccagaccccatcgtgctgaccccaggcacctacggcctgagcaatgccctgctggagaccccctggaggaagctgtgcttcggcaagcagctgttcctggaggccgtggagaggagccaggccctgcccaaggatgtgctgattgccagcctgctggatgtgctgaacaatgaggaggcccagctgcctgaccctgccatcgaggaccagggcggggagtatgtgcagcccatgctgagcaaatatgctgctgtgtgtgtgcgctgccccggctacggcaccaggaccaacaccatcatcctggtggatgctgatggccacgtgaccttcacagagaggtccatgatggacaaggacctgagccactgggagaccaggacctatgagttcaccctgcagagctag

SEQ ID NO: 33269 - DNA, 324 bp, Artificial Sequence
  Description of Artificial Sequence: Synthetic coding sequence
atggccagcggggccgcccgctggctggtgctggcccctgtgcgcagcggggccctgcggagcggccccagcctgaggaaggatggagatgtgtctgctgcctggagcggcagcggccgcagcctggtgcccagccgctctgtgattgtgaccaggtctggggccatcctgcccaagcctgtgaagatgagctttggcctgctgcgggtcttcagcatcgtcatccccttcctgtatgtgggcaccctcatcagcaagaactttgctgccctgctggaggagcatgacatctttgtgcctgaagatgatgatgatgatgactag

SEQ ID NO: 33270 - DNA, 1704 bp, Artificial Sequence
  Description of Artificial Sequence: Synthetic coding sequence
atgatggctgctgtgcccccaggcctggagccctggaacagagtgcgcatccccaaggccggcaacagatctgctgtgacagtgcagaaccctggagctgccctggacctgtgcatcgctgctgtgatcaaggagtgccacctggtgatcctgagcctgaagagccagaccctggatgctgagacagatgtgctgtgtgctgtgctgtacagcaaccacaacaggatgggccgccacaagccccacctggccctgaagcaggtggagcagtgcctgaagaggctgaagaacatgaacctggagggcagcatccaggacctgtttgagctgttcagcagcaatgaaaaccagcccctgaccaccaaggtgtgtgtggtgcccagccagcctgtggtggagctggtgctgatgaaggtgctgggcgcctgcaagctgctgctgcggctgctggactgctgctgcaagaccttcctgctgactgtgaagcacctgggcctgcaggagttcatcatcctgaacctggtgatggtgggcctggtgtcccggctgtgggtgctgtacaagggcgtgctgaagaggctcatcctgctgtatgagcccctgtttggcctgctgcaggaggtggcccgcatccagcccatgccctacttcaaggacttcaccttccccagcgacatcacagagttcctgggccagccctactttgaggccttcaagaagaagatgcccatcgcctttgctgccaagggcatcaacaagctgctgaacaagctgttcctgatcaatgagcagagcccccgggccagcgaggagaccctgctgggcatcagcaagaaggccaagcagatgaagatcaacgtgcagaacaacgtggacctgggccagcctgtgaagaacaagagggtcttcaaggaggagagcagcgagtttgatgtgcgggccttctgcaaccagctgaagcacaaggccacccaggagaccagctttgacttcaagtgcagccagagccggctgaagaccaccaagtacagcagccagaaggtgattggcacccctcatgccaagagctttgtgcagcgcttccgggaggccgagagcttcacccagctgtctgaggagatccagatggctgtggtgtggtgccgcagcaagaagctgaaggcccaggccatcttcctgggcaacaagctgctgaagagcaaccggctgaagcacctggaggcccagggcaccagcctgcccaagaagctggagtgcatcaagaccagcatctgcaaccacctgctgcggggcagcggcatcaagaccagcaagcaccacctgcggcagaggaggagccagaacaagttcctgcggcggcagaggaagccccagaggaagctgcagagcaccctgctgcgggagatccagcagttcagccagggcaccaggaagagcgccacagacaccagcgccaagtggaggctgagccactgcaccgtgcacaggacagacctgtaccccaacagcaagcagctgctgaacagcggcgtgtccatgcctgtgatccagaccaaggagaagatgattcatgagaacctgcggggcatccatgaaaatgaaacagacagctggacagtgatgcagatcaacaagaacagcaccagcggcaccatcaaggagacagatgacattgatgacatctttgccctgatgggcgtgtag

SEQ ID NO: 33271 - DNA, 1494 bp, Artificial Sequence
  Description of Artificial Sequence: Synthetic coding sequence
atgatggctgctgtgcccccaggcctggagccctggaacagagtgcgcatccccaaggccggcaacagatctgctgtgacagtgcagaaccctggagctgccctggacctgtgcatcgctgctgtgatcaaggagtgccacctggtgatcctgagcctgaagagccagaccctggatgctgagacagatgtgctgtgtgctgtgctgtacagcaaccacaacaggatgggccgccacaagccccacctggccctgaagcaggtggagcagtgcctgaagaggctgaagaacatgaacctggagggcagcatccaggacctgtttgagctgttcagcagcaaggtgctgtacaagggcgtgctgaagaggctcatcctgctgtatgagcccctgtttggcctgctgcaggaggtggcccgcatccagcccatgccctacttcaaggacttcaccttccccagcgacatcacagagttcctgggccagccctactttgaggccttcaagaagaagatgcccatcgcctttgctgccaagggcatcaacaagctgctgaacaagctgttcctgatcaatgagcagagcccccgggccagcgaggagaccctgctgggcatcagcaagaaggccaagcagatgaagatcaacgtgcagaacaacgtggacctgggccagcctgtgaagaacaagagggtcttcaaggaggagagcagcgagtttgatgtgcgggccttctgcaaccagctgaagcacaaggccacccaggagaccagctttgacttcaagtgcagccagagccggctgaagaccaccaagtacagcagccagaaggtgattggcacccctcatgccaagagctttgtgcagcgcttccgggaggccgagagcttcacccagctgtctgaggagatccagatggctgtggtgtggtgccgcagcaagaagctgaaggcccaggccatcttcctgggcaacaagctgctgaagagcaaccggctgaagcacctggaggcccagggcaccagcctgcccaagaagctggagtgcatcaagaccagcatctgcaaccacctgctgcggggcagcggcatcaagaccagcaagcaccacctgcggcagaggaggagccagaacaagttcctgcggcggcagaggaagccccagaggaagctgcagagcaccctgctgcgggagatccagcagttcagccagggcaccaggaagagcgccacagacaccagcgccaagtggaggctgagccactgcaccgtgcacaggacagacctgtaccccaacagcaagcagctgctgaacagcggcgtgtccatgcctgtgatccagaccaaggagaagatgattcatgagaacctgcggggcatccatgaaaatgaaacagacagctggacagtgatgcagatcaacaagaacagcaccagcggcaccatcaaggagacagatgacattgatgacatctttgccctgatgggcgtgtag

SEQ ID NO: 33272 - DNA, 1296 bp, Artificial Sequence
  Description of Artificial Sequence: Synthetic coding sequence
atgaaggtgctgggcgcctgcaagctgctgctgcggctgctggactgctgctgcaagaccttcctgctgactgtgaagcacctgggcctgcaggagttcatcatcctgaacctggtgatggtgggcctggtgtcccggctgtgggtgctgtacaagggcgtgctgaagaggctcatcctgctgtatgagcccctgtttggcctgctgcaggaggtggcccgcatccagcccatgccctacttcaaggacttcaccttccccagcgacatcacagagttcctgggccagccctactttgaggccttcaagaagaagatgcccatcgcctttgctgccaagggcatcaacaagctgctgaacaagctgttcctgatcaatgagcagagcccccgggccagcgaggagaccctgctgggcatcagcaagaaggccaagcagatgaagatcaacgtgcagaacaacgtggacctgggccagcctgtgaagaacaagagggtcttcaaggaggagagcagcgagtttgatgtgcgggccttctgcaaccagctgaagcacaaggccacccaggagaccagctttgacttcaagtgcagccagagccggctgaagaccaccaagtacagcagccagaaggtgattggcacccctcatgccaagagctttgtgcagcgcttccgggaggccgagagcttcacccagctgtctgaggagatccagatggctgtggtgtggtgccgcagcaagaagctgaaggcccaggccatcttcctgggcaacaagctgctgaagagcaaccggctgaagcacctggaggcccagggcaccagcctgcccaagaagctggagtgcatcaagaccagcatctgcaaccacctgctgcggggcagcggcatcaagaccagcaagcaccacctgcggcagaggaggagccagaacaagttcctgcggcggcagaggaagccccagaggaagctgcagagcaccctgctgcgggagatccagcagttcagccagggcaccaggaagagcgccacagacaccagcgccaagtggaggctgagccactgcaccgtgcacaggacagacctgtaccccaacagcaagcagctgctgaacagcggcgtgtccatgcctgtgatccagaccaaggagaagatgattcatgagaacctgcggggcatccatgaaaatgaaacagacagctggacagtgatgcagatcaacaagaacagcaccagcggcaccatcaaggagacagatgacattgatgacatctttgccctgatgggcgtgtag

SEQ ID NO: 33273 - DNA, 645 bp, Artificial Sequence
  Description of Artificial Sequence: Synthetic coding sequence
atgcccaaggtgctgtgcaaggacagcgagcggctgagccccagccacaacttcctgaagaagagccgctggcagctgtatggagctgggaagaagctgaaggcccaggccatcttcctgggcaacaagctgctgaagagcaaccggctgaagcacctggaggcccagggcaccagcctgcccaagaagctggagtgcatcaagaccagcatctgcaaccacctgctgcggggcagcggcatcaagaccagcaagcaccacctgcggcagaggaggagccagaacaagttcctgcggcggcagaggaagccccagaggaagctgcagagcaccctgctgcgggagatccagcagttcagccagggcaccaggaagagcgccacagacaccagcgccaagtggaggctgagccactgcaccgtgcacaggacagacctgtaccccaacagcaagcagctgctgaacagcggcgtgtccatgcctgtgatccagaccaaggagaagatgattcatgagaacctgcggggcatccatgaaaatgaaacagacagctggacagtgatgcagatcaacaagaacagcaccagcggcaccatcaaggagacagatgacattgatgacatctttgccctgatgggcgtgtag

SEQ ID NO: 33274 - DNA, 489 bp, Artificial Sequence
  Description of Artificial Sequence: Synthetic coding sequence
atgaacagcaggacagccagcgcccggggctggttcagcagccggccccccaccagcgagagtgacctggagcccgccacagatggccctgccagcgagaccaccaccctgagccctgaggccaccaccttcaatgacacccgcatcccagatgctgctgggggcacagctggggtgggcaccatgctgctgagctttggcatcatcaccgtcatcggcctggccgtggccctggtgctgtacatcaggaagaagaagaggctggagaagctgcggcaccagctgatgcccatgtacaactttgaccccacagaggagcaggatgagctggagcaggagctgctggagcacggcagagatgctgcctctgtgcaggccgccacctctgtgcaggccatgcagggcaagaccaccctgcccagccagggccccctgcagaggcccagccggctggtgttcacagatgtggccaatgccatccacgcctag

SEQ ID NO: 33275 - DNA, 489 bp, Artificial Sequence; identical to SEQ ID NO: 33274
  Description of Artificial Sequence: Synthetic coding sequence

SEQ ID NO: 33276 - DNA, 429 bp, Artificial Sequence
  Description of Artificial Sequence: Synthetic coding sequence
atgaacagcaggacagccagcgcccggggctggttcagcagccggccccccaccagcgagagtgacctggagcccgccacagatggccctgccagcgagaccaccaccctgagccctgaggccaccaccttcaatgacacccgcatcccagatgctgctgggggcacagctggggtgctgtacatcaggaagaagaagaggctggagaagctgcggcaccagctgatgcccatgtacaactttgaccccacagaggagcaggatgagctggagcaggagctgctggagcacggcagagatgctgcctctgtgcaggccgccacctctgtgcaggccatgcagggcaagaccaccctgcccagccagggccccctgcagaggcccagccggctggtgttcacagatgtggccaatgccatccacgcctag

SEQ ID NO: 33277 - DNA, 489 bp, Artificial Sequence; identical to SEQ ID NO: 33274
  Description of Artificial Sequence: Synthetic coding sequence

SEQ ID NO: 33278 - DNA, 2715 bp, Artificial Sequence
  Description of Artificial Sequence: Synthetic coding sequence
atgagctacatcaagagcaacctggagctgtaccagcagtacacagccatggcccccaagctgctggcccgcatcagcaagctgctgatgatctgccagaatgccggcatctctgtgcccaagggcatccggaacatctttgagttcacctgggaggagctgatcagtgaccccagcgtgcccacccccagcgacatcctgggcctggaggtgtcctttggagcccccctggtggtgctgatggagcccacctttgtgcaggtgcccaccctgaagaagcccctgcccccacctcctccagccccacccaggcctgtgctgctggccaccactggagctgccaagaggagcaccctgagccccaccatggcccggcaggtgaggacccaccaggagaccctgaaccgcttccagcagcagagcatccacctgctgacagagctgctgcggctgaagatgaaggccatggtggagagcatgtctgtgggcgccaaccccctggacatcaccaggagatttgtggaggccagccagctgctgcacctgaatgccaaggagatggccttcaactgcctgatcagcacagctggccgcagcggctacagcagcggccagctgtggaaggagagcctggccaacatgtctgccatcggcgtgaacagcccctaccagctgatctaccacagcagcacagcctgcctgtccttcagcctgtctgctgggaaggaggccaagaagaagattggcaagagcaggaccacagaagatgtgtccatgccacccctgcacagaggagtgggcaccccagccaacagcctggagttcagtgacccctgcccagaggcccgggagaagctgcaggagctgtgccgccacattgaagctgagcgggccacctggaagggcaggaacatctcctaccccatgatcctgaggaactacaaggccaagatgcccagccacctgatgctggccaggaaaggagacagccagaccccaggcctgcactacccacccacagctggggcccagaccctgagccccaccagccaccccagcagcgccaaccaccacttcagccagcactgccaggagggcaaggcccccaagaaggccttcaagttccactacaccttctatgatggcagcagctttgtgtactaccccagcggaaatgtggccgtgtgccagatccccacctgctgccggggccgcaccatcacctgcctcttcaatgacatccctggcttcagcctgctggccctcttcaacacagagggccagggctgtgtgcactacaacctgaagaccagctgcccctacgtgctgatcctggatgaggagggcggcaccaccaatgaccagcagggctacgtggtgcacaagtggagctggaccagcaggacagagaccctgctgagcctggagtacaaggtgaatgaggagatgaagctgaaggtgctgggccaggacagcatcaccgtgaccttcaccagcctgaatgaaacagtgaccctgactgtgtctgccaacaactgcccccacggcatggcctatgacaagaggctgaacagacgcatcagcaacatggatgacaaggtgtacaagatgagccgggccctggccgagatcaagaagcgcttccagaagacagtgacccagttcatcaacagcatcctgctggccgccggcctcttcaccatcgagtaccccaccaagaaggaggaggaggagtttgtgcgcttcaagatgaggagcaggacccaccctgagcggctgcccaagctgagcctgtacagcggggagagcctgctgcggagccagagcggccacctggagagcagcattgctgagaccctgaaggatgagcctgagagcgcccctgtgtcccctgtgaggaagaccaccaagatccacaccaaggccaaggtgaccagccggggcaaggcccgggagggccgcagccccacccgctgggccgccctgcccagcgactgccccctggtgctgaggaagctgatgctgaaggaggacaccagggctggctgcaagtgcctggtgaaggcccccctggtgtctgatgtggagctggagcgcttcctgctggccccccgggaccccagccaggtgctggtgtttggcatcatcagcagccagaactacaccagcacaggccagctgcagtggctgctgaacaccctgtacaaccaccagcagaggggccggggcagcccctgcatccagtgccgctatgacagctaccgcctgctgcagtatgacctggacagccccctgcaggaggacccccccctgatggtgaagaagaacagcgtggtgcagggcatgatcctgatgtttgctgggggcaagctgatctttggaggccgggtgctgaatggctacggcctgagcaagcagaacctgctgaagcagatcttccgcagccagcaggactacaagatgggctacttcctgcctgatgactacaagttctctgtgcccaacagcgtgctgagcctggaggacagcgagagcgtgaagaaggccgagagcgaggacatccagggcagcagcagcagcctggccctggaggactatgtggagaaggagctgagcctggaggccgagaagacccgggagcctgaggtggagctgcaccccctgagccgggacagcaagatcacctcctggaagaagcaggccagcaagaagtag

SEQ ID NO: 33279 - DNA, 2349 bp, Artificial Sequence
  Description of Artificial Sequence: Synthetic coding sequence
atggcccggcaggtgaggacccaccaggagaccctgaaccgcttccagcagcagagcatccacctgctgacagagctgctgcggctgaagatgaaggccatggtggagagcatgtctgtgggcgccaaccccctggacatcaccaggagatttgtggaggccagccagctgctgcacctgaatgccaaggagatggccttcaactgcctgatcagcacagctggccgcagcggctacagcagcggccagctgtggaaggagagcctggccaacatgtctgccatcggcgtgaacagcccctaccagctgatctaccacagcagcacagcctgcctgtccttcagcctgtctgctgggaaggaggccaagaagaagattggcaagagcaggaccacagaagatgtgtccatgccacccctgcacagaggagtgggcaccccagccaacagcctggagttcagtgacccctgcccagaggcccgggagaagctgcaggagctgtgccgccacattgaagctgagcgggccacctggaagggcaggaacatctcctaccccatgatcctgaggaactacaaggccaagatgcccagccacctgatgctggccaggaaaggagacagccagaccccaggcctgcactacccacccacagctggggcccagaccctgagccccaccagccaccccagcagcgccaaccaccacttcagccagcactgccaggagggcaaggcccccaagaaggccttcaagttccactacaccttctatgatggcagcagctttgtgtactaccccagcggaaatgtggccgtgtgccagatccccacctgctgccggggccgcaccatcacctgcctcttcaatgacatccctggcttcagcctgctggccctcttcaacacagagggccagggctgtgtgcactacaacctgaagaccagctgcccctacgtgctgatcctggatgaggagggcggcaccaccaatgaccagcagggctacgtggtgcacaagtggagctggaccagcaggacagagaccctgctgagcctggagtacaaggtgaatgaggagatgaagctgaaggtgctgggccaggacagcatcaccgtgaccttcaccagcctgaatgaaacagtgaccctgactgtgtctgccaacaactgcccccacggcatggcctatgacaagaggctgaacagacgcatcagcaacatggatgacaaggtgtacaagatgagccgggccctggccgagatcaagaagcgcttccagaagacagtgacccagttcatcaacagcatcctgctggccgccggcctcttcaccatcgagtaccccaccaagaaggaggaggaggagtttgtgcgcttcaagatgaggagcaggacccaccctgagcggctgcccaagctgagcctgtacagcggggagagcctgctgcggagccagagcggccacctggagagcagcattgctgagaccctgaaggatgagcctgagagcgcccctgtgtcccctgtgaggaagaccaccaagatccacaccaaggccaaggtgaccagccggggcaaggcccgggagggccgcagccccacccgctgggccgccctgcccagcgactgccccctggtgctgaggaagctgatgctgaaggaggacaccagggctggctgcaagtgcctggtgaaggcccccctggtgtctgatgtggagctggagcgcttcctgctggccccccgggaccccagccaggtgctggtgtttggcatcatcagcagccagaactacaccagcacaggccagctgcagtggctgctgaacaccctgtacaaccaccagcagaggggccggggcagcccctgcatccagtgccgctatgacagctaccgcctgctgcagtatgacctggacagccccctgcaggaggacccccccctgatggtgaagaagaacagcgtggtgcagggcatgatcctgatgtttgctgggggcaagctgatctttggaggccgggtgctgaatggctacggcctgagcaagcagaacctgctgaagcagatcttccgcagccagcaggactacaagatgggctacttcctgcctgatgactacaagttctctgtgcccaacagcgtgctgagcctggaggacagcgagagcgtgaagaaggccgagagcgaggacatccagggcagcagcagcagcctggccctggaggactatgtggagaaggagctgagcctggaggccgagaagacccgggagcctgaggtggagctgcaccccctgagccgggacagcaagatcacctcctggaagaagcaggccagcaagaagtag

SEQ ID NO: 33280 - DNA, 2349 bp, Artificial Sequence; identical to SEQ ID NO: 33279
  Description of Artificial Sequence: Synthetic coding sequence

SEQ ID NO: 33281 - DNA, 1491 bp, Artificial Sequence
  Description of Artificial Sequence: Synthetic coding sequence
atgttctgccacctgcggcccatgaggcggctgtgcctggagaagatcttcccccactggttccccttcagccgggccctgagcggggctgaggccgtgaatgccctgcggcccttctactttgctgtgcacccagacttcttcggccagcaccctgtggagcgggagatcaatgaaaacagcctgaagaggctgtctgtgtacctggagaacctgcagaagccaggcttcaagagcctgaagcccacccagctgaccttctacgtgcgggagacagaccagagcagcagtgatggccaggagcccttcagcaccagcggcttccgggctgtgaagttcaccctgcacacccgggacctgctgagcacagtgctgtacatcctgaacagctgcagcctgtctgtggagcacatccagagcctgaacaccaacatgcacacccagcccctgaaggaggccaagaggatgccagaccggcccatcaagtgggacaagagctactacagcttcaccggcttcaaggaccctgatgaggacctggagcaggtgtcccgggtggagaccaccctgacctcctggctggacaacaacgggaagtctgctgtgaagaagctgaagaacagcctgcccctgaggaaggagctggaccggctgaaggatgagctgagccaccagctgcagctgagtgacatccgctggcagaggtcctggggcatcgcccaccgctgcagccagctgcacagcctgagccggctggcccagcagaacctggagaccctgaagaaggccaagggctgcaccatcatcttcacagacaggagcggcatgtctgctgtgggccacgtgatgctgggcaccatggatgtgcaccaccactggaccaagctgtttgagcggctgcccagctactttgacctgcagaggcggctgatgatcctggaggaccagatctcctacctgctgggcggcatccaggtggtgtacatcgaggagctgcagcctgtgctgaccctggaggagtactacagcctgctggatgtgttctacaaccggctgctgaagagccgcatcctcttccaccccaggagcctgcggggcctgcagatgatcctgaacagcgacagatatgcccccagcctgcacgagctgggccacttcaacatccccaccctgtgtgaccctgccaacctgcagtggttcatcctgaccaaggcccagcaggcccgggagaacatgaagaggaaggaggagctgaaggtgattgaaaatgaactcatccaggccagcaccaagaagttcagcctggagaagctgtacaaggagcccagcatcagcagcatccagatggtggactgctgcaagaggctgctggagcagagcctgccctacctgcacggcatgcacctgtgcatcagccacttctacagcgtgatgcaggatggagacctgtgcatcccctggaactggaagaatggagaggccatcaagtag

SEQ ID NO: 33282 - DNA, 213 bp, Artificial Sequence
  Description of Artificial Sequence: Synthetic coding sequence
atgttctgccacctgcggcccatgaggcggctgtgcctggagaagatcttcccccactggttccccttcagccgggccctgagcggggctgaggccgtgaatgccctgcggcccttctactttgctgtgcacccagacttcttcggccagcaccctgtggagagagatgacacctggaagagcttccagtgccccagcgacttcagcctgtag

SEQ ID NO: 33283 - DNA, 213 bp, Artificial Sequence; identical to SEQ ID NO: 33282
  Description of Artificial Sequence: Synthetic coding sequence

SEQ ID NO: 33284 - DNA, 1491 bp, Artificial Sequence; identical to SEQ ID NO: 33281
  Description of Artificial Sequence: Synthetic coding sequence

SEQ ID NO: 33285 - DNA, 885 bp, Artificial Sequence
  Description of Artificial Sequence: Synthetic coding sequence
atggccggccagcctgctgccaccggcagccccagcgctgacaaggatggcatggagcccaacgtggtggcccgcatcagccagtgggcagatgaccacctgcggctggtgaggaacatcagcacaggcatggccatcgccggcatcatgctgctgctgcggagcatccggctgaccagcaagttcaccagcagcagtgacatccctgtggagttcatcagaagaaatgtgaagctgcggggccgcctgcggcgcatcacagaaaatggcctggagattgagcacatccccatcaccctgcccatcatcgccagcctgaggaaggagcccaggggggccctgctggtgaagctggccggcgtggagctggccgagaccgggaaggcctggctgcagaaggagctgaagcccagccagctgctgtggttccagctgctgggcaaggaaaattctgccctcttctgctacctgctggtgtccaaaggaggctacttctctgtgaacctgaatgaggagatcctgcggcggggcctgggcaagacagtgctggtgaagggcctgaagtatgacagcaagatctactggacagtgcacaggaacctgctgaaggccgagctgacagccctgaagaagggggagggcatctggaaggaggacagcgagaaggagagctacctggagaagttcaaggacagctggagggagatctggaagaaggacagcttcctgaagaccaccggcagtgacttcagcctgaagaaggagagctactatgagaagctgaagaggacctatgagatctggaaggacaacatgaacaactgcagcctcatcctgaagttccgggagctgatcagccgcatcaacttcagaagaaaaggatag

SEQ ID NO: 33286 - DNA, 756 bp, Artificial Sequence
  Description of Artificial Sequence: Synthetic coding sequence
atggccatcgccggcatcatgctgctgctgcggagcatccggctgaccagcaagttcaccagcagcagtgacatccctgtggagttcatcagaagaaatgtgaagctgcggggccgcctgcggcgcatcacagaaaatggcctggagattgagcacatccccatcaccctgcccatcatcgccagcctgaggaaggagcccaggggggccctgctggtgaagctggccggcgtggagctggccgagaccgggaaggcctggctgcagaaggagctgaagcccagccagctgctgtggttccagctgctgggcaaggagaacagcgccctcttctgctacctgctggtgtccaagggcggctacttctctgtgaacctgaatgaggagatcctgcggcggggcctgggcaagacagtgctggtgaagggcctgaagtatgacagcaagatctactggacagtgcacaggaacctgctgaaggccgagctgacagccctgaagaagggggagggcatctggaaggaggacagcgagaaggagagctacctggagaagttcaaggacagctggagggagatctggaagaaggacagcttcctgaagaccactggaagtgacttcagcctgaagaaggagagctactatgagaagctgaagaggacctatgagatctggaaggacaacatgaacaactgcagcctcatcctgaagttccgggagctgatcagccgcatcaacttccggaggaagggctag

SEQ ID NO: 33287 - DNA, 885 bp, Artificial Sequence; identical to SEQ ID NO: 33285
  Description of Artificial Sequence: Synthetic coding sequence

SEQ ID NO: 33288 - DNA, 513 bp, Artificial Sequence
  Description of Artificial Sequence: Synthetic coding sequence
atgaagaccatggccaccaggaagcgctgcaagctgagcaggactggacctgagtttgaaaatgtcatcaagaggctgctgtgtgcccggaccttccacacccgcatcggcggggacctgacccacggcatcatcaacagaggaagaagagccaatgctgagcagatgggcctgcagggcagcgcccagcacttcaacatcttccccctggacctgtggacccagggcaagaagacagaggtgcagaagcgggagggcacagacagcatcccagctgctggccgcagcggcacagccaaccagcccagcatcgccccccaccgctgcctcttcagccggggcatcacagccctggatggcctgaagaggggccggggctgcaatggagctgcccacctggtgagaggagatgcctggaagaccaagctgggggagccctgggtgtccatcgccctggccctggccggccctggggccatcctgatcctggagctgtcctggttcctgggctag

SEQ ID NO: 33289 - DNA, 360 bp, Artificial Sequence
  Description of Artificial Sequence: Synthetic coding sequence
atgaagaccatggccaccaggaagcgctgcaagctgagcaggactggacctgagtttgaaaatgtcatcaagaggctgctgtgtgcccggaccttccacacccgcatcggcggggacctgacccacggcatcatcaacagaggaagaagagccaatgctgagcagatgggcctgcagggcagcgcccagcacttcaacatcttccccctggacctgtggacccagggcgactgcatgctggtgtccctggccaagaacaaggtgaatgtgtttggagccatcatcaacatggccgcctctgtgtctggagtgattggaggcctgaagttcagcaggacctactacgtgaagggcatctag

SEQ ID NO: 33290 - DNA, 360 bp, Artificial Sequence; identical to SEQ ID NO: 33289
  Description of Artificial Sequence: Synthetic coding sequence

SEQ ID NO: 33291 - DNA, 360 bp, Artificial Sequence; identical to SEQ ID NO: 33289
  Description of Artificial Sequence: Synthetic coding sequence

SEQ ID NO: 33292 - DNA, 237 bp, Artificial Sequence
  Description of Artificial Sequence: Synthetic coding sequence
atgaagaccatggccaccaggaagcgctgcaagctgagcaggactggacctgagtttgaaaatgtcatcaagaggctgctgtgtgcccggaccttccacacccgcatcggcggggacctgacccacggcatcatcaacagaggaagaagagccaatgctgagcagatgggcctgcagggcagcgcccagcacttcaacatcttccccctggacctgtggacccagggcaagaagtag

SEQ ID NO: 33293 - DNA, 645 bp, Artificial Sequence
  Description of Artificial Sequence: Synthetic coding sequence
atgaacaatgagaccaccaccctcatcagcctgaaggaggccatgaagagggtggaccacaagctgcaggccctggagacccagttcaaggagctggacttcaccaaggacaacctgatgcagaagtttgagcaccacagcaaggccctggccagccaggccgcccaggatgagatgtggacagctgtgcgggccctgcagctgacctccatggagctgaacatcctgtacagctatgtgattgaggtgctgatctgcctgcacaccagggtgctggagaagctgcctgacctggtgcggggcctgcccaccctggcctctgtgctgcggaggaaggtgaagaacaagagggtgcgggtggtgtgggagagcatcctggaggagtgtggcctgcaggagggggacatcacagccctgtgcaccttcttcatcgcccggggcaacaaggccgagcactacacagccaaggtgcggcagatgtacatcagagatgtgaccttcctgatcaccaacatggtgaagaaccaggccctgcaggacagcctgctgcgggctgtgcaggtgattgagaagggcaaggctgtgaggaccccagagaagcagaagagcagcctggaggagctgatccccagcgtgaagaactag

SEQ ID NO: 33294 - DNA, 495 bp, Artificial Sequence
  Description of Artificial Sequence: Synthetic coding sequence
atgcccagcctggccccagactgccccctgctggccatgcctgaggagacccaggaggacagcgtggcccccatgatgcccagccagaggagccggggccccctggcccccaaccacgtgcatgaggtgtgcctgcaccaggtggagagcatcagtgacctgcacagcggggccggcaccctgcggccctacctgacagaggaggcccggccctgggatgagctgctgggcgtgctgccccccagcctgtgtgcccaggccggctgcagccctgtgtaccgccggggcggcttcctgctgctgctggccctgctggtgctgacctgcctggtgctggccctgctggccgtgtacctgtctgtgctgcagagcgagagcctgcgcatcctggcccacaccctgcggacccaggaggagaccctgctgaagctgcggctggccagcctgagccagctgcggcggctgaacagcagcgaggcccaggcccccagctag

SEQ ID NO: 33295 - DNA, 219 bp, Artificial Sequence
  Description of Artificial Sequence: Synthetic coding sequence
atgaaggtggtgggcaactacagagtgaacacagccaacagcagcacagacaccagcggggagcacctgacctgcctgcggagccagctgtttgtggcctacagaaatggccgggtggatgaggccgtgtccctgggcttcctggactgctggattggaggagacctgaccaacttcaagggctgctacctgaccaaccagctgcccatccagttctag

SEQ ID NO: 33296 - DNA, 873 bp, Artificial Sequence
  Description of Artificial Sequence: Synthetic coding sequence
atgctgggccagagagctggagatggagagcggcccggcctgcctggagatggagagggcggcgtgcctgcccggcccggccggcgggcagagaggcctccccagaggcctgccaaggtgaacaaggctgtgacctgtgccgcccacctgcctggagctgctgccagccggcccctgagccccaacaagccagacagagtgcggcccggccagagggacagaattggagccaagaggcagaggagaagaagagcagatgctggccaggcccgggccgccagcagccggcgggtggtgcccacagcccctgaggtgctgggcgctgtggccagcctgcctgaccggggccggcccaccgtggcccgggtggccaccggcagccggctggagggcctcttctctgctgccagcctgaagctgagcgccctgacccagagcctgaccagggtgcggcaggcccccacagccagcggggccaccatccggctgcctgccagccctgtggagatgttcctgaccagcgccttcctgaccggcttctccttccactgcctgtacagcggcattggacatggagaggacatcctggcctctgtggagcagatcaccatcgtgtcccggcccctgagcggccagagaggagctggccctggcaacagcgcctacaccccaagaagaagccagggcggccccagggctgccaccaccccaggcttccgcttcccctgccggggcctggtgcggcgggctgtgctgcggctgactgtgacagtgcaggactgcatcctgacagccctgctggccgtgtccttccacagcattggagtggtgatcatgaccagcagctacctgctgggccctgtggtgaagtag

SEQ ID NO: 33297 - DNA, 213 bp, Artificial Sequence
  Description of Artificial Sequence: Synthetic coding sequence
atgttcacccgggcccaggtgcggcgcatcctgcagagggtgcctgggaagcagcgcttcggcatctaccgcttcctgcccttcttctttgtgctgggcggcaccatggagtggatcatgatcaaggtgcgggtgggccaggagaccttctatgatgtgtacagaaggaaggccagcgagcggcagtaccagaggcggctggaggatgaatag

SEQ ID NO: 33298 - DNA, 3189 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtatgatgacaagggggcctgcctggagagcctcttcctgaagtgcctggaggtgaagccaggagatgacctggagagtgaccgctacctgatcaccgtggaggaggtgaaggtggccggggccatcggcatcgtgaagcagaatgtgaacaaggaggcccctgagctgaacagcaggaccttcatcagcagcggccgcagcctgggctgccagcccagcggcctgaagaggaagttcaccggcttccagggcccccggcaggtgcccaagaagatggtgatcatggagagcggggagagcgctgccagccatgaggccaagaagacaggccccaccatcttcagccccttctgcagcatgccacccctcttccccaccgtgggcaagaaggatgtgaacaacatcctggccgaccctgaaaatattgtgacctacaagaaccgggagagaaatgccatggacttcagcagcgtcttcagccccagcttccagatcaaccctgaggtgctgtgtgaggagaactacttctgcagccctgtgaacagcggcaacaagctgagtgacagcctgctgaccaatgaacctgtgaagagggacagcctggccagccactacagcggcgtgtcccagaacatccgcagcaaggcccagatcctggccctgctgaagtctgagagcagcagcagctgtgaggagctgaacagcgagatgacagagcacttcccccagaagcagccccagggcagcctgaagatcgccaccaagcccaagtacctgatccagcaggaggagtgtgccgagatgaagagcacagaaaatctctactaccagcaccagagcgagaacaccatgaggaacaagagccgctgggccatgtacctgagcagccagagcagccccatccacagcagcacagtggatggaaatgacacagagaggaagcccaaggcccaggaggatgatgtgaacagcaacctgaaggacctgagcctgcagaagatcatccagtttgtggagacctatgcagaggagaggaagaagtacaacgtggaccagagcgtgggcaacaatgaccccagctggaaccaggaggtgaagctggagatccccagcttcaatgaaagcagcagcctgcaggtgacctgcagcagcgcagaaaatgatggcatcctgtctgagagtgacatccaggaggacaacaagatccccttcaaccagaatgacaagggctgcatcaagggctctgtgctgatcaaggaaaatgcccaggaggtgaacacctgtggcaccctggagaaggagtatgagcagagcgagagcagcctgcctgagctgaagcacctgcagatcgagagcagcaacaacagccgcatcagtgatgacatcacagacatgatcagcgagagcaagatggacaatgaaagcctgaacagcatccacgagagcctgagcaatgtgacccagcccttcctggaggtgaccttcaacctgaacaactttgagaccagtgacacagaggaggagagccaggagagcaacaagatcagccaggacagcgagagctgggtgaaggacatcctggtgaatgatggcaacagctgcttccagaagagaagtgagaacaccaactgtgaggagattgaaggagagcacctgcccttcctgacctctgtgtctgacaagcccaccgtgaccttccctgtgaaggagaccctgcccagccagttctgtgacaagacctacgtgggctttgacatgggcatctgcaagacagaaaatacaggcaaggagattgaggagtacagcgacaccctgagcaactttgagagcttcaagtggacagatgctgtgtatggagacaacaaggaggatgccaacaagcccatccaggaggtgcgcatcaactatgactttgccctgccccccaacaagagcaagggcatcaacatgaacctgcacatcccccacatccagaaccagattgctgagaacagcaacctcttctctgaagatgcccagccccagcccttcatcctgggcagtgacctggacaagaatgatgagcacgtgctgcccagcaccagcagcagtgacaacagcgtgcagctgctgaacaccaaccagaaccactatgaatgtattgccctggacaagagcaacacccacatcagcaacagcctcttctaccccctgggcaagaagcacctgatcagcaaggacacagaggcccacatcagcgagcctgaggacctgggcaagatccgcagccccccaccagaccacgtggaggtggagacagcccgggagggcaagcagtactggaaccccaggaacagcagcgagctgagcggcctggtgaacaccatcagcatcctgaagagcctgtgtgagcacagcacagccctggacagcctggagatcctgaagaagaagaacacagtgttccagcagggcacccagcagacctatgagccagacagccccccagaggtgaggaagcccttcatcaccgtggtgagccccaagagcccccacctgcacaaggacagccagcagatcctgaaggaggatgaggtggagctgtctgagcccctgcagagcgtgcagttcagcagcagcggcagcaaggaggagacagccttccaggccgtcatccccaagcagatcgagaggaagacctgtgaccccaagcctgtggagttccagggccaccaggtgaagggcagcgccaccagcggcgtgatggtgcggggccacagcagccagctgggctgcagccagttcccagacagcacagaatatgagaacttcatgacagagaccccagagctgcccagcacctgcatgcagattgacttcctgcaggtgaccagccctgaggagaacatcagcaccctgagccctgtgtccaccttcagcctgaacagcagagatgaggacttcatggtggagttcagcgagaccagcctgaaggcccggaccctgcctgatgacctgcacttcctgaacctggagggcagccgctaccacatcgccctgatctctgtgtacagcttcaagatgaagttcttcatctag

SEQ ID NO: 33299 - DNA, 2748 bp, Artificial Sequence
  Description of Artificial Sequence: Synthetic coding sequence
atgttccaggccatcctgtatgatgacaagggggcctgcctggagagcctcttcctgaagtgcctggaggtgaagccaggagatgacctggagagtgaccgctacctgatcaccgtggaggaggtgaaggtggccggggccatcggcatcgtgaagcagaatgtgaacaaggaggcccctgagctgaacagcaggaccttcatcagcagcggccgcagcctgggctgccagcccagcggcctgaagaggaagttcaccggcttccagggcccccggcaggtgcccaagaagatggtgatcatggagagcggggagagcgctgccagccatgaggccaagaagacaggccccaccatcttcagccccttctgcagcatgcctcctctcttccccaccgtgggcaagaaggatgtgaacaacatcctggccgaccctgagaacatcgtgacctacaagaaccgggagagaaatgccatggacttcagctctgtgttcagccccagcttccagatcaaccctgaggtgctgtgtgaggagaactacttctgcagccctgtgaacagcggcaacaagctgagtgacagcctgctgaccaatgaacctgtgaagagggacagcctggccagccactacagcggcgtgtcccagaacatccgcagcaaggcccagatcctggccctgctgaagtctgagagcagcagcagctgtgaggagctgaacagcgagatgacagagcacttcccccagaagcagccccagggcagcctgaagatcgccaccaagcccaagtacctgatccagcaggaggagtgtgccgagatgaagagcacagagaacctgtactaccagcaccagagcgagaacaccatgaggaacaagagccgctgggccatgtacctgagcagccagagcagccccatccacagcagcacagtggatggaaatgacacagagaggaagcccaaggcccaggaggatgatgtgaacagcaacctgaaggacctgagcctgcagaagatcatccagtttgtggagacctacgccgaggagaggaagaagtacaacgtggaccagagcgtgggcaacaatgaccccagctggaaccaggaggtgaagctggagatccccagcttcaatgaaagcagcagcctgcaggtgacctgcagcagcgcagaaaatgatggcatcctgtctgagagtgacatccaggaggacaacaagatccccttcaaccagaatgacaagggctgcatcaagggctctgtgctgatcaaggaaaatgcccaggaggtgaacacctgtggcaccctggagaaggagtatgagcagagcgagagcagcctgcctgagctgaagcacctgcagatcgagagcagcaacaacagccgcatcagtgatgacatcacagacatgatcagcgagagcaagatggacaatgaaagcctgaacagcatccacgagagcctgagcaatgtgacccagcccttcctggaggtgaccttcaacctgaacaactttgagaccagtgacacagaggaggagagccaggagagcaacaagatcagccaggacagcgagagctgggtgaaggacatcctggtgaatgatggcaacagctgcttccagaagaggtctgagaacaccaactgtgaggagattgaaggagagcacctgcccttcctgacctctgtgtctgacaagcccaccgtgaccttccctgtgaaggagaccctgcccagccagttctgtgacaagacctacgtgggctttgacatgggcatctgcaagacagagaacacaggcaaggagattgaggagtacagcgacaccctgagcaactttgagagcttcaagtggacagatgctgtgtatggagacaacaaggaggatgccaacaagcccatccaggaggtgcgcatcaactatgactttgccctgccccccaacaagagcaagggcatcaacatgaacctgcacatcccccacatccagaaccagattgctgagaacagcaacctcttctctgaagatgcccagccccagcccttcatcctgggcagtgacctggacaagaatgatgaacatgtgctgcccagcaccagcagcagtgacaacagcgtgcagctgctgaacaccaaccagaaccactatgagtgcatcgccctggacaagagcaacacccacatcagcaacagcctcttctaccccctgggcaagaagcacctgatcagcaaggacacagaggcccacatcagcgagcctgaggacctgggcaagatccgcagccccccaccagaccacgtggaggtggagacagcccgggagggcaagcagtactggaaccccaggaacagcagcgagctgagcggcctggtgaacaccatcagcatcctgaagagcctgtgtgagcacagcacagccctggacagcctggagatcctgaagaagaagaacacagtgttccagcagggcacccagcagacctatgagccagacagccccccagaggtgaggaagcccttcatcaccgtggtgagccccaagagcccccacctgcacaaggacagccagcagaagacagtgaagaagaagatcaagcccaccctgcccctgcgcatcttcatcaacgtgagccgcttcttctgtgtgcagctgaagaagatggtgcggctgatgtacatcaacagcttcatctccttccccctgaacatcgtggtgctgagctacatcatcaacaacagcagctag

SEQ ID NO: 33300 - DNA, 525 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtatgatgacaagggggcctgcctggagagcctcttcctgaagtgcctggaggtgaagccaggagatgacctggagagtgaccgctacctgatcaccgtggaggaggtgaaggtggccggggccatcggcatcgtgaagcagaatgtgaacaaggaggcccctgagctgaacagcaggaccttcatcagcagcggccgcagcctgggctgccagcccagcggcctgaagaggaagttcaccggcttccagggcccccggcaggtgcccaagaagatggtgatcatggagagcggggagagcgctgccagccatgaggccaagaagacaggccccaccatcttcagccccttctgcagcatgccacccctcttccccaccgtgggcaagaaggatgtgaacaacatcctggcctag

SEQ ID NO: 33301 - DNA, 600 bp, Artificial Sequence
  Description of Artificial Sequence: Synthetic coding sequence
atgaccagcctcatcaacagccccatcaacagaagacccctgcagaatgtggagggcaacaaccgctgccagaggaaggccaagaactacggcaacaagtacttcatccactgcctggacctggagaagatcaccctgagccccaggaggaagcatgacatcgagggcggggacaagctgaatgtgaagttcagccagctgcggagccggcggcagaggaaggccgagcccggggcctgtgccctgggccgggtgggcagcgagtgcatccctgagcccggggcccggaggacagcccaggccgccggcctgcggtctgtgtctggggccgccaacaccaaggtgcgggagctgaagcacttccgcttcctgggcctgctgcggagctgccgctctgagatggaggtggatgcccctggggtggatggaagagatggcctgcgggagcggcggggcttcagcgagggcggccggcagaactttgatgtgcggccccagagcggggccaacggcctgcccaagcacagctactggctggacctgtggctgttcatcctgtttgatgtggtggtgttcctgtttgtgtacttcctgccctag

SEQ ID NO: 33302 - DNA, 201 bp, Artificial Sequence
  Description of Artificial Sequence: Synthetic coding sequence
atggaggtggatgcccctggggtggatggaagagatggcctgcgggagcggcggggcttcagcgagggcggccggcagaactttgatgtgcggccccagagcggggccaacggcctgcccaagcacagctactggctggacctgtggctgttcatcctgtttgatgtggtggtgttcctgtttgtgtacttcctgccctag

SEQ ID NO: 33303 - DNA, 399 bp, Artificial Sequence
  Description of Artificial Sequence: Synthetic coding sequence
atgtgcagcgctggggagctgctgcggggaggagatggaggagagagagatgaagatggagatgccctggccgagcgggaggccgccggcaccggctgggaccccggggccagccccaggagaagaggccagaggcccaaggagagcgagcaggatgtggaggacagccagaaccacactggagagcctgtgggagatgactacaagaagatgggcaccctgtttggagagctgaacaagaacctgatcaacatgggcttcaccaggatgtactttggagagcgcatcgtggagcctgtgattgtcatcttcttctgggtgatgctgtggttcctgggcctgcaggccctgggcctggtggccgtgctgtgcctggtgatcatctacgtgcagcagtag

SEQ ID NO: 33304 - DNA, 300 bp, Artificial Sequence
  Description of Artificial Sequence: Synthetic coding sequence
atggccgagggcggctttgacccctgtgaatgtgtgtgcagccatgaacatgccatgaggaggctcatcaacctgctgcggcagagccagagctactgcacagacacagaatgtctgcaggagctgcccggccccagcggggacaatggcatctctgtgaccatgatcctggtggcctggatggtgattgccctgatcctcttcctgctgcggccccccaacctgcggggcagcagcctgcccgggaagcccaccagcccccacaacggccaggaccccccagcccctcctgtggactag

SEQ ID NO: 33305 - DNA, 270 bp, Artificial Sequence
  Description of Artificial Sequence: Synthetic coding sequence
atggccgagggcggctttgacccctgtgaatgtgtgtgcagccatgaacatgccatgaggaggctcatcaacctgctgcggcagagccagagctactgcacagacacagaatgtctgcaggagctgcccggccccagcggggacaatggcatctctgtgaccatgatcctggtggcctggatggtgattgccctgatcctcttcctgctgcggccccccaacctgcggggcagcagcctgcccgggaagcccaccagcccccacaactag

SEQ ID NO: 33306 - DNA, 723 bp, Artificial Sequence
  Description of Artificial Sequence: Synthetic coding sequence
atgtacctgcggcgggctgtgtccaagaccctggccctgcccctgcgggccccacccaacccagcccccctgggcaaggatgccagcctgcggaggatgagcagcaaccgcttccctggcagcagcggcagcaacatgatctactacctggtggtgggcgtgacagtgtctgctgggggctactatgcctacaagacagtgaccagtgaccaggccaagcacacagagcacaagaccaacctgaaggagaagaccaaggccgagatccaccccttccagggcgagaaggaaaatgtggccgagacagagaaggccagcagcgaggcccctgaggagctgattgtggaggccgaggtggtggatgctgaggagagccccagcgccaccgtggtggtgatcaaggaggccagcgcctgccccggccacgtggaggccgcccctgagaccacagctgtgtctgctgagaccggccctgaggtgacagatgctgctgcccgggagaccacagaggtgaaccctgagaccaccccagaggtgaccaatgctgccctggatgaagctgtgaccatcgacaatgacaaggacaccaccaagaatgagaccagtgatgaatatgcagagctggaggaggagaacagccctgctgagagcgagagcagcgctggagatgacctgcaggaggaggcctctgtgggcagcgaggccgccagcgcccagggctag

SEQ ID NO: 33307 - DNA, 2337 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcggcaacaagatgtctgccatctctgtgcacggcgtgtccaccagcggcggccagatgtaccactatgacatgaacacagccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccggcagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccaccggggtgtcccaggagaccagcgagaaccctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgagcagcgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 33308 - DNA, 498 bp, Artificial Sequence
  Description of Artificial Sequence: Synthetic coding sequence
atgaagaccaagcccaacctgctcttccccaagagcgccccacccagcctgcccaggagagtgcccaggaaggtggaggaggacctgctgatgctgaacagcagccccagcacagccaaggacaccctggacaatggagactatggagagccagactatgactggaccaccggccccagagatgatgatgaaagtgatgacaccctggaggagaacagaggctacatggagattgagcagagcgtgaagagcttcaagatgcccagcagcaacatcgaggaggaggacagccacttcttcttccacctgatcatctttgccttctgcatcgctgtggtgtacatcacctaccacaacaagaggaagatcttcctgctggtgcagagcaggaagtggagagatggcctgtgcagcaagacagtggagtaccaccggctggaccagaatgtgaatgaggccatgcccagcctgaagatcaccaatgactacatcttctag

SEQ ID NO: 33309 - DNA, 648 bp, Artificial Sequence
  Description of Artificial Sequence: Synthetic coding sequence
atggccagcgagacagagaagacccacgccctgctgcagacctgcagcacagagagcctcatcagcagcctgggcctgggcgccttctgcctggtggccgaccggctgctgcagttcagcaccatccagcagaatgactggctgcgggccctgagtgacaatgctgtgcactgcgtcatcggcatgtggagctgggccgtggtgacaggcatcaagaagaagacagactttggagagatcatcctggccggcttcctggcctctgtgattgatgtggaccacttcttcctggccggctccatgagcctgaaggccgccctgaccctgccccggcggcccttcctgcactgcagcaccgtcatccctgtggtggtgctgaccctgaagttcaccatgcacctgttcaagctgaaggacagctggtgcttcctgccctggatgctgttcatctcctggaccagccaccacatcagagatggcatcagacatggcctgtggatctgcccctttgggaagaccagccccctgcccttctggctgtatgtgatcatcaccagcagcctgccccacatctgcagctttgtgatgtacctgaccggcacccggcagatgatgagcagcaagcatggagtgagaattgatgtgtag

SEQ ID NO: 33310 - DNA, 648 bp, Artificial Sequence; identical to SEQ ID NO: 33309
  Description of Artificial Sequence: Synthetic coding sequence

SEQ ID NO: 33311 - DNA, 531 bp, Artificial Sequence
  Description of Artificial Sequence: Synthetic coding sequence
atggccagcgagacagagaagacccacgccctgctgcagacctgcagcacagagagcctcatcagcagcctgggcctgggcgccttctgcctggtggccgaccggctgctgcagttcagcaccatccagcagaatgactggctgcgggccctgagtgacaatgctgtgcactgcgtcatcggcatgtggagctgggccgtggtgacaggcatcaagaagaagacagactttggagagatcatcctggccggcttcctggcctctgtgattgatgtggaccacttcttcctggccggctccatgagcctgaaggccgccctgaccctgccccggcggcccttcctgcactgcagcaccgtcatccctgtggtggtgctgaccctgaagttcaccatgcacctgttcaagctgaaggacagctggtgcttcctgccctggatgctgttcatctcctggaccagccaccacatcagagatggcatcagacatggcctgtggatctgcccctttgggaagaccagccccctgtag

SEQ ID NO: 33312 - DNA, 648 bp, Artificial Sequence; identical to SEQ ID NO: 33309
  Description of Artificial Sequence: Synthetic coding sequence

SEQ ID NO: 33313 - DNA, 255 bp, Artificial Sequence
  Description of Artificial Sequence: Synthetic coding sequence
atgcacctgttcaagctgaaggacagctggtgcttcctgccctggatgctgttcatctcctggaccagccaccacatcagagatggcatccgccacggcctgtggatctgcccctttgggaagaccagccccctgcccttctggctgtatgtgatcatcaccagcagcctgccccacatctgcagctttgtgatgtacctgaccggcacccggcagatgatgagcagcaagcacggcgtgagaattgatgtgtag

SEQ ID NO: 33314 - DNA, 1002 bp, Artificial Sequence
  Description of Artificial Sequence: Synthetic coding sequence
atgaagggggaggccggccacatgctgcacaatgagaagagcaagcaggagggccacatctggggctccatgagaagaacagccttcatcctgggcagcggcctgctgagctttgtggccttctggaacagcgtgacctggcacctgcagcgcttctggggcgccagcggctacttctggcaggcccagtgggagcggctgctgaccacctttgagggcaaggagtggatcctcttcttcatcggggccatccaggtgccctgcctcttcttctggagcttcaacggcctgctgctggtggtggacaccaccgggaagcccaacttcatcagccgctaccgcatccaggtgggcaagaatgaacctgtggaccctgtgaagctgcggcagagcatcagaacagtgctcttcaaccagtgcatgatctccttccccatggtggtgttcctgtaccccttcctgaagtggtggagggacccctgccggcgggagctgcccaccttccactggttcctgctggagctggccatcttcaccctgattgaggaggtgctcttctactacagccaccggctgctgcaccaccccaccttctacaagaagatccacaagaagcaccacgagtggacagcccccatcggggtcatcagcctgtatgcccaccccattgaacatgctgtgagcaacatgctgcccgtcatcgtgggccccctggtgatgggcagccacctgagcagcatcaccatgtggttcagcctggccctgatcatcaccaccatcagccactgcggctaccacctgcccttcctgcccagccctgagttccatgactaccaccacctgaagttcaaccagtgctatggagtgctgggcgtgctggaccacctgcatggaacagacaccatgttcaagcagaccaaggcctatgagcggcacgtgctgctgctgggcttcacccccctgtctgagagcatcccagacagccccaagaggatggagtag

SEQ ID NO: 33315 - DNA, 933 bp, Artificial Sequence
  Description of Artificial Sequence: Synthetic coding sequence
atgagaagaacagccttcatcctgggcagcggcctgctgagctttgtggccttctggaacagcgtgacctggcacctgcagcgcttctggggcgccagcggctacttctggcaggcccagtgggagcggctgctgaccacctttgagggcaaggagtggatcctcttcttcatcggggccatccaggtgccctgcctcttcttctggagcttcaacggcctgctgctggtggtggacaccaccgggaagcccaacttcatcagccgctaccgcatccaggtgggcaagaatgaacctgtggaccctgtgaagctgcggcagagcatcagaacagtgctcttcaaccagtgcatgatctccttccccatggtggtgttcctgtaccccttcctgaagtggtggagggacccctgcagaagagagctgcccaccttccactggttcctgctggagctggccatcttcaccctcatcgaggaggtgctcttctactacagccaccggctgctgcaccaccccaccttctacaagaagatccacaagaagcaccacgagtggacagcccccatcggggtcatcagcctgtatgcccaccccatcgagcacgctgtgagcaacatgctgcctgtgattgtgggccccctggtgatgggcagccacctgagcagcatcaccatgtggttcagcctggccctgatcatcaccaccatcagccactgcggctaccacctgcccttcctgcccagccctgagttccatgactaccaccacctgaagttcaaccagtgctacggcgtgctgggcgtgctggaccacctgcacggcacagacaccatgttcaagcagaccaaggcctatgaaagacatgtgctgctgctgggcttcacccccctgtctgagagcatcccagacagccccaagaggatggagtag

SEQ ID NO: 33316 - DNA, 441 bp, Artificial Sequence
  Description of Artificial Sequence: Synthetic coding sequence
atgagaagaacagccttcatcctgggcagcggcctgctgagctttgtggccttctggaacagcgtgacctggcacctgcagcgcttctggggcgccagcggctacttctggcaggcccagtgggagcggctgctgaccacctttgagggcaaggagtggatcctcttcttcatcggggccatccaggtgccctgcctcttcttctggagcttcaacggcctgctgctggtggtggacaccaccgggaagcccaacttcatcagccgctaccgcatccaggtgggcaagaatgaacctgtggaccctgtgaagctgcggcagagcatcagaacagtgctcttcaaccagtgcatgatctccttccccatggtggtgttcctgtaccccttcctgaagtggtggagggacccctgcagaagagagctgcccaccttccactag

SEQ ID NO: 33317 - DNA, 99 bp, Artificial Sequence
  Description of Artificial Sequence: Synthetic coding sequence
atgaagggggaggccggccacatgctgcacaatgagaagagcaagcaggagggccacatctggggctccatgagaagaacagccttcatcctgggctag

SEQ ID NO: 33318 - DNA, 225 bp, Artificial Sequence
  Description of Artificial Sequence: Synthetic coding sequence
atgtttgacatcaaggcctgggccgagtatgtggtggagtgggccgccaaggacccctacggcttcctgaccaccgtcatcctggccctgacccccctcttcctggccagcgctgtgctgtcctggaagctggccaagatgattgaggcccgggagaaggagcagaagaagaagcagaagaggcaggagaacatcgccaaggccaagaggctgaagaaggactag

SEQ ID NO: 33319 - DNA, 225 bp, Artificial Sequence; identical to SEQ ID NO: 33318
  Description of Artificial Sequence: Synthetic coding sequence

SEQ ID NO: 33320 - DNA, 183 bp, Artificial Sequence
  Description of Artificial Sequence: Synthetic coding sequence
atggatgctgtgtcccaggtgcccatggaggtggtgctgcccaagcacatcctggacatctgggtgattgtgctgatcatcctggccaccatcgtcatcatgaccagcctgctgctgtgcccagccacagctgtgatcatctacaggatgaggacccaccccatcctgtctggagctgtgtag

SEQ ID NO: 33321 - DNA, 1683 bp, Artificial Sequence
  Description of Artificial Sequence: Synthetic coding sequence
tctgtgctgaagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccggggcagcagacatgcctacagcacccagagcgacaccagctatgacaacagagcccgctatgaggcccccttcagccccaagattgagaagctggccatcagcaagagcagcctggccctgccccagggctccatgagcagcatcaagtgcctgcagaccacagaggagcccccctgcatcccctgtgtgatgatcctgatcttctacaacgtgcctgccacccggggcatgggcaaggtggtgaggaagcacatcatgcagaccccaggccccatcggcaagctgcccgtcttctctgtgcgcagccacccccacaccatcaccggcccccccagcgccccccggggcaagcctgtgtccaccctgctgatcagcaacagcgtgtgcagctacctgacccagagcttccagtttcctgaggtgaggaccatcgccaccaagaagagggccaccacccagggcagcgtcatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 33322 - DNA, 1704 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccgggtggagtgccaccacggccagcagaaggagaccagccacaggaagacagagaggaagctgcggcgggagaggaagaggatcaccaatgaaagaaggctgattggaacagagaagagcctgccccagggctccatgagcagcatcaagtgcctgcagaccacagaggagcccccctgcaagggcatgggcaaggtgatccaggccaagcagctgctgaacatctcctggcccctggccgtgtccctgagcaagcccctgtgcatcatccatgatgtgctggagagcttcaagaccatcaacctgcagagccctgctggcttccaggccgtgaccagccactgcaagaagggccgggacaagttcaggaagatcctggtgtacaagaagggcaccagcatcaagggcaagaagattgagatcaagaggaagtacctgatcagcaagagccggccctttgtggtgtgcagcgtcatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagtgatgagtacaccaccaggacaggcagccccaacaaggagaagtgtgtgcgctgcaccaagaggacaggccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagaggcggcagatccaggagggcagcaccaccaagaagtggaagagcaaggacaagttcttcaagggcccctag

SEQ ID NO: 33323 - DNA, 1686 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccggggcagcagacatgcctacagcacccagagcggcaacctgtgcttccagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagccccccagcaggacagctggggccatgatgcagttcaccgcccccatccctggggccaccggccccatcaagctgagccagaagaccatcgtgcagaccccaggccccatcgtgcagtacccaggcagcaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 33324 - DNA, 1692 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagccccccagcaggacagctggggccatgatgcagttcaccgcccccatccctggggccaccggccccatcaagctgagccagaagaccatcgtgcagaccccaggccccatcgtgcagtacccaggcagcaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 33325 - DNA, 1692 bp, Artificial Sequence; identical to SEQ ID NO: 33324
  Description of Artificial Sequence: Synthetic coding sequence

SEQ ID NO: 33326 - DNA, 1689 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggccctgagccgcagcagcatcgccctgccccagggctccatgagcagcatcaagtgcctgcagaccacagaggagccccccagcaggacagctggggccatgatgcagttcaccgcccccatccctggggccaccggccccatcaagctgagccagaagaccatcgtgcagaccccaggccccatcgtgcagtacccaggcagcaatgtgcgcagccacccccacaccatcaccggcccccccagcgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 33327 - DNA, 1686 bp, Artificial Sequence; identical to SEQ ID NO: 33323
  Description of Artificial Sequence: Synthetic coding sequence

SEQ ID NO: 33328 - DNA, 1683 bp, Artificial Sequence; identical to SEQ ID NO: 33321
  Description of Artificial Sequence: Synthetic coding sequence

SEQ ID NO: 33329 - DNA, 1704 bp, Artificial Sequence; identical to SEQ ID NO: 33322
  Description of Artificial Sequence: Synthetic coding sequence

SEQ ID NO: 33330 - DNA, 1644 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccgctgcaagcagagcgagatgtacatcagccgctacagcagcgagcagagcgcccggctgctggactatgaagatggccggggcagcagacatgcctacagcacccagagcgagaggagcaagagggactacacccccagcaccaacagcctggccctgagccgcagcagcatcgccctgccccagggctccatgagcagcatcaagtgcctgcagaccacagaggagccccccagcaggacagctggggccatgatgcagttcaccgcccccatccctggggccaccggccccatcaagctgagccagaagaccatcgtgcagaccccaggccccatcgtgcagtacccaggcagcaatgccggccccccatctgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 33331 - DNA, 306 bp, Artificial Sequence
  Description of Artificial Sequence: Synthetic coding sequence
atggccgccagccgctaccgccgcttcctgaagctgtgtgaggagtggcctgtggatgagaccaagaggggccgggacctgggcgcctacctgcggcagagggtggcccaggccttccgggagggggagaacacccagtacccccggccccgggacaccagcttcagcggcctgagcctggaggagtacaagctgatcctgagcacagacaccctggaggagctgaaggagattgacaagggcatgtggaagaagctgcaggagaagtttgcccccaagggccctgaggaggaccacaaggcctag

SEQ ID NO: 33332 - DNA, 381 bp, Artificial Sequence
  Description of Artificial Sequence: Synthetic coding sequence
atggccgccagccgctaccgccgcttcctgaagctgtgtgaggagtggcctgtggatgagaccaagaggggccgggacctgggcgcctacctgcggcagagggtggcccaggccttccgggagggggagaacacccaggtggccgagcctgaggcctgtgaccagatgtatgagagcctggcccggctgcacagcaactactacaagcacaagtacccccggccccgggacaccagcttcagcggcctgagcctggaggagtacaagctgatcctgagcacagacaccctggaggagctgaaggagattgacaagggcatgtggaagaagctgcaggagaagtttgcccccaagggccctgaggaggaccacaaggcctag

SEQ ID NO: 33333 - DNA, 1491 bp, Artificial Sequence
  Description of Artificial Sequence: Synthetic coding sequence
atgtaccagcccagcagaggagctgcccggcggctgggcccctgcctgcgggcctaccaggcccggccccaggtgtctggaggagaggagggcggcagaagaggaggaggagagcggcccagcagcaagcctgtgagaggagctgagcgggccctgggcagcgcccaggcccagaggcaccccccacccctgcccacctgtgccctgcagagggtggaccggctgggcgtggccggggccggcggccgccgctgccgggcctgccgggcccggacctctgtgctgcccggcctgcgggctgtgcggcggggccagggccaggccgccggccgggtgtgtgtggccccagacagcccccggctgcctgtgcccaggggggacctgaagggccggggccgggagatccgcagccctgctgctgcccccagccgcagcagccctgcccagaccaggcctgctggccggccccagcagcctgcccggctggccctgggggagaggtcctggcaggagggccggcctgtgtgcaccaggtttggccccctgcggcccggctggcaggacggccacgcccccagcagagatggagccagcaggacccccagcggcacagaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggaaaaggagaggagggccctggccctgagctgcacagcggctgcctggatggcctgcggagcctgtttgagggccccccctgcccctacccaggggcctggatccccttccaggtgcctggaacagcccaccccagccctgccacccccagcggggaccccagcatggaggagcacctgtctgtgatgtatgagcggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 33334 - DNA, 546 bp, Artificial Sequence
  Description of Artificial Sequence: Synthetic coding sequence
atgtaccagcccagcagaggagctgcccggcggctgggcccctgcctgcgggcctaccaggcccggccccagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 33335 - DNA, 948 bp, Artificial Sequence
  Description of Artificial Sequence: Synthetic coding sequence
atgtaccagcccagcagaggagctgcccggcggctgggcccctgcctgcgggcctaccaggcccggccccaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggcaagggggaggagggccctggccctgagctgcacagcggctgcctggatggcctgcggagcctgtttgagggccccccctgcccctacccaggggcctggatccccttccaggtgcccggcacagcccaccccagccctgccaccccatctggggaccccagcatggaggagcacctgtctgtgatgtatgaaaggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 33336 - DNA, 519 bp, Artificial Sequence
  Description of Artificial Sequence: Synthetic coding sequence
atggaggagcacctgtctgtgatgtatgagcggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 33337 - DNA, 2541 bp, Artificial Sequence
  Description of Artificial Sequence: Synthetic coding sequence
atgtgcttcctgcggcggcctggggccccagcctcctggatctggtggaggatgctgcggcaggtgctgcggcggggcctgcagagcttctgccaccggctgggcctgtgtgtgagccgccaccctgtgttcttcctgactgtgcctgctgtgctgaccatcaccttcggcctgagcgccctgaaccgcttccagcctgagggggacctggagcggctggtggcccccagccacagcctggccaagattgaaagaagcctggccagcagcctcttccccctggaccagagcaagagccagctgtacagcgacctgcacaccccaggccgctatggccgggtcatcctgctgagccccaccggggacaacatcctgctgcaggccgagggcatcctgcagacccacagagctgtgctggagatgaaggatggaagaaattccttcatcggccaccagctgggcggcgtggtggaggtgcccaacagcaaggaccagagggtgaagagcgcccgggccatccagatcacctactacctgcagacctacggcagcgccacccaggacctgattggagagaagtgggagaatgagttctgcaagctgatcaggaagctgcaggaggagcaccaggagctgcagctgtacagcctggccagcttcagcctgtggagggacttccacaagaccagcatcctggcccggagcaaggtgctggtgtccctggtgctgatcctgaccacagccaccctgagcagctccatgaaggactgcctgcggagcaagcccttcctgggcctgctgggcgtgctgactgtgtgcatcagcatcatcacagctgctggcatcttcttcatcacagatggcaagtacaacagcaccctgctgggcatccccttctttgccatgggccacggcaccaagggcgtgtttgagctgctgagcggctggaggaggaccaaggagaacctgcccttcaaggacagaattgctgatgcctacagtgatgtgatggtgacctacaccatgaccagcagcctgtacttcatcaccttcggcatgggcgccagccccttcaccaacattgaagctgtgaaggtgttctgccagaacatgtgtgtgtccatcctgctgaactacttctacatcttctccttcttcggcagctgcctggtgtttgctggccagctggagcagaaccgctaccacagcatcttctgctgcaagatccccagcgctgagtacctggacaggaagcctgtgtggttccagacagtgatgtctgatggccaccagcagaccagccaccacgagaccaacccctaccagcaccacttcatccagcacttcctgcgggagcactacaatgagtggatcaccaacatctacgtgaagccctttgtggtgatcctgtacctgatctatgccagcttctccttcatgggctgcctgcagatcagtgatggagccaacatcatcaacctgctggccagtgacagccccagcgtgtcctatgccatggtgcagcagaagtacttcagcaactacagccctgtgattggcttctacgtgtatgagcccctggagtactggaacagctctgtgcaggatgacctgcggcggctgtgcagcggcttcaccgctgtgtcctgggtggagcagtactaccagttcctgaaggtgtccaatgtgtctgccaacaacaagagtgacttcatctctgtgctgcagagcagcttcctgaagaagccagagttccagcacttcagaaatgacatcatcttcagcaaggctggagatgagagcaacatcatcgccagccggctgtacctggtggcccggaccagccgggacaagcagaaggagatcacagaggtgctggagaagctgcggcccctgagcctgagcaagagcatccgcttcatcgtgttcaaccccagctttgtgttcatggaccactacagcctgtctgtgacagtgcctgtgctgattgctggcttcggcgtgctgctggtgctgatcctgaccttcttcctggtgatccaccccctgggcaacttctggctgatcctgtctgtgaccagcattgagctgggcgtgctgggcctgatgaccctgtggaatgtggacatggactgcatcagcatcctgtgcctgatctacaccctgaactttgccatcgaccactgtgcccccctgctcttcacctttgtgctggccacagagcacaccaggacccagtgcatcaagagcagcctgcaggaccatggaacagccatcctgcagaatgtgaccagcttcctgattggcctggtgcccctgctgtttgtgcccagcaacctgaccttcaccctcttcaagtgcctgctgctgactggaggctgcaccctgctgcactgcttcgtcatcctgcccgtcttcctgaccttcttcccccccagcaagaagcaccacaagaagaagaagagggccaagaggaaggagcgggaggagattgagtgcatcgagatccaggagaacccagaccacgtgaccaccgtgtag

SEQ ID NO: 33338 - DNA, 936 bp, Artificial Sequence
  Description of Artificial Sequence: Synthetic coding sequence
tgatgcttcctgcggcggcctggggccccagcctcctggatctggtggaggatgctgcggcaggtgctgcggcggggcctgcagagcttctgccaccggctgggcctgtgtgtgagccgccaccctgtgttcttcctgactgtgcctgctgtgctgaccatcaccttcggcctgagcgccctgaaccgcttccagcctgagggggacctggagcggctggtggcccccagccacagcctggccaagattgaaagaagcctggccagcagcctcttccccctggaccagagcaagagccagctgtacagcgacctgcacaccccaggccgctatggccgggtcatcctgctgagccccaccggggacaacatcctgctgcaggccgagggcatcctgcagacccacagagctgtgctggagatgaaggatggaagaaattccttcatcggccaccagctgggcggcgtggtggaggtgcccaacagcaaggaccagagggtgaagagcgcccgggccatccagatcacctactacctgcagacctacggcagcgccacccaggacctgattggagagaagtgggagaatgagttctgcaagctgatcaggaagctgcaggaggagcaccaggagctgcagctgtacagcctggccagcttcagcctgtggagggacttccacaagaccagcatcctggcccggagcaaggtgctggtgtccctggtgctgatcctgaccacagccaccctgagcagctccatgaaggactgcctgcggagcaagcccttcctgggcctgctgggcgtgctgactgtgtgcatcagcatcatcacagctgctggcatcttcttcatcacagatggcaagtacaacagcaccctgctgggcatccccttctttgccatgggcatcagcacagagttcaccagcagctag

SEQ ID NO: 33339 - DNA, 885 bp, Artificial Sequence
  Description of Artificial Sequence: Synthetic coding sequence
atgctgcggcaggtgctgcggcggggcctgcagagcttctgccaccggctgggcctgtgtgtgagccgccaccctgtgttcttcctgactgtgcctgctgtgctgaccatcaccttcggcctgagcgccctgaaccgcttccagcctgagggggacctggagcggctggtggcccccagccacagcctggccaagattgaaagaagcctggccagcagcctcttccccctggaccagagcaagagccagctgtacagcgacctgcacaccccaggccgctatggccgggtcatcctgctgagccccactggagacaacatcctgctgcaggccgagggcatcctgcagacccacagagctgtgctggagatgaaggatggcaggaacagcttcatcggccaccagctgggcggcgtggtggaggtgcccaacagcaaggaccagagggtgaagagcgcccgggccatccagatcacctactacctgcagacctacggcagcgccacccaggacctgattggagagaagtgggagaatgagttctgcaagctgatcaggaagctgcaggaggagcaccaggagctgcagctgtacagcctggccagcttcagcctgtggagggacttccacaagaccagcatcctggcccggagcaaggtgctggtgtccctggtgctgatcctgaccacagccaccctgagcagctccatgaaggactgcctgcggagcaagcccttcctgggcctgctgggcgtgctgactgtgtgcatcagcatcatcacagctgctggcatcttcttcatcacagatggcaagtacaacagcaccctgctgggcatccccttctttgccatgggcatcagcacagagttcaccagcagctag

SEQ ID NO: 33340 - DNA, 339 bp, Artificial Sequence
  Description of Artificial Sequence: Synthetic coding sequence
atgcaggacaccggctctgtggtgcccctgcactggtttggatttggctacgccgccctggtggccagcggcggcatcatcggctacgtgaaggccggctctgtgcccagcctggccgccggcctgctgtttggcagcctggccggcctgggcgcctaccagctgagccaggaccccagaaatgtgtgggtgttcctggccaccagcggcaccctggccggcatcatgggcatgaggttctaccacagcggcaagttcatgcctgctggcctgattgctggggccagcctgctgatggtggccaaggtgggcgtgtccatgttcaaccggccccactag

SEQ ID NO: 33341 - DNA, 294 bp, Artificial Sequence
  Description of Artificial Sequence: Synthetic coding sequence
atgagcagcgcccctgagccccccaccttcaagaaggagccccccaaggagaaggagttccagagccctggcctgcggggcgtgaggaccaccaccctcttccgggctgtgaaccctgagctgttcatcaagcccaacaagcctgtgatggccttcggcctggtgaccctgagcctgtgtgtggcctacatcggctacctgcacgccatccaggagaacaagaaggacctgtatgaggccattgattctgagggccacagctacatgaggaggaagaccagcaagtgggactag

SEQ ID NO: 33342 - DNA, 2844 bp, Artificial Sequence
  Description of Artificial Sequence: Synthetic coding sequence
atgagccagccccccatcggcggggccgccccagccacagctgctgccagccctgctgctgctgccacagaggcccggctgcaccctgagggcagcagcaggaagcagcagagggcccagagccctgcccggccccgggacagcagcctgcggcagaccatcgccgccaccaggagccctgtgggcgccggcaccaagctgaacagcgtgcggcagcagcagctgcagcagcagcagcagcagggcaacaagacaggcagcaggactggacctccagccagcatccggggcggcggcggcggcgctgagaaggccacccccctggcccccaagggagctgcccctggagctgtgcagcctgtggccggggctgaggccgccccagctgccaccctggccgccctgggcggccggcggcccggccccccagaggagcccccccgggagctggagagcgtgcccagcaagctgggggagcccccacccctgggggagggcggcggcggcggcggggagggcggcggggccggcggcggcagcggggagcgggagggcggggccccccagcccccaccaccccggggctggagaggaaaaggagtgcgggcccagcagagaggaggcagcggcggggagggcgccagccccagccccagcagcagcagcgctgggaagaccccaggcaccggcagcaggaacagcggcagcggcgtggccggcggcggcagcggcggcggcggcagctactggaaggagggctgcctgcagagcgagctgatccagttccacctgaagaaggagagagctgctgctgctgctgctgctgcccagatgcacgccaagaatggaggcggcagcagcagccgcagcagccctgtgtctggccccccagctgtgtgtgagaccctggccgtggccagcgccagccccatggctgctgctgctgagggcccccagcagagcgctgagggcagcgccagcggcggcggcatgcaggccgccgccccacccagcagccagccccacccccagcagctgcaggagcaggaggagatgcaggaggagatggagaagctgcgggaggagaatgagaccctgaagaatgaaattgatgagctgaggacagagatggatgagatgagggacaccttctttgaagaagatgcctgccagctgcaggagatgagacatgagctggagcgggccaacaagaactgccgcatcctgcagtaccgcctgaggaaggccgagaggaagaggctgcgctatgcccagacaggagaaattgatggagagctgctgcggagcctggagcaggacctgaaggtggccaaggatgtgtctgtgcggctgcaccacgagctggagaatgtggaggagaagaggaccaccacagaagatgaaaatgagaagctgcggcagcagctgattgaggtggagatcgccaagcaggccctgcagaatgagctggagaagatgaaggagctgagcctgaagaggcggggcagcaaggacctgcccaagtctgagaagaaggcccagcagacccccacagaggaggacaatgaagacctgaagtgccagctgcagtttgtgaaggaggaggccgccctgatgaggaagaagatggccaagattgacaaggagaaggacagatttgaacatgagctgcagaagtaccgctccttctacggggacctggacagccccctgcccaagggggaggccggcggcccccccagcacccgggaggccgagctgaagctgcggctgcggctggtggaggaggaggccaacatcctgggcaggaagatcgtggagctggaggtggagaacagaggcctgaaggccgagctggatgacctgcggggagatgacttcaacggcagcgccaaccccctgatgagggagcagagcgagagcctgtctgagctgcggcagcacctgcagctggtggaggatgaaacagagctgctgcggagaaatgtggccgacctggaggagcagaacaagaggatcacagctgagctgaacaagtacaagtacaagagcggcggccatgattctgcccggcaccacgacaatgccaagacagaggccctgcaggaggagctgaaggccgcccggctgcagatcaatgagctgagcggcaaggtgatgcagctgcagtatgaaaatagagtgctgatgagcaacatgcagagatatgacctggccagccacctgggcatccggggcagcccccgggacagtgatgctgagagtgatgctgggaagaaggagagtgatgatgacagccggcccccccacaggaagcgggagggccccatcggcggggagagtgacagcgaggaggtgaggaacatccgctgcctgacccccaccaggagcttctacccagcccctggcccctggcccaagagcttcagtgaccggcagcagatgaaggacatccgctctgaggccgagcggctgggcaagaccatcgaccggctgattgctgacaccagcaccatcatcacagaggcccgcatctacgtggccaatggagacctgtttggcctgatggatgaagaagatgatggcagccgcatccgggagcacgagctgctgtaccgcatcaatgcccagatgaaggccttcaggaaggagctgcagaccttcatcgaccggctggaggtgcccaagtctgcagatgacagaggagctgaggagcccatctctgtgtcccagatgttccagcccatcatcctgctgatcctgatcctggtgctcttcagcagcctgagctacaccaccatcttcaagctggtgttcctgttcaccctcttctttgtgctgtag

SEQ ID NO: 33343 - DNA, 33 bp, Artificial Sequence
  Description of Artificial Sequence: Synthetic coding sequence
atgagccagccccccatcggcggggccgcctag

SEQ ID NO: 33344 - DNA, 2844 bp, Artificial Sequence; identical to SEQ ID NO: 33342
  Description of Artificial Sequence: Synthetic coding sequence

SEQ ID NO: 33345 - DNA, 2844 bp, Artificial Sequence; identical to SEQ ID NO: 33342
  Description of Artificial Sequence: Synthetic coding sequence

SEQ ID NO: 33346 - DNA, 387 bp, Artificial Sequence
  Description of Artificial Sequence: Synthetic coding sequence
atggccctgcaggtgcgggtggcccccagcaaggtggtgctgcagaagttcctgctgtgtgtgatcctcttctacacagtgtactacgtgtccctgtccatgggctgtgtgatgtttgaggtgcatgagctgaatgtgctggccccctttgacttcaagaccaaccccagctggctgaacatcaactacaaggtgctgctggtgtccacagaggtgacctactttgtgtgtggcctcttctttgtgcctgtggtggaggagtgggtgtgggactatgccatctctgtgaccatcctgcacgtggccatcaccagcacagtgatgctggagttccccctgaccagccactggtgggccgccctgggcatcagcaagctgctggtgtag

SEQ ID NO: 33347 - DNA, 387 bp, Artificial Sequence; identical to SEQ ID NO: 33346
  Description of Artificial Sequence: Synthetic coding sequence

SEQ ID NO: 33348 - DNA, 723 bp, Artificial Sequence
  Description of Artificial Sequence: Synthetic coding sequence
atggccatggcctctgtgaagctgctggccggcgtgctgaggaagccagatgcctggattggcctgtggggcgtgctgcggggcacccccagcagctacaagctgtgcacctcctggaaccgctacctgtacttcagcagcaccaagctgcgggcccccaactacaagaccctcttctacaacatcttcagcctgcggctgcccggcctgctgctgagccctgagtgcatcttccccttctctgtgcggctgaagagcaacatccgcagcaccaagagcaccaagaagagcctgcagaaggtggatgaggaggacagtgatgaggagagccaccatgatgagatgtctgagcaggaggaggagctggaggatgaccccaccgtggtgaagaactacaaggacctggagaaggctgtgcagagcttccgctatgatgtggtgctgaagacaggcctggacatcggcaggaacaaggtggaggatgccttctacaagggggagctgcggctgaatgaggagaagctgtggaagaagagcaggacagtgaaggtgggggacaccctggacctgctgattggagaggacaaggaggccggcacagagaccgtgatgaggatcctgctgaagaaggtgtttgaggagaagacagagagcgagaagtacagagtggtgctgcggcgctggaagagcctgaagctgcccaagaagaggatgagcaagtag

SEQ ID NO: 33349 - DNA, 723 bp, Artificial Sequence; identical to SEQ ID NO: 33348
  Description of Artificial Sequence: Synthetic coding sequence

SEQ ID NO: 33350 - DNA, 738 bp, Artificial Sequence
  Description of Artificial Sequence: Synthetic coding sequence
atgatcatcagcgccatggccatggcctctgtgaagctgctggccggcgtgctgaggaagccagatgcctggattggcctgtggggcgtgctgcggggcacccccagcagctacaagctgtgcacctcctggaaccgctacctgtacttcagcagcaccaagctgcgggcccccaactacaagaccctcttctacaacatcttcagcctgcggctgcccggcctgctgctgagccctgagtgcatcttccccttctctgtgcggctgaagagcaacatccgcagcaccaagagcaccaagaagagcctgcagaaggtggatgaagaagattctgatgaggagagccaccatgatgagatgtctgagcaggaggaggagctggaggatgaccccaccgtggtgaagaactacaaggacctggagaaggctgtgcagagcttccgctatgatgtggtgctgaagacaggcctggacattggaagaaacaaggtggaggatgccttctacaagggggagctgcggctgaatgaggagaagctgtggaagaagagcaggacagtgaaggtgggggacaccctggacctgctgattggagaggacaaggaggccggcacagaaacagtgatgaggatcctgctgaagaaggtgtttgaggagaagacagaaagtgagaagtacagagtggtgctgcggcgctggaagagcctgaagctgcccaagaagaggatgagcaagtag

SEQ ID NO: 33351 - DNA, 582 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacgccctgagccccccccacagcagcacctgtgaaaatagagcccctgaggccagcaaaggaggccgggcccaggacagccggggccctggccctggaacagagcccgccctgtgtggcagcggccccagcagcccccagcaggcccctcctgctgtgcacagcggcccctgctag

SEQ ID NO: 33352 - DNA, 654 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggggcctgccccaggaacagatttgaccacagcctggacctgctgtgccccccccacatcgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 33353 - DNA, 726 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggctctgtgtacccccagctgctgatccccctgctgggcgccggcctggtgctgggcctgggcgccctgggcctggtgtggtggctgcaccggcggctgcccccccagcccatccggcccctgcccaggtttgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 33354 - DNA, 714 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggctctgtgtacccccagctgctgatccccctgctgggcgccggcctggtgctgggcctgggcgccctgggcctggtgtggtggctgcaccggcggctgcccccccagcccatccggcccctgcccaggtttgccctgagccccccccacagcagcacctgtgaaaatagagcccctgaggccagcaaaggaggccgggcccaggacagccggggccctggccctggaacagagcccgccctgtgtggcagcggccccagcagcccccagcaggcccctcctgctgtgcacagcggcccctgctag

SEQ ID NO: 33355 - DNA, 669 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacggctctgtgtacccccagctgctgatccccctgctgggcgccggcctggtgctgggcctgggcgccctgggcctggtgtggtggctgcaccggcggctgcccccccagcccatccggcccctgcccaggtttgccctgagccccccccacagcagcacctgtgaaaatagagcccctgaggccagcaaaggaggccgggcccaggacagccggggccctggccctggcaccgggaagggcatgggcatgggccggggctag

SEQ ID NO: 33356 - DNA, 594 bp, Artificial Sequence
  Description of Artificial Sequence: Synthetic coding sequence
atggctgtgttcctgcagctgctgcccctgctgctgagccgggcccagggcaaccctggggccagcctggatggccggcctggggacagagtgaacctgagctgtggcggcgtgagccaccccatccgctgggtgtgggcccccagcttccctgcctgcaagggcctgagcaagggccggcggcccatcctgtgggccagcagcagcggcacccccaccgtgccccccctgcagccctttgtgggccgcctgcggagcctggacagcggcatccggcggctggagctgctgctgtctgctggggacagcggcaccttcttctgcaagggcagacatgaagatgagagcaggacagtgctgcacgtgctgggggacaggacctactgcaaggcccctggccccacccacgcccccctggtgaagacagagccccagaggcctgtgaaggaggaggagcccaagatccctggggacctggaccaggagcccagcctgctgtatgctgacctggaccacctggccctgagccggccccggcggctgagcacagctgaccctgcagatgccagcaccatctatgctgtggtggtgtag

SEQ ID NO: 33357 - DNA, 594 bp, Artificial Sequence; identical to SEQ ID NO: 33356
  Description of Artificial Sequence: Synthetic coding sequence

SEQ ID NO: 33358 - DNA, 654 bp, Artificial Sequence; identical to SEQ ID NO: 33352
  Description of Artificial Sequence: Synthetic coding sequence

SEQ ID NO: 33359 - DNA, 714 bp, Artificial Sequence; identical to SEQ ID NO: 33354
  Description of Artificial Sequence: Synthetic coding sequence

SEQ ID NO: 33360 - DNA, 582 bp, Artificial Sequence; identical to SEQ ID NO: 33351
  Description of Artificial Sequence: Synthetic coding sequence

SEQ ID NO: 33361 - DNA, 726 bp, Artificial Sequence; identical to SEQ ID NO: 33353
  Description of Artificial Sequence: Synthetic coding sequence

SEQ ID NO: 33362 - DNA, 726 bp, Artificial Sequence; identical to SEQ ID NO: 33353
  Description of Artificial Sequence: Synthetic coding sequence

SEQ ID NO: 33363 - DNA, 594 bp, Artificial Sequence; identical to SEQ ID NO: 33356
  Description of Artificial Sequence: Synthetic coding sequence

SEQ ID NO: 33364 - DNA, 582 bp, Artificial Sequence; identical to SEQ ID NO: 33351
  Description of Artificial Sequence: Synthetic coding sequence

SEQ ID NO: 33365 - DNA, 654 bp, Artificial Sequence; identical to SEQ ID NO: 33352
  Description of Artificial Sequence: Synthetic coding sequence

SEQ ID NO: 33366 - DNA, 582 bp, Artificial Sequence; identical to SEQ ID NO: 33351
  Description of Artificial Sequence: Synthetic coding sequence

SEQ ID NO: 33367 - DNA, 714 bp, Artificial Sequence; identical to SEQ ID NO: 33354
  Description of Artificial Sequence: Synthetic coding sequence

SEQ ID NO: 33368 - DNA, 714 bp, Artificial Sequence; identical to SEQ ID NO: 33354
  Description of Artificial Sequence: Synthetic coding sequence

SEQ ID NO: 33369 - DNA, 594 bp, Artificial Sequence; identical to SEQ ID NO: 33356
  Description of Artificial Sequence: Synthetic coding sequence

SEQ ID NO: 33370 - DNA, 654 bp, Artificial Sequence; identical to SEQ ID NO: 33352
  Description of Artificial Sequence: Synthetic coding sequence

SEQ ID NO: 33371 - DNA, 726 bp, Artificial Sequence; identical to SEQ ID NO: 33353
  Description of Artificial Sequence: Synthetic coding sequence

SEQ ID NO: 33372 - DNA, 582 bp, Artificial Sequence; identical to SEQ ID NO: 33351
  Description of Artificial Sequence: Synthetic coding sequence

SEQ ID NO: 33373 - DNA, 582 bp, Artificial Sequence; identical to SEQ ID NO: 33351
  Description of Artificial Sequence: Synthetic coding sequence

SEQ ID NO: 33374 - DNA, 714 bp, Artificial Sequence; identical to SEQ ID NO: 33354
  Description of Artificial Sequence: Synthetic coding sequence

SEQ ID NO: 33375 - DNA, 654 bp, Artificial Sequence; identical to SEQ ID NO: 33352
  Description of Artificial Sequence: Synthetic coding sequence

SEQ ID NO: 33376 - DNA, 726 bp, Artificial Sequence; identical to SEQ ID NO: 33353
  Description of Artificial Sequence: Synthetic coding sequence

SEQ ID NO: 33377 - DNA, 594 bp, Artificial Sequence; identical to SEQ ID NO: 33356
  Description of Artificial Sequence: Synthetic coding sequence

SEQ ID NO: 33378 - DNA, 714 bp, Artificial Sequence; identical to SEQ ID NO: 33354
  Description of Artificial Sequence: Synthetic coding sequence

SEQ ID NO: 33379 - DNA, 594 bp, Artificial Sequence; identical to SEQ ID NO: 33356
  Description of Artificial Sequence: Synthetic coding sequence

SEQ ID NO: 33380 - DNA, 654 bp, Artificial Sequence; identical to SEQ ID NO: 33352
  Description of Artificial Sequence: Synthetic coding sequence

SEQ ID NO: 33381 - DNA, 726 bp, Artificial Sequence; identical to SEQ ID NO: 33353
  Description of Artificial Sequence: Synthetic coding sequence

SEQ ID NO: 33382 - DNA, 981 bp, Artificial Sequence
  Description of Artificial Sequence: Synthetic coding sequence
atggagttcctgtgggacttcctgaaccaccaggagggcccccgcatccgggaccacctgagccacggggagatcaacctgcacgagttcagcaaggagaccaccaaccagctgctggccttcagcctggtgctgctgctgcgctttgtggatgactgcctgctgagcgtcttcaaggagaagtctgctgtggagctgctgatcagcctggccgagggctacagcagccgctgccaccctgtgttccagctgaagaagcaggtgctgagctgtgaggagagcatccgggtgtgggccctgctgcccttccctgaggagctgacccggcaggccgtgcggctggaggacaacagcgagaccaatgcctgccacagcctcatcaccaagatgacagatgagctgtaccaccacatgcctgagaacagatgtgtgctgaaggacctggaccggctgcccacagagacctggccccagctgctgcgggagctgtgcagcacccctgtgcccaccctcttctgcccccgcatcgtgctggaggtgctggtggtgctgcggagcatcagcgagcagtgccggcgggtgagcagccaggtgacagtggccagcgagctgcggcaccggcagtgggtggagaggaccctgcggagccggcagaggcagaactacctgaggatgtggagcagcatccggctgctgagccctgtgctgagcctcatcctgctgctgattgccctggagctggtgaacatccatgctgtgtgtgggaagaatgcccacgagtaccagcagtacctgaagtttgtgaagagcatcctgcagtacacagagaacctggtggcctacaccagctatgagaagaacaagtggaatgagaccatcaacctgacccacacagccctgctgaagatgtggaccttcagcgagaagaagcagatgctgatccacctggccaagaagagcaccagcaaggtgctgctgtag

SEQ ID NO: 33383 - DNA, 1896 bp, Artificial Sequence
  Description of Artificial Sequence: Synthetic coding sequence
atggaggtgctgattggagaccccatcaccacctgcctgagccccagcgtgtatgacatcatctgcaacctgggcttccagctgcgggagaactgtgacatcaacagcatcgtgacccagaatggagaggtgtgctggaagaccatcacagactgtgtgtcctacacagagagcgagcagggcctggactactggggctctgtgcggctgctgggccctgtgtgtgaggccgtgcacagccacttcctgagcctgaccaagggccagtttgagatccgctatgccccctggttccagtggaccagcttccctgagctgtttcctgagatctttgatgccctggagagcctgcagagccctgccatcagcctgagcctgatgaagctgaccagctgcctggagcgggccctgggagatgtgttcctgctgattggcaaggaatgtcccttcctgctgcgggacctgctgagcagcgaggagctggcccaggtgttcagccagagcgtgatgaatgtgctgaaggtgtttgtgggcagcccctgtggcctgaacctgagaaatgtgctgtggcacggctttgccagccctgaggagatcccccccaagtactgcagcatgatgatcctgctgacagctggcctgggccagctgctgaagagctacctgcagaacaccaagctgaccctggcccaccgctccttcatcagcctgaccaacctggaggacctgattgtgtttcctgatgtgacctatgaggtgctgtctgtgctggaggaggtgatgatgaagagcgccttcatcctgaagatcatgctgccctactgggaggtggccctggtgaagttcaagagccacagatttgctgactgtgccatcctgctgctgacccagctggagaccggcctgagaaatgtgtttgccaccctgaaccgctgccccaagaggctgctgacagctgagagcacagccctgtacaccacctttgaccagatcctggccaagcacctgaatgatggcaagatcaaccagctgcccctcttcctgggggagcccgccatggagttcctgtgggacttcctgaaccaccaggagggcccccgcatccgggaccacctgagccacggggagatcaacctgcacgagttcagcaaggagaccaccaaccagctgctggccttcagcctggtgctgctgctgcgctttgtggatgactgcctgctgagcgtcttcaaggagaagtctgctgtggagctgctgatcagcctggccgagggctacagcagccgctgccaccctgtgttccagctgaagaagcaggtgctgagctgtgaggagagcatccgggtgtgggccctgctgcccttccctgaggagctgacccggcaggccgtgcggctggaggacaacagcgagaccaatgcctgccacagcctcatcaccaagatgacagatgagctgtaccaccacatgcctgagaacagatgtgtgctgaaggacctggaccggctgcccacagagacccccaccagtgacacccccctggccctggcccccaggaagccccagccctgccgctgcagaagaagagtgcggcccagcatccggctgctgagccctgtgctgagcctcatcctgctgctgattgccctggagctggtgaacatccatgctgtgtgtgggaagaatgcccacgagtaccagcagtacctgaagtttgtgaagagcatcctgcagtacacagagaacctggtggcctacaccagctatgagaagaacaagtggaatgagaccatcaacctgacccacacagccctgctgaagatgtggaccttcagcgagaagaagcagatgctgatccacctggccaagaagagcaccagcaaggtgctgctgtag

SEQ ID NO: 33384 - DNA, 2037 bp, Artificial Sequence
  Description of Artificial Sequence: Synthetic coding sequence
atggaggtgctgattggagaccccatcaccacctgcctgagccccagcgtgtatgacatcatctgcaacctgggcttccagctgcgggagaactgtgacatcaacagcatcgtgacccagaatggagaggtgtgctggaagaccatcacagactgtgtgtcctacacagagagcgagcagggcctggactactggggctctgtgcggctgctgggccctgtgtgtgaggccgtgcacagccacttcctgagcctgaccaagggccagtttgagatccgctatgccccctggttccagtggaccagcttccctgagctgtttcctgagatctttgatgccctggagagcctgcagagccctgccatcagcctgagcctgatgaagctgaccagctgcctggagcgggccctgggagatgtgttcctgctgattggcaaggaatgtcccttcctgctgcgggacctgctgagcagcgaggagctggcccaggtgttcagccagagcgtgatgaatgtgctgaaggtgtttgtgggcagcccctgtggcctgaacctgagaaatgtgctgtggcacggctttgccagccctgaggagatcccccccaagtactgcagcatgatgatcctgctgacagctggcctgggccagctgctgaagagctacctgcagaacaccaagctgaccctggcccaccgctccttcatcagcctgaccaacctggaggacctgattgtgtttcctgatgtgacctatgaggtgctgtctgtgctggaggaggtgatgatgaagagcgccttcatcctgaagatcatgctgccctactgggaggtggccctggtgaagttcaagagccacagatttgctgactgtgccatcctgctgctgacccagctggagaccggcctgagaaatgtgtttgccaccctgaaccgctgccccaagaggctgctgacagctgagagcacagccctgtacaccacctttgaccagatcctggccaagcacctgaatgatggcaagatcaaccagctgcccctcttcctgggggagcccgccatggagttcctgtgggacttcctgaaccaccaggagggcccccgcatccgggaccacctgagccacggggagatcaacctgcacgagttcagcaaggagaccaccaaccagctgctggccttcagcctggtgctgctgctgcgctttgtggatgactgcctgctgagcgtcttcaaggagaagtctgctgtggagctgctgatcagcctggccgagggctacagcagccgctgccaccctgtgttccagctgaagaagcaggtgctgagctgtgaggagagcatccgggtgtgggccctgctgcccttccctgaggagctgacccggcaggccgtgcggctggaggacaacagcgagaccaatgcctgccacagcctcatcaccaagatgacagatgagctgtaccaccacatgcctgagaacagatgtgtgctgaaggacctggaccggctgcccacagagacctggccccagctgctgcgggagctgtgcagcacccctgtgcccaccctcttctgcccccgcatcgtgctggaggtgctggtggtgctgcggagcatcagcgagcagtgccggcgggtgagcagccaggtgacagtggccagcgagctgcggcaccggcagtgggtggagaggaccctgcggagccggcagaggcagaactacctgaggatgtggagcagcatccggctgctgagccctgtgctgagcctcatcctgctgctgattgccctggagctggtgaacatccatgctgtgtgtgggaagaatgcccacgagtaccagcagtacctgaagtttgtgaagagcatcctgcagtacacagagaacctggtggcctacaccagctatgagaagaacaagtggaatgagaccatcaacctgacccacacagccctgctgaagatgtggaccttcagcgagaagaagcagatgctgatccacctggccaagaagagcaccagcaaggtgctgctgtag

SEQ ID NO: 33385 - DNA, 1659 bp, Artificial Sequence
  Description of Artificial Sequence: Synthetic coding sequence
atgaagctgaccagctgcctggagcgggccctgggagatgtgttcctgctgattggcaaggaatgtcccttcctgctgcgggacctgctgagcagcgaggagctggcccaggtgttcagccagagcgtgatgaatgtgctgaaggtgtttgtgggcagcccctgtggcctgaacctgagaaatgtgctgtggcacggctttgccagccctgaggagatcccccccaagtactgcagcatgatgatcctgctgacagctggcctgggccagctgctgaagagctacctgcagaacaccaagctgaccctggcccaccgctccttcatcagcctgaccaacctggaggacctgattgtgtttcctgatgtgacctatgaggtgctgtctgtgctggaggaggtgatgatgaagagcgccttcatcctgaagatcatgctgccctactgggaggtggccctggtgaagttcaagagccacagatttgctgactgtgccatcctgctgctgacccagctggagaccggcctgagaaatgtgtttgccaccctgaaccgctgccccaagaggctgctgacagctgagagcacagccctgtacaccacctttgaccagatcctggccaagcacctgaatgatggcaagatcaaccagctgcccctcttcctgggggagcccgccatggagttcctgtgggacttcctgaaccaccaggagggcccccgcatccgggaccacctgagccacggggagatcaacctgcacgagttcagcaaggagaccaccaaccagctgctggccttcagcctggtgctgctgctgcgctttgtggatgactgcctgctgagcgtcttcaaggagaagtctgctgtggagctgctgatcagcctggccgagggctacagcagccgctgccaccctgtgttccagctgaagaagcaggtgctgagctgtgaggagagcatccgggtgtgggccctgctgcccttccctgaggagctgacccggcaggccgtgcggctggaggacaacagcgagaccaatgcctgccacagcctcatcaccaagatgacagatgagctgtaccaccacatgcctgagaacagatgtgtgctgaaggacctggaccggctgcccacagagacctggccccagctgctgcgggagctgtgcagcacccctgtgcccaccctcttctgcccccgcatcgtgctggaggtgctggtggtgctgcggagcatcagcgagcagtgccggcgggtgagcagccaggtgacagtggccagcgagctgcggcaccggcagtgggtggagaggaccctgcggagccggcagaggcagaactacctgaggatgtggagcagcatccggctgctgagccctgtgctgagcctcatcctgctgctgattgccctggagctggtgaacatccatgctgtgtgtgggaagaatgcccacgagtaccagcagtacctgaagtttgtgaagagcatcctgcagtacacagagaacctggtggcctacaccagctatgagaagaacaagtggaatgagaccatcaacctgacccacacagccctgctgaagatgtggaccttcagcgagaagaagcagatgctgatccacctggccaagaagagcaccagcaaggtgctgctgtag

SEQ ID NO: 33386 - DNA, 1818 bp, Artificial Sequence
  Description of Artificial Sequence: Synthetic coding sequence
atggaggtgctgattggagaccccatcaccacctgcctgagccccagcgtgtatgacatcatctgcaacctgggcttccagctgcgggagaactgtgacatcaacagcatcgtgacccagaatggagaggtgtgctggaagaccatcacagactgtgtgtcctacacagagagcgagcagggcctggactactggggctctgtgcggctgctgggccctgtgtgtgaggccgtgcacagccacttcctgagcctgaccaagggccagtttgagatccgctatgccccctggttccagtggaccagcttccctgagctgtttcctgagatctttgatgccctggagagcctgcagagccctgccatcagcctgagcctgatgaagctgaccagctgcctggagcgggccctgggagatgtgttcctgctgattggcaaggaatgtcccttcctgctgcgggacctgctgagcagcgaggagctggcccaggtgttcagccagagcgtgatgaatgtgctgaaggtgtttgtgggcagcccctgtggcctgaacctgagaaatgtgctgtggcacggctttgccagccctgaggagatcccccccaagtactgcagcatgatgatcctgctgacagctggcctgggccagctgctgaagagctacctgcagaacaccaagctgaccctggcccaccgctccttcatcagcctgaccaacctggaggacctgattgtgtttcctgatgtgacctatgaggtgctgtctgtgctggaggaggtgatgatgaagagcgccttcatcctgaagatcatgctgccctactgggaggtggccctggtgaagttcaagagccacagatttgctgactgtgccatcctgctgctgacccagctggagaccggcctgagaaatgtgtttgccaccctgaaccgctgccccaagaggctgctgacagctgagagcacagccctgtacaccacctttgaccagatcctggccaagcacctgaatgatggcaagatcaaccagctgcccctcttcctgggggagcccgccatggagttcctgtgggacttcctgaaccaccaggagggcccccgcatccgggaccacctgagccacggggagatcaacctgcacgagttcagcaaggagaccaccaaccagctgctggccttcagcctggtgctgctgctgcgctttgtggatgactgcctgctgagcgtcttcaaggagaagtctgctgtggagctgctgatcagcctggccgagggctacagcagccgctgccaccctgtgttccagctgaagaagcaggtgctgagctgtgaggagagcatccgggtgtgggccctgctgcccttccctgaggagctgacccggcaggccgtgcggctggaggacaacagcgagaccaatgcctgccacagcctcatcaccaagatgacagatgagctgtaccaccacatgcctgagaacagatgtgtgctgaaggacctggaccggctgcccacagagaccatccggctgctgagccctgtgctgagcctcatcctgctgctgattgccctggagctggtgaacatccatgctgtgtgtgggaagaatgcccacgagtaccagcagtacctgaagtttgtgaagagcatcctgcagtacacagagaacctggtggcctacaccagctatgagaagaacaagtggaatgagaccatcaacctgacccacacagccctgctgaagatgtggaccttcagcgagaagaagcagatgctgatccacctggccaagaagagcaccagcaaggtgctgctgtag

SEQ ID NO: 33387 - DNA, 993 bp, Artificial Sequence
  Description of Artificial Sequence: Synthetic coding sequence
atggagggcgcccctcctggcagcctggccctgcggctgctgctgtttgtggccctgcctgccagcggctggctgaccactggagcccctgagcccccacccctgagcggggccccccaggacggcatccgcatcaacgtgaccaccctgaaggatgatggagacatcagcaagcagcaggtggtgctgaacatcacctatgaaagtggccaggtgtatgtgaatgacctgcctgtgaacagcggcgtgacccgcatcagctgccagaccctcatcgtgaagaatgaaaacctggagaacctggaggagaaggagtactttggaattgtgtctgtgcgcatcctggtgcatgagtggcccatgaccagcggcagcagcctgcagctgattgtcatccaggaggaggtggtggagattgatggcaagcaggtgcagcagaaggatgtgacagaaattgacatcctggtgaagaacagaggagtgctgcggcacagcaactacaccctgcccctggaggagagcatgctgtacagcatcagccgggacagcgacatcctcttcaccctgcccaacctgagcaagaaggagagcgtgagcagcctgcagaccaccagccagtacctgatcagaaatgtggagaccaccgtggatgaagatgtgctgcccgggaagctgcctgagacccccctgcgggcagagccccccagcagctacaaggtgatgtgccagtggatggagaagttcaggaaggacctgtgccgcttctggagcaatgtgtttcctgtgttcttccagttcctgaacatcatggtggtgggcatcactggagctgctgtggtgatcaccatcctgaaggtgttcttccctgtgtctgagtacaagggcatcctgcagctggacaaggtggatgtgattcctgtgacagccatcaacctgtacccagatggccctgagaagagagctgagaacctggaggacaagacctgcatctag

SEQ ID NO: 33388 - DNA, 396 bp, Artificial Sequence
  Description of Artificial Sequence: Synthetic coding sequence
atgaccagcggcagcagcctgcagctgattgtcatccaggaggaggtggtggagattgatggcaagcaggtgcagcagaaggatgtgacagaaattgacatcctggtgaagaacagaggagtgctgcggcacagcaactacaccctgcccctggaggagagcatgctgtacagcatcagccgggacagcgacatcctcttcaccctgcccaacctgagcaagaaggagagcgtgagcagcctgcagaccaccagccagtacctgatcagaaatgtggagaccaccgtggatgaagatgtgctgcccgggaagctgcctgagacccccctgcgggcagagccccccagcagctacaaggtgctggagaccgtggacagcgcccccttccggctgtag

SEQ ID NO: 33389 - DNA, 378 bp, Artificial Sequence
  Description of Artificial Sequence: Synthetic coding sequence
ctgcagctgattgtcatccaggaggaggtggtggagattgatggcaagcaggtgcagcagaaggatgtgacagaaattgacatcctggtgaagaacagaggagtgctgcggcacagcaactacaccctgcccctggaggagagcatgctgtacagcatcagccgggacagcgacatcctcttcaccctgcccaacctgagcaagaaggagagcgtgagcagcctgcagaccaccagccagtacctgatcagaaatgtggagaccaccgtggatgaagatgtgctgcccgggaagctgcctgagacccccctgcgggcagagccccccagcagctacaaggtgctggagaccgtggacagcgcccccttccggctgtag

SEQ ID NO: 33390 - DNA, 1065 bp, Artificial Sequence
  Description of Artificial Sequence: Synthetic coding sequence
atggacttcatcctggaggacatggacctggccgccaatgagatcagcatctatgacaagctgtctgagaccgtggacctggtgcggcagacaggccaccagtgtggcatgtctgagaaggccatcgagaagttcatccggcagctgctggagaagaatgagccccagaggcccccaccccagtaccccctgctgattgtggtgtacaaggtgctggccaccctgggcctcatcctgctgacagcctacttcgtcatccagcccttcagccccctggcccctgagcctgtgctgagcggggcccacacctggaggagcctcatccaccacatccggctgatgagcctgcccatcgccaagaagtacatgtctgaaaataaaggagtgcccctgcacggcggagatgaggaccggcccttcccagactttgacccctggtggaccaatgactgtgagcagaatgaaagtgagcccatcccagccaactgcaccggctgtgcccagaagcacctgaaggtgatgctgctggaggatgcccccaggaagtttgagcggctgcaccccctggtgatcaagacaggcaagcccctgctggaggaggagatccagcacttcctgtgccagtacccagaggccacagagggcttcagcgagggcttctttgccaagtggtggcgctgcttccctgagcgctggttccccttcccctacccctggaggcggcccctgaacagaagccagatgctgcgggagctgtttcctgtgttcacccacctgcccttccccaaggatgccagcctgaacaagtgcagcttcctgcaccctgagcctgtggtgggcagcaagatgcacaagatgccagacctcttcatcatcggcagcggggaggccatgctgcagctgatcccccccttccagtgccgccgccactgccagagcgtggccatgcccatcgagcccggggacatcggctacgtggacaccacccactggaaggtgtatgtgattgcccggggcgtgcagcccctggtgatctgtgatggaacagccttcagcgagctgtag

SEQ ID NO: 33391 - DNA, 726 bp, Artificial Sequence
  Description of Artificial Sequence: Synthetic coding sequence
atgagcctgcccatcgccaagaagtacatgtctgagaacaagggcgtgcccctgcatggaggagatgaagatcggcccttcccagactttgacccctggtggaccaatgactgtgagcagaatgaaagtgagcccatcccagccaactgcaccggctgtgcccagaagcacctgaaggtgatgctgctggaggatgcccccaggaagtttgagcggctgcaccccctggtgatcaagacaggcaagcccctgctggaggaggagatccagcacttcctgtgccagtacccagaggccacagagggcttcagcgagggcttctttgccaagtggtggcgctgcttccctgagcgctggttccccttcccctacccctggaggcggcccctgaacagaagccagatgctgcgggagctgtttcctgtgttcacccacctgcccttccccaaggatgccagcctgaacaagtgcagcttcctgcaccctgagcctgtggtgggcagcaagatgcacaagatgccagacctcttcatcatcggcagcggggaggccatgctgcagctgatcccccccttccagtgcagaagacactgccagagcgtggccatgcccatcgagcccggggacatcggctacgtggacaccacccactggaaggtgtatgtgattgcccggggcgtgcagcccctggtgatctgtgatggaacagccttcagcgagctgtag

SEQ ID NO: 33392 - DNA, 1044 bp, Artificial Sequence
  Description of Artificial Sequence: Synthetic coding sequence
atggacctggccgccaatgagatcagcatctatgacaagctgtctgaaacagtggacctggtgcggcagacaggccaccagtgtggcatgtctgagaaggccatcgagaagttcatccggcagctgctggagaagaatgagccccagaggcccccaccccagtaccccctgctgattgtggtgtacaaggtgctggccaccctgggcctcatcctgctgacagcctactttgtgatccagcccttcagccccctggcccctgagcctgtgctgagcggggcccacacctggaggagcctcatccaccacatccggctgatgagcctgcccatcgccaagaagtacatgtctgagaacaagggcgtgcccctgcatggaggagatgaagatcggcccttcccagactttgacccctggtggaccaatgactgtgagcagaatgaaagtgagcccatcccagccaactgcaccggctgtgcccagaagcacctgaaggtgatgctgctggaggatgcccccaggaagtttgagcggctgcaccccctggtgatcaagacaggcaagcccctgctggaggaggagatccagcacttcctgtgccagtacccagaggccacagagggcttcagcgagggcttctttgccaagtggtggcgctgcttccctgagcgctggttccccttcccctacccctggaggcggcccctgaacagaagccagatgctgcgggagctgtttcctgtgttcacccacctgcccttccccaaggatgccagcctgaacaagtgcagcttcctgcaccctgagcctgtggtgggcagcaagatgcacaagatgccagacctcttcatcatcggcagcggggaggccatgctgcagctgatcccccccttccagtgcagaagacactgccagagcgtggccatgcccatcgagcccggggacatcggctacgtggacaccacccactggaaggtgtatgtgattgcccggggcgtgcagcccctggtgatctgtgatggaacagccttcagcgagctgtag

SEQ ID NO: 33393 - DNA, 708 bp, Artificial Sequence
  Description of Artificial Sequence: Synthetic coding sequence
atggacttcatcctggaggacatggacctggccgccaatgagatcagcatctatgacaagctgtctgagaccgtggacctggtgcggcagacaggccaccagtgtggcatgtctgagaaggccatcgagaagttcatccggcagctgctggagaagaatgagccccagaggcccccaccccagtaccccctgctgattgtggtgtacaaggtgctggccaccctgggcctcatcctgctgacagcctacttcgtcatccagcccttcagccccctggcccctgagcctgtgctgagcggggcccacacctggaggagcctcatccaccacatccggctgatgagcctgcccatcgccaagaagtacatgtctgaaaataaaggagtgcccctgcacggcggagatgaggaccggcccttcccagactttgacccctggtggaccaatgactgtgagcagaatgaaagtgagcccatcccagccaactgcaccggctgtgcccagaagcacctgaaggtgatgctgctggaggatgcccccaggaagtttgagcggctgcaccccctggtgatcaaggagattgagctgtgcaccggcacagccagcagagctgagaaccaggtggagcggggcaagatcaagaccaagaccatgaagctgctgagcggcggctggctgctgagctacctgccctttgcctgcatgtag

SEQ ID NO: 33394 - DNA, 726 bp, Artificial Sequence; identical to SEQ ID NO: 33391
  Description of Artificial Sequence: Synthetic coding sequence

SEQ ID NO: 33395 - DNA, 705 bp, Artificial Sequence
  Description of Artificial Sequence: Synthetic coding sequence
gacttcatcctggaggacatggacctggccgccaatgagatcagcatctatgacaagctgtctgaaacagtggacctggtgcggcagacaggccaccagtgtggcatgtctgagaaggccatcgagaagttcatccggcagctgctggagaagaatgagccccagaggcccccaccccagtaccccctgctgattgtggtgtacaaggtgctggccaccctgggcctcatcctgctgacagcctactttgtgatccagcccttcagccccctggcccctgagcctgtgctgagcggggcccacacctggaggagcctcatccaccacatccggctgatgagcctgcccatcgccaagaagtacatgtctgagaacaagggcgtgcccctgcatggaggagatgaagatcggcccttcccagactttgacccctggtggaccaatgactgtgagcagaatgaaagtgagcccatcccagccaactgcaccggctgtgcccagaagcacctgaaggtgatgctgctggaggatgcccccaggaagtttgagcggctgcaccccctggtgatcaaggagattgagctgtgcacaggaacagccagcagagctgagaaccaggtggagcggggcaagatcaagaccaagaccatgaagctgctgagcggcggctggctgctgagctacctgccctttgcctgcatgtag

SEQ ID NO: 33396 - DNA, 651 bp, Artificial Sequence
  Description of Artificial Sequence: Synthetic coding sequence
atgctggccagccctgcccggcccaccctgaggatgctggccaaccacgccctgagcaccccccactgtgcctgcagccctgccccagcccccaggacagccagcgccagcagaagaagatgtgtgcctgtggaggcccgggctgctggggtgtttggagaccggctggccggcgtgtttggcagccggggcctgaagcatggaggagtgcaggccccccggccccgggtggtgcgggcagagccccgggccggctttgctgtggtgcgcagcccccggcggctgtgtggccgcagccacgccccccagcccccagcccacctgggcctgggccctggctgcttccctgctgtggccgtggtggtgcctgtgcccggcagccgggcccaccggccctttgctgccctgctggtggagggcagcttcctgggggacccccccatccccccaagaagaagtggagtgctggcccggggcagcgctggagctgactgcctggccagctctgtgaccccaggccccagcctgtggatccccctgctgctggtggccggctgtgtgtcctgctttgtgggcctggccgtgtgtgtgtggatgcaggcccgggtgtccccagcctggccagctggcctcttcctgctgcccaggtag

SEQ ID NO: 33397 - DNA, 357 bp, Artificial Sequence
  Description of Artificial Sequence: Synthetic coding sequence
atggaggactttgccaccaggacctacggcaccagcggcctggacaaccggcccctgtttggagagaccagcgccaaggaccgcatcatcaacctggtggtgggcagcctgaccagcctgctgatcctggtgaccctcatcagcgcctttgtgttcccccagctgccccccaagcccctgaacatcttctttgctgtgtgcatcagcctgagcagcatcacagcctgcatcctgatctactggtaccggcagggcgacctggagcccaagttcaggaagctgatctactacatcatcttcagcatcatcatgctgtgcatctgtgccaacctgtacttccatgatgtgggccgctag

SEQ ID NO: 33398 - DNA, 357 bp, Artificial Sequence; identical to SEQ ID NO: 33397
  Description of Artificial Sequence: Synthetic coding sequence

SEQ ID NO: 33399 - DNA, 18 bp, Artificial Sequence
  Description of Artificial Sequence: Synthetic coding sequence
atggaggactttgcctag

SEQ ID NO: 33400 - DNA, 705 bp, Artificial Sequence
  Description of Artificial Sequence: Synthetic coding sequence
atgggccctgggggccgggtggcccggctgctggcccccctgatgtggaggagagctgtgtcctctgtggccggcagcgctgtgggcgctgagcccggcctgcggctgctggccgtgcagaggctgcctgtgggcgccgccttctgccgggcctgccagacccccaactttgtgcggggcctgcacagcgagcccggcctggaggagagagctgagggcaccgtgaatgaaggccggcctgagagtgatgctgctgaccacacaggccccaagtttgacatcgacatgatggtgtccctgctgcggcaggagaatgcccgggacatctgtgtgatccaggtgcccccagagatgagatacacagactacttcgtcatcgtgtctggcaccagcaccaggcacctgcacgccatggccttctacgtggtgaagatgtacaagcacctgaagtgcaagagggacccccacgtgaagattgagggcaaggacacagatgactggctgtgtgtggactttggctccatggtgatccacctgatgctgcctgagacccgggagatctatgagctggagaagctgtggaccctgcggagctatgatgaccagctggcccagatcgcccctgagaccgtgcctgaggacttcatcctgggcattgaagatgacaccagctctgtgacccctgtggagctgaagtgtgagtag

SEQ ID NO: 33401 - DNA, 945 bp, Artificial Sequence
  Description of Artificial Sequence: Synthetic coding sequence
atgttcagcatcaaccccctggagaacctgaaggtgtacatcagcagccggccccccctggtggtgttcatgatctctgtgtctgccatggccatcgccttcctgaccctgggctacttcttcaagatcaaggagatcaagagccctgagatggccgaggactggaacaccttcctgctgcgcttcaatgacctggacctgtgtgtgtctgaaaatgagaccctgaagcacctgaccaatgacaccaccaccccagagagcaccatgaccagcggccaggcccgggccagcacccagagcccccaggccctggaggacagcggccctgtgaacatctctgtgtccatcaccctgaccctggaccccctgaagccctttggaggctacagcagaaatgtgacccacctgtacagcaccatcctgggccaccagatcggcctgagcggccgggaggcccacgaggagatcaacatcaccttcaccctgcccacagcctggagcagtgatgactgtgccctgcacggccactgtgagcaggtggtgttcaccgcctgcatgaccctgacagccagccctggggtcttccctgtgacagtgcagcccccccactgtgtgcctgacacctacagcaatgccaccctgtggtacaagatcttcaccacagccagagatgccaacaccaagtatgcccaggactacaaccccttctggtgctacaagggggccatcggcaaggtgtaccacgccctgaaccccaagctgactgtgattgtgcctgatgatgacaggagcctcatcaacctgcacctgatgcacaccagctacttcctgtttgtgatggtgatcaccatgttctgctacgccgtcatcaagggccggcccagcaagctgcggcagagcaaccctgagttctgcccagagaaggtggccctggccgaggcctag

SEQ ID NO: 33402 - DNA, 219 bp, Artificial Sequence
  Description of Artificial Sequence: Synthetic coding sequence
atgttcagcatcaaccccctggagaacctgaaggtgtacatcagcagccggccccccctggtggtgttcatgatctctgtgtctgccatggccatcgccttcctgaccctgggctacttcttcaagatcaaggagatcaagagccctgagatggccgaggactggaacaccttcctgctgcgcttcaatgacctggacctgtgtgtgtctgaaaattag

SEQ ID NO: 33403 - DNA, 285 bp, Artificial Sequence
  Description of Artificial Sequence: Synthetic coding sequence
atgttcagcatcaaccccctggagaacctgaaggtgtacatcagcagccggccccccctggtggtgttcatgatctctgtgtctgccatggccatcgccttcctgaccctgggctacttcttcaagatcaaggagatcaagagccctgagatggccgaggactggaacaccttcctgctgcgcttcaatgacctggacctgtgtgtgtctgaaaatgagaccctgaagcacctgaccaatgacaccaccaccccagagagcaccatgaccagcggccaggcctag

SEQ ID NO: 33404 - DNA, 420 bp, Artificial Sequence
  Description of Artificial Sequence: Synthetic coding sequence
atgttcagcatcaaccccctggagaacctgaaggtgtacatcagcagccggccccccctggtggtgttcatgatctctgtgtctgccatggccatcgccttcctgaccctgggctacttcttcaagatcaaggagatcaagagccctgagatggccgaggactggaacaccttcctgctgcgcttcaatgacctggacctgtgtgtgtctgaaaatgagaccctgaagcacctgaccaatgacaccaccaccccagagagcaccatgaccagcggccaggcccgggccagcacccagagcccccaggccctggaggacagcggccctgtgaacatctctgtgtccatcaccctgaccctggaccccctgaagccctttggaggctacagcagaaatgtgacccacctgtacagcacctag

SEQ ID NO: 33405 - DNA, 567 bp, Artificial Sequence
  Description of Artificial Sequence: Synthetic coding sequence
atggccctggccatgctggtgctggtggtgagcccctggagcgctgcccggggcgtgctgaggaactactgggagcggctgctgaggaagctgccccagagccggcccggcttccccagccccccctggggccctgccctggccgtgcagggccctgccatgttcacagagcccgccaatgacaccagcggcagcaaagaaaacagcagcctgctggacagcatcttctggatggccgcccccaagaacagaaggaccatcgaggtgaaccgctgcagaagaagaaacccccagaagctgatcaaggtgaagaacaacattgatgtgtgcccagaatgtggccacctgaagcagaagcacgtgctgtgtgcctactgctatgagaaggtgtgcaaggagacagctgagatccggcggcagatcggcaagcaggagggcggccccttcaaggcccccaccatcgagaccgtggtgctgtacacaggagagacccccagcgagcaggaccagggcaagaggatcatcgagcgggacaggaagaggcccagctggttcacccagaactag

SEQ ID NO: 33406 - DNA, 441 bp, Artificial Sequence
  Description of Artificial Sequence: Synthetic coding sequence
atgatgtggcagaagtatgccggcagccgccgctccatgcccctgggcgcccgcatcctcttccacggcgtcttctacgccggcggctttgccatcgtgtactacctgatccagaagttccacagccgggccctgtactacaagctggccgtggagcagctgcagagccaccctgaggcccaggaggccctgggcccccccctgaacatccactacctgaagctgattgacagagaaaattttgtggacatcgtggatgccaagctgaagatccctgtgtctggcagcaagtctgagggcctgctgtatgtgcacagcagcagaggaggccccttccagcgctggcacctggatgaggtgttcctggagctgaaggatggccagcagatccctgtgttcaagctgagcggggagaatggagatgaggtgaagaaggagtag

SEQ ID NO: 33407 - DNA, 441 bp, Artificial Sequence; identical to SEQ ID NO: 33406
  Description of Artificial Sequence: Synthetic coding sequence

SEQ ID NO: 33408 - DNA, 441 bp, Artificial Sequence; identical to SEQ ID NO: 33406
  Description of Artificial Sequence: Synthetic coding sequence

SEQ ID NO: 33409 - DNA, 441 bp, Artificial Sequence; identical to SEQ ID NO: 33406
  Description of Artificial Sequence: Synthetic coding sequence

SEQ ID NO: 33410 - DNA, 342 bp, Artificial Sequence
  Description of Artificial Sequence: Synthetic coding sequence
atgatgtggcagaagtatgccggcagccgccgctccatgcccctgggcgcccgcatcctcttccacggcgtcttctacgccggcggctttgccatcgtgtactacctgatccagaagttccacagccgggccctgtactacaagctggccgtggagcagctgcagagccaccctgaggcccaggaggccctgggcccccccctgaacatccactacctgaagctgattgacagagaaaattttgtggacatcgtggatgccaagctgaagatccctgtgtctggcagcaagtctgagggcctgctgtatgtgcacagcagcagaggaggccccttccagtag

SEQ ID NO: 33411 - DNA, 267 bp, Artificial Sequence
  Description of Artificial Sequence: Synthetic coding sequence
atgatgtggcagaagtatgccggcagccgccgctccatgcccctgggcgcccgcatcctcttccacggcgtcttctacgccggcggctttgccatcgtgtactacctgatccagaagttccacagccgggccctgtactacaagctggccgtggagcagctgcagagccaccctgaggcccaggaggccctgggcccccccctgaacatccactacctgaagctgattgacagagaaaattttgtggacatcgtggatgccaagtag

SEQ ID NO: 33412 - DNA, 441 bp, Artificial Sequence; identical to SEQ ID NO: 33406
  Description of Artificial Sequence: Synthetic coding sequence

SEQ ID NO: 33413 - DNA, 441 bp, Artificial Sequence; identical to SEQ ID NO: 33406
  Description of Artificial Sequence: Synthetic coding sequence

SEQ ID NO: 33414 - DNA, 441 bp, Artificial Sequence; identical to SEQ ID NO: 33406
  Description of Artificial Sequence: Synthetic coding sequence

SEQ ID NO: 33415 - DNA, 735 bp, Artificial Sequence
  Description of Artificial Sequence: Synthetic coding sequence
atgggagacctcttcagcctcttctgggaggtggaccccccacccatccctgtgaactgtgccatccccaaccaggactatgagtgctggaaggatgacagctgtggcaccatcggcagcttcctgctgtggtacttcgtcatcgtgtttgtgctgatgttcttcagccgggcctctgtgtggatgtctgaggacaagaaggatgagggcagcggcaccagcacctctgtgaggaaggccagcaaggagaccagctgcaagaggcagagcaaggacagcgcctgggaccccagccagaccatgaagaagcccaagcagaaccagctgacccctgtgaccaacagcgaggtggccctggtgaatgcctacccagagcagaggcgggcccggcggcagagccagttcaatgaggtgaaccagaaccagcacgacagcgacaccacagaatatggcagcgaggagagcaacagcgaggccagctcctggaaggagagcgagagcgagcaccaccccagcccagacagcatcaagaggaggaagatggcccagaggcagaggaacctgggcagctaccagatgtctgagcggcactgcctgcactgcaaggccctgcggaccaatgagtggctggcccaccacagccggcagaagcccagcgtgaccccacccatgaagagggacagccaggaggagagcagcatcagtgacatcaacaagaagttcagcaagttctag

SEQ ID NO: 33416 - DNA, 396 bp, Artificial Sequence
  Description of Artificial Sequence: Synthetic coding sequence
atgacccacagcagccaggacaccggcagctgtggcatccaggaggatggcaagctgtatgtggtggacagcatcaatgacctgaacaagctgaacctgtgcccagctggcagccagcacctgttccccctggaggacaagatccctgtgctgggcaccaacagcggaaatggcagccgcagcctcttctttgtgggcctgctgattgtgctgattgtgtccctggccctggtgttcttcgtcatcttcctgattgtgcagacaggcaacaagatggatgatgtgtcccggcggctgacagctgagggcaaggacattgatgacctgaagaggatcaacaacatgattgtgaagaggctgaaccagctgaaccagctggacagcgagcagaactag

SEQ ID NO: 33417 - DNA, 180 bp, Artificial Sequence
  Description of Artificial Sequence: Synthetic coding sequence
atgacccacagcagccaggacaccggcagctgtggcatccaggaggatggcaagctgtatgtggtggacagcatcaatgacctgaacaagctgaacctgtgcccagctggcagccagcacctgttcctgctgcggcagagcagcaagaacttccccaagaggagcaaggagatcgcctag

SEQ ID NO: 33418 - DNA, 396 bp, Artificial Sequence; identical to SEQ ID NO: 33416
  Description of Artificial Sequence: Synthetic coding sequence

SEQ ID NO: 33419 - DNA, 342 bp, Artificial Sequence
  Description of Artificial Sequence: Synthetic coding sequence
atggccgccctgggcagccccagccacaccttccggggcctgctgcgggagctgcgctacctgtctgctgccaccggccggccctacagagacacagctgcctaccgctacctggtgaaggccttccgggcccaccgggtgaccagcgagaagctgtgccgggcccagcacgagctgcacttccaggccgccacctacctgtgcctgctgcggagcatcaggaagcacgtggccctgcaccaggagttccacggcaagggggagaggtctgtggaggagagcgctggcctggtgggcctgaagctgccccaccagcccggcggcaagggctgggagccctag

SEQ ID NO: 33420 - DNA, 3081 bp, Artificial Sequence
  Description of Artificial Sequence: Synthetic coding sequence
atggtgtgcaggcctgtgttcccctgcagaagacgcttctgcccccggcccttcctggtgggcctggtggtggccatctgcctcttctaccagaccctgaccctgcggggcagcaggaagctgacagctgctgcccctggagctgtgccccacaccagcacagagacccaggccagccgctgcaagaagggcttcagccaggacaagcagtgcttcctgctgtctggaaatgcccaggagaccaggaaggtgaaggagagcatggagacccacttcggcagccatggaagaagagccatcctgtaccggccccccttctacagcaagacagagctgcagctgcaccagcacatcctgacccagcacggctacacagtggtgattgctgaggagcggctgaatgccggcctgggccctggcctgctggagcagggcgacctgggctcctgggacctgctgatctgcctgagcagcaagaaggccgagggcaccccctgcatcagcaaggaggtgatgtgccagctgggcctgcaccagaaggccaaccggctgcctgagatccagcagcccctgtgcaggaaggagggcctgtgccagatcgtgcggcgcttccctgagctgcagctgcctgtgagccccagcgtgtgcctggaccagggcatgcagctgaagcccagcaccagcagccacctgctgaagacagtgaagccccgggtgtggaagccaggggactggagccgggagcagctgaatgagaccaccgtgctggcccctcatgagaccatcttccgggcagaggacctgagcgtcatcctgaaggcctacgtgctggtgaccagcctgacccccctgcgggccttcatccacagcactggaacagtgtggaacccccccaagaagaagcgcttcaccgtgaagctgcagaccttctttgagaccttcctgcgggccagcagcccccagcaggcctttgacatcatgaaggaggccatcggcaagctgctgctggccgctgaggtgttcagcgagaccagcaccctgggccccaagaccttccaccgctgccgcttctgcttccagctgctgacctttgacatcggctacggcagcttcatgtaccctgtggtgctgcaggtgcatgagcacctgaacttccaggactatgacaacatggactttgaggaccagaacacagaggagttcctgctgaatgacaccttcaacttcctgttccccaatgaaagcagcctgagcatcttcagcgagatcttccagaggctgtacagaagtgatgtgttcaagggggagaactaccagaaggagctgaaccagtgcctgagcctggaggagatcaacagcatcatgaccttcatcaaggagctgggcagcctgggccagttccagctgctcttccccagcaccaccccaggcatccagagcctgatgcatgagttctatgatgtggccaaccctgtgggcaaccctggctctgtgctgacccagtactggagcctgctgaatgtgtttgagcagttccagttcatgaacaagaagacccagccccaccccctggagtggaacagcttcacagaggacaagaacatcgagaagccccaggtgccctttgatgccatcgagaacaagaaggctgctgtgccccagatcaagaatgaaaacaaggagatccactgcagtgatgatgagaacaccccctgccacatcaagcagatcttcacccacccccacctggagctgaacccagacttccaccccaagatcaaggactactactgtgaggtgccctttgatgtggtgacagtgaccatcggcgtggagacccccaagtgcctgtgcaaggtgcacctgtatgagcaggccggccccagctttgccagctaccccctgggcctgggcatgaacaagatcagcatctttgtggtggatgagagccctgcccatggagagaccctcatcacctacaagctgaccatctacagagaagatcggcccagcctgcccctgtttgaggccttcaccgcctgtggctttgtgcaggactgtggcctgctgatccaccctgaggagacctgtggcctgcagcccatcagcagtgactacatcgaggccatcctgcagagcgagctgaagcgctgccccagcggggacatgaagggccagtggatcgtgccctgcctgagctgcagcgacaacagaacctgtgactggagggagatcacctggcagccccacaactgccagtatggagtgctgaccaagccccagctgcagcagtgcctgggcggcaggaagatcctcttcatcggggacagcaccaacagaggcatcatgtactacctgattgagcggctgaatgagaccctgcaggagtggcagaaggtgcacggcaccaagttctaccacaacgtgaatggaggcaagaccctcatctcctacagctactacccccagttctggatcagccccagcctgcggcccacctttgaaaatgccctggagcacctgctgcagaggagccggcccctggagaacacaggccagacagtgctggtggtgggcggcgtgcagtggctgaacagcaaccacctgcagatcatccacaaggtgctgaagcgggagaacctgctgaacatcctggtgatcatcaagaccctgggcatcggcttccacctgcctgtggatggagtgcacttcctgacccagagcgaggtgcagaacctgtggaaggagaacctgatcatcctggacacagccaagaagcacggctatgaggtggtggacaccttcaccatcaccatgggccgctacaaggagttcctgcagggcaaatgtggctgccacttccacgaggtggtgaagagcaagctgagcaaggagtacaacttcatcaagatgaagaggagcaggaaccacatcatgggccgctacttcagcaaccagagcaagctgcagcagggcaccgtgaccaacttccgcagcccctaccacgtgcggggccccatcaaccaggtgtgcagcgagatcctgctgagcaggatgtgtgccaacaagaggaccatgtag

SEQ ID NO: 33421 - DNA, 609 bp, Artificial Sequence
  Description of Artificial Sequence: Synthetic coding sequence
atggtgtgcaggcctgtgttcccctgcagaagacgcttctgcccccggcccttcctggtgggcctggtggtggccatctgcctcttctaccagaccctgaccctgcggggcagcaggaagctgacagctgctgcccctggagctgtgccccacaccagcacagagacccaggccagccgctgcaagaagggcttcagccaggacaagcagtgcttcctgctgtctggaaatgcccaggagaccaggaaggtgaaggagagcatggagacccacttcggcagccatggaagaagagccatcctgtaccggccccccttctacagcaagacagagctgcagctgcaccagcacatcctgacccagcacggctacacagtggtgattgctgaggagcggctgaatgccggcctgggccctggcctgctggagcagggcgacctgggctcctgggacctgctgatctgcctgagcagcaagaaggccgagggcaccccctgcatcagcaaggaggtgatgtgccagctgggcctgcaccagaagcagctgcggcggcgggaggagcggcagaggcctggcagccctgccagccggcggctgtctgtgaggtag

SEQ ID NO: 33422 - DNA, 1650 bp, Artificial Sequence
  Description of Artificial Sequence: Synthetic coding sequence
atggtgtgcaggcctgtgttcccctgcagaagacgcttctgcccccggcccttcctggtgggcctggtggtggccatctgcctcttctaccagaccctgaccctgcggggcagcaggaagctgacagctgctgcccctggagctgtgccccacaccagcacagagacccaggccagccgctgcaagaagggcttcagccaggacaagcagtgcttcctgctgtctggaaatgcccaggagaccaggaaggtgaaggagagcatggagacccacttcggcagccatggaagaagagccatcctgtaccggccccccttctacagcaagacagagctgcagctgcaccagcacatcctgacccagcacggctacacagtggtgattgctgaggagcggctgaatgccggcctgggccctggcctgctggagcagggcgacctgggctcctgggacctgctgatctgcctgagcagcaagaaggccgagggcaccccctgcatcagcaaggaggtgatgtgccagctgggcctgcaccagaaggccaaccggctgcctgagatccagcagcccctgtgcaggaaggagggcctgtgccagatcgtgcggcgcttccctgagctgcagctgcctgtgagccccagcgtgtgcctggaccagggcatgcagctgaagcccagcaccagcagccacctgctgaagacagtgaagccccgggtgtggaagccaggggactggagccgggagcagctgaatgagaccaccgtgctggcccctcatgagaccatcttccgggcagaggacctgagcgtcatcctgaaggcctacgtgctggtgaccagcctgacccccctgcgggccttcatccacagcactggaacagtgtggaacccccccaagaagaagcgcttcaccgtgaagctgcagaccttctttgagaccttcctgcgggccagcagcccccagcaggcctttgacatcatgaaggaggccatcggcaagctgctgctggccgctgaggtgttcagcgagaccagcaccctgggccccaagaccttccaccgctgccgcttctgcttccagctgctgacctttgacatcggctacggcagcttcatgtaccctgtggtgctgcaggtgcatgagcacctgaacttccaggactatgacaacatggactttgaggaccagaacacagaggagttcctgctgaatgacaccttcaacttcctgttccccaatgaaagcagcctgagcatcttcagcgagatcttccagaggctgtacagaagtgatgtgttcaagggggagaactaccagaaggagctgaaccagtgcctgagcctggaggagatcaacagcatcatgaccttcatcaaggagctgggcagcctgggccagttccagctgctcttccccagcaccaccccaggcatccagagcctgatgcatgagttctatgatgtggccaaccctgtgggcaaccctggctctgtgctgacccagtactggagcctgctgaatgtgtttgagcagttccagttcatgaacaagaagacccagccccaccccctggagtggaacagcttcacagaggacaagaacatcgagaagccccaggtgccctttgatgccatcgagaacaagaagtag

SEQ ID NO: 33423 - DNA, 2352 bp, Artificial Sequence
  Description of Artificial Sequence: Synthetic coding sequence
atggtgtgcaggcctgtgttcccctgcagaagacgcttctgcccccggcccttcctggtgggcctggtggtggccatctgcctcttctaccagaccctgaccctgcggggcagcaggaagctgacagctgctgcccctggagctgtgccccacaccagcacagagacccaggccagccgctgcaagaagggcttcagccaggacaagcagtgcttcctgctgtctggaaatgcccaggagaccaggaaggtgaaggagagcatggagacccacttcggcagccatggaagaagagccatcctgtaccggccccccttctacagcaagacagagctgcagctgcaccagcacatcctgacccagcacggctacacagtggtgattgctgaggagcggctgaatgccggcctgggccctggcctgctggagcagggcgacctgggctcctgggacctgctgatctgcctgagcagcaagaaggccgagggcaccccctgcatcagcaaggaggtgatgtgccagctgggcctgcaccagaaggccaaccggctgcctgagatccagcagcccctgtgcaggaaggagggcctgtgccagatcgtgcggcgcttccctgagctgcagctgcctgtgagccccagcgtgtgcctggaccagggcatgcagctgaagcccagcaccagcagccacctgctgaagacagtgaagccccgggtgtggaagccaggggactggagccgggagcagctgaatgagaccaccgtgctggcccctcatgagaccatcttccgggcagaggacctgagcgtcatcctgaaggcctacgtgctggtgaccagcctgacccccctgcgggccttcatccacagcactggaacagtgtggaacccccccaagaagaagcgcttcaccgtgaagctgcagaccttctttgagaccttcctgcgggccagcagcccccagcaggcctttgacatcatgaaggaggccatcggcaagctgctgctggccgctgaggtgttcagcgagaccagcaccctgggccccaagaccttccaccgctgccgcttctgcttccagctgctgacctttgacatcggctacggcagcttcatgtaccctgtggtgctgcaggtgcatgagcacctgaacttccaggactatgacaacatggactttgaggaccagaacacagaggagttcctgctgaatgacaccttcaacttcctgttccccaatgaaagcagcctgagcatcttcagcgagatcttccagaggctgtacagaagtgatgtgttcaagggggagaactaccagaaggagctgaaccagtgcctgagcctggaggagatcaacagcatcatgaccttcatcaaggagctgggcagcctgggccagttccagctgctcttccccagcaccaccccaggcatccagagcctgatgcatgagttctatgatgtggccaaccctgtgggcaaccctggctctgtgctgacccagtactggagcctgctgaatgtgtttgagcagttccagttcatgaacaagaagacccagccccaccccctggagtggaacagcttcacagaggacaagaacatcgagaagccccaggtgccctttgatgccatcgagaacaagaaggctgctgtgccccagatcaagaatgaaaacaaggagatccactgcagtgatgatgagaacaccccctgccacatcaagcagatcttcacccacccccacctggagctgaacccagacttccaccccaagatcaaggactactactgtgaggtgccctttgatgtggtgacagtgaccatcggcgtggagacccccaagtgcctgtgcaaggtgcacctgtatgagcaggccggccccagctttgccagctaccccctgggcctgggcatgaacaagatcagcatctttgtggtggatgagagccctgcccatggagagaccctcatcacctacaagctgaccatctacagagaagatcggcccagcctgcccctgtttgaggccttcaccgcctgtggctttgtgcaggactgtggcctgctgatccaccctgaggagacctgtggcctgcagcccatcagcagtgactacatcgaggccatcctgcagagcgagctgaagcgctgccccagcggggacatgaagggccagtggatcgtgccctgcctgagctgcagcgacaacagaacctgtgactggagggagatcacctggcagccccacaactgccagtatggagtgctgaccaagccccagctgcagcagtgcctgggcggcaggaagctgggcgtggatgtgcagagggtgcccaggagcaggaactag

SEQ ID NO: 33424 - DNA, 348 bp, Artificial Sequence
  Description of Artificial Sequence: Synthetic coding sequence
atgatggctgtgatgacccccagtgatggcctgagccagctgtctgtgccccacctgacccaccagaggctgtggagcctgagctgcctggccatgctgttccaggccgtgctgatcctgagcgccccccagatgagctgcctgctgaagtgcttctacgccctggaccccctgcaccctgtgatgtctgaggagttcagcgcccagtaccgccacatgatggaccagcgctaccgcacccgcatccacgagggctacatcagccaggtgaagggggcctacctgagaattgtgcacaagaagcccatctcctatgccaagagcttccccaaggagatgggcaactag

SEQ ID NO: 33425 - DNA, 300 bp, Artificial Sequence
  Description of Artificial Sequence: Synthetic coding sequence
atgggagaatgtccccacctggtggatgtgcggctgggccacaggagcctggccactggacctgagcagagcgacatctgccacactggaagtgaggcccgctggaccaccacctggtacggcagcctgtccttcagccgccacaagtacaagatgctggccgacctgaccccaggagtggagatgagctgccgccactgggcccgctggctgacccctgtgatcccagccctgtggaaggccgaggccggcggcctgcctgagctgcggagcagcaggcctgcctggaccacctggtag

SEQ ID NO: 33426 - DNA, 324 bp, Artificial Sequence
  Description of Artificial Sequence: Synthetic coding sequence
atggccggcggctatggagtgatgggagatgatggcagcattgactacacagtgcatgaggcctggaatgaggccaccaacgtgtacctgattgtcatcctggtgtcctttggcctcttcatgtatgccaagaggaacaagaggcgcatcatgaggatcttctctgtgcccccaacagaggagaccctgtctgagcccaacttctatgacaccatcagcaagatccggctgcggcagcagctggagatgtacagcatcagcaggaaatatgactaccagcagccccagaaccaggccgacagcgtgcagctgagcctggagtag

SEQ ID NO: 33427 - DNA, 324 bp, Artificial Sequence; identical to SEQ ID NO: 33426
  Description of Artificial Sequence: Synthetic coding sequence

SEQ ID NO: 33428 - DNA, 324 bp, Artificial Sequence; identical to SEQ ID NO: 33426
  Description of Artificial Sequence: Synthetic coding sequence

SEQ ID NO: 33429 - DNA, 324 bp, Artificial Sequence; identical to SEQ ID NO: 33426
  Description of Artificial Sequence: Synthetic coding sequence

SEQ ID NO: 33430 - DNA, 324 bp, Artificial Sequence; identical to SEQ ID NO: 33426
  Description of Artificial Sequence: Synthetic coding sequence

SEQ ID NO: 33431 - DNA, 651 bp, Artificial Sequence
  Description of Artificial Sequence: Synthetic coding sequence
atgtggccaccctgtggcaccctgcggaccctggccctggcccggagcagaggagcccgggcctgcagcggagatggaggagtgtcctacacccagggccagagccctgagcccaggacccgggagtacttctactacgtggaccaccagggccagctgttcctggatgacagcaagatgaagaacttcatcacctgcttcaaggacccccagttcctggtgaccttcttcagccggctgcggcccaacagaagtggccgctatgaggccgccttccccttcctgagcccctgtggccgggagaggaacttcctgcgctgtgaggacaggcctgtggtgttcacccacctgctgacagctgaccacggccccccccggctgagctactgcggcggcggggaggccctggccgtgccctttgagcccgcccggctgctgcccctggccgccaacggccgcctgtaccacccagcccctgagcgggccggcggcgtgggcctggtgcgcagcgccctggcctttgagctgagcgcctgctttgaatatggccctggggccccagccctgcccagccacgtgcgctggcagggccggcggctggccctgaccatggacctggcccccctgctgctggccgcccggagcccctag

SEQ ID NO: 33432 - DNA, 261 bp, Artificial Sequence
  Description of Artificial Sequence: Synthetic coding sequence
atgggcaggaaggatgctgccaccatcaagctgcctgtggaccagtacaggaagcagatcggcaagcaggactacaagaagaccaagcccatcctgcgggccaccaagctgaaggccgaggccaagaagacagccatcggcatcaaggaggtgggcctggtgctggccgccatcctggccctgctgctggccttctacgccttcttctacctgcggctgaccacagatgtggaccctgacctggaccaggatgaagattag

SEQ ID NO: 33433 - DNA, 228 bp, Artificial Sequence
  Description of Artificial Sequence: Synthetic coding sequence
atgggcaggaaggatgctgccaccatcaagctgcctgtggaccagtacaggaagcagatcggcaagcaggactacaagaagaccaagcccatcctgcgggccaccaagctgaaggccgaggccaagaagacagccatcggcatcaaggaggtgggcctggtgctggccgccatcctggccctgctgctggccttctacgccttcttctacctgcggctgaccacctag

SEQ ID NO: 33434 - DNA, 261 bp, Artificial Sequence; identical to SEQ ID NO: 33432
  Description of Artificial Sequence: Synthetic coding sequence

SEQ ID NO: 33435 - DNA, 261 bp, Artificial Sequence; identical to SEQ ID NO: 33432
  Description of Artificial Sequence: Synthetic coding sequence

SEQ ID NO: 33436 - DNA, 261 bp, Artificial Sequence; identical to SEQ ID NO: 33432
  Description of Artificial Sequence: Synthetic coding sequence

SEQ ID NO: 33437 - DNA, 261 bp, Artificial Sequence; identical to SEQ ID NO: 33432
  Description of Artificial Sequence: Synthetic coding sequence

SEQ ID NO: 33438 - DNA, 261 bp, Artificial Sequence; identical to SEQ ID NO: 33432
  Description of Artificial Sequence: Synthetic coding sequence

SEQ ID NO: 33439 - DNA, 261 bp, Artificial Sequence; identical to SEQ ID NO: 33432
  Description of Artificial Sequence: Synthetic coding sequence

SEQ ID NO: 33440 - DNA, 27 bp, Artificial Sequence
  Description of Artificial Sequence: Synthetic coding sequence
atgggcaggaaggatgctgccacctag

SEQ ID NO: 33441 - DNA, 261 bp, Artificial Sequence; identical to SEQ ID NO: 33432
  Description of Artificial Sequence: Synthetic coding sequence

SEQ ID NO: 33442 - DNA, 261 bp, Artificial Sequence; identical to SEQ ID NO: 33432
  Description of Artificial Sequence: Synthetic coding sequence

SEQ ID NO: 33443 - DNA, 384 bp, Artificial Sequence
  Description of Artificial Sequence: Synthetic coding sequence
atgaacttcatcctcttcatcttcatccctggggtcttcagcctgaagagcagcaccctgaagcccaccatcgaggccctgcccaacgtgctgcccctgaatgaagatgtgaacaagcaggaggagaagaatgaagaccacacccccaactatgccccagccaatgagaagaatggaaactactacaaggacatcaagcagtatgtgttcaccacccagaaccccaacggcacagagagcgagatctctgtgcgggccaccacagacctgaactttgccctgaagaatgacaagacagtgaatgccaccacctatgagaagagcaccatcgaggaggagaccaccaccagcgagcccagccacaagaacatccagagcatctag

SEQ ID NO: 33444 - DNA, 885 bp, Artificial Sequence
  Description of Artificial Sequence: Synthetic coding sequence
atgaacttcatcctcttcatcttcatccctggggtcttcagcctgaagagcagcaccctgaagcccaccatcgaggccctgcccaacgtgctgcccctgaatgaagatgtgaacaagcaggaggagaagaatgaagaccacacccccaactatgccccagccaatgagaagaatggaaactactacaaggacatcaagcagtatgtgttcaccacccagaaccccaacggcacagagagcgagatctctgtgcgggccaccacagacctgaactttgccctgaagaatgacaagacagtgaatgccaccacctatgagaagagcaccatcgaggaggagaccaccaccagcgagcccagccacaagaacatccagaggagcacccccaacgtgcctgccttctggaccatgctggccaaggccatcaatggaacagctgtggtgatggatgacaaggaccagctgttccaccccatccctgagagtgatgtgaatgccacccagggcgagaaccagcctgacctggaggacctgaagatcaagatcatgctgggcatcagcctgatgaccctgctgctgtttgtggtgctgctggccttctgcagcgccaccctgtacaagctgcggcacctgagctacaagagctgtgagagccagtacagcgtgaaccctgagctggccaccatgagctacttccaccccagcgagggcgtgtctgacaccagcttcagcaagtctgctgagagcagcaccttcctgggcaccaccagcagtgacatgagaagaagtggcaccaggaccagcgagagcaagatcatgacagacatcatcagcattggaagtgacaatgagatgcatgaaaatgatgaatctgtgaccaggtag

SEQ ID NO: 33445 - DNA, 798 bp, Artificial Sequence
  Description of Artificial Sequence: Synthetic coding sequence
atgaacttcatcctcttcatcttcatccctggggtcttcagcctgaagagcagcaccctgaagcccaccatcgaggccctgcccaacgtgctgcccctgaatgaagatgtgaacaagcaggaggagaagaatgaagaccacacccccaactatgccccagccaatgagaagaatggaaactactacaaggacatcaagcagtatgtgttcaccacccagaaccccaacggcacagagagcgagatctctgtgcgggccaccacagacctgaactttgccctgaagaatggcagcaccccaaatgtgcctgccttctggaccatgctggccaaggccatcaatggaacagctgtggtgatggatgacaaggaccagctgttccaccccatccctgagagtgatgtgaatgccacccagggcgagaaccagcctgacctggaggacctgaagatcaagatcatgctgggcatcagcctgatgaccctgctgctgtttgtggtgctgctggccttctgcagcgccaccctgtacaagctgcggcacctgagctacaagagctgtgagagccagtacagcgtgaaccctgagctggccaccatgagctacttccaccccagcgagggcgtgtctgacaccagcttcagcaagtctgctgagagcagcaccttcctgggcaccaccagcagtgacatgaggaggagcggcaccaggaccagcgagagcaagatcatgacagacatcatcagcatcggcagtgacaatgagatgcatgaaaatgatgagagcgtgaccaggtag

SEQ ID NO: 33446 - DNA, 339 bp, Artificial Sequence
  Description of Artificial Sequence: Synthetic coding sequence
atgggcagccggctgagccagccctttgagagctacatcacagcccctcctggaacagctgctgccccagccaagccagcccccccagccacccctggggcccccaccagccctgctgagcaccggctgctgaagacctgctggagctgccgggtgctgagcggcctgggcctgatgggcgccggcggctacgtgtactgggtggccaggaagcccatgaagatgggctacccacccagcccctggaccatcacccagatggtgattggcctgagcatcgccacctggggcatcgtggtgatggctgaccccaagggcaaggcctacagagtggtgtag

SEQ ID NO: 33447 - DNA, 1212 bp, Artificial Sequence
  Description of Artificial Sequence: Synthetic coding sequence
atgagcaccagcaccagccctgctgccatgctgctgcggcggctgcggcggctgtcctggggcagcacagctgtgcagctgttcatcctgactgtggtgaccttcggcctgctggcccccctggcctgccaccggctgctgcacagctacttctacctgcggcactggcacctgaaccagatgagccaggagttcctgcagcagagcctgaaggagggggaggccgccctgcactactttgaggagctgcccagcgccaatggatctgtgcccatcgtgtggcaggccaccccccggccctggctggtgatcaccatcatcaccgtggaccggcagcccggcttccactacgtgctgcaggtggtgtcccagttccaccggctgctgcagcagtgtggcccccagtgtgagggccaccagctgttcctgtgcaatgtggagaggtctgtgagccactttgatgccaagctgctgagcaaatatgtgcctgtggccaacagatatgagggcacagaagatgattatggagatgaccccagcaccaacagctttgagaaggagaagcaggactatgtgtactgcctggagagcagcctgcagacctacaacccagactatgtgctgatggtggaggatgatgctgtgcctgaggagcagatcttccctgtgctggagcacctgctgcgggcccgcttcagcgagccccacctgagagatgccctgtacctgaagctgtaccaccctgagcggctgcagcactacatcaaccctgagcccatgaggatcctggagtgggtgggcgtgggcatgctgctgggccccctgctgacctggatctacatgagatttgccagcaggcctggcttctcctggcctgtgatgctgttcttcagcctgtacagcatgggcctggtggagctggtgggccgccactacttcctggagctgcggcggctgagccccagcctgtacagcgtggtgcctgccagccagtgctgcaccccagccatgctgtttcctgccccagctgcccggaggaccctgacctacctgagccaggtgtactgccacaagggctttgggaaggacatggccctgtacagcctgctgcgggccaagggggagcgggcctacgtggtggagcccaacctggtgaagcacatcggcctcttcagcagcctgcgctacaacttccaccccagcctgctgtag

SEQ ID NO: 33448 - DNA, 1212 bp, Artificial Sequence; identical to SEQ ID NO: 33447
  Description of Artificial Sequence: Synthetic coding sequence

SEQ ID NO: 33449 - DNA, 1212 bp, Artificial Sequence; identical to SEQ ID NO: 33447
  Description of Artificial Sequence: Synthetic coding sequence

SEQ ID NO: 33450 - DNA, 690 bp, Artificial Sequence
  Description of Artificial Sequence: Synthetic coding sequence
atggacagcctggacaggagctgccaggactggtgtgacaggaagcagcactggctggagatcggccccccagacctggtggagaggaagggcagcctgaccctgcggagccaccacaagaagtacagcaagcctgtgctggtgtacagctggcaccgggaccgggaggccttccccaagggctatgacatcgagggccctgagaaggtgaagaagctgtgcaacagcacctacagaaggctgggcacagatgagagccccatctggaccagcgagacccatgagaagctgagccagatgtgcctgaacacagagtgggtggagatgaagagcaaggccctgctgaatgaggagaccgtgagcagcggcatcatcgagcgggtgacaggcctgcctgccaccggctttggagctgtgttccccaggcaccccccagactggagcaagatgtgtgccctgaccacctacagcgaggactatgtgcccccctatgactaccagccccacgcctacccctgccaggatgactacagcatcgtgcacaggaaatgtcgcagccagttcacagacctgaatggcagcaagagatttggcatcaacacctggcatgatgagagcggcatctatgccaacagtgatgtgaagcagaagctgtaccccctgaccagcggccccatcgtgcccatctag

SEQ ID NO: 33451 - DNA, 1272 bp, Artificial Sequence
  Description of Artificial Sequence: Synthetic coding sequence
atggaccggggccagcccagcctggagcctgctgctgctgccccccgggccagcggccgctgtgtgattgcccctgtgcgggctgtgctgcggctgcggcggcgggtgtgtgtgctgaggaagaggcggctgctgcagcccggcggcggcccagatgtgggcactggagccccccggcccggctgcagcccccgggcccccagggctgacctggaccagcccaagttcttcacctttgacagccctgctgagctgcccagcaggacccccaggaagaagagaagaagaagccggctggtgctgtacccagagaccagcaggaagtaccggccccgggtggagcacaggagccgggcccagcgctgcctgctgctgctggtggccatcgtgggcttccaggtgctgaatgccatcgagaacctggatgacaatgcccagagatatgacctggatggcctggagaaggccctgcagagagctgtgtttggccagcctgctgctgtgtccagaattgtggccctgatgagggactacctggccacccacgtgcacagccggcccctgctgctggccctgcacggccccagcggcgtgggcaagagccacgtgggccgcctgctggcccggcacttccgctctgtgctggaggacagcgccctggtgctgcagtaccacgcccggcaccactgcccagaggcccgggccgcccaggactgccgggaggagctggccaggagagtggctgatgtggtggcccgggcagaggccgaggagaagacccccctgctggtgctggatgatgtggagctgatgccccggcccctgctggatgagctgcacggcttcctgcagccccagaggagccaccacttccacaatgccatctacgtgctgctgagcggggccggcggcgctgaggtgaccaggtttgtgctgcagaatgccagccgggccctgcccctgcggccagatggcttccgctctgctgaggccgctgctgcccaggccgaggaggacctgcgggccagcctgctggccgtgctgagccgggagcaccccctgtggcaggccgccgccatcgtgcccttcctgctgctggacaagagagatgtggtgtcctgcttcagagatgagatggccggggagggcttcttcccagaccaggcccgggcagagaacctggccgcccagctgtccttctacagagtggccggccgggagtttgctgtgacaggctgcaagcaggtggtggccaccgtgaacctgctgtag

SEQ ID NO: 33452 - DNA, 4941 bp, Artificial Sequence
  Description of Artificial Sequence: Synthetic coding sequence
atgtggcacggcaaccacgtgcagcccggggccacccaccggcccaaccagggcctggagatgctgcagggcctgggcatcggcatgaaggccttccacaacttcaactacttcctgttcttctacaacgtgctgctgggcctgggcgcctgcctgagccggctgctgatcagctgcctgctgggcatgtggctgattgccagaattgacaggaccatcatgcagagcggctatgagggcgctgacatgggcttcagcgcctggattggcatgctgtacatggaccactaccacatcaaccctgtgctggtgtccttctgccacatcctgatcaccaaccaccgggagaagaagctgcagcagagcaccaagtactggtgcctgaaccagagcgctgagagcctgcgcatctgtgccatgaggggcggggagaacagacctccagcccgggtgcagagcagcagcgaggagctggagctgcggcaccagagcctggatgccttccctggaagaaggctgcccggccggggcatccagcctgctgccaagatgagctctgtgggcaaggtgacccaggtgcccaacgggaaggcctaccagcagatcttccaggccgaggtgcagctggtgcacagcctggccgccaccaggaagagagctgctgagaggtctgtgaccctgaagagcggccgcatccccatgatgaagaaggtggagaccccagagggggaggtgatgagcccccggcagcagaagtggatgcacagcctgcccaatgactggatcatggagaaccctgtgctgcaccgggagaaggagcgggccaagcgggagaaggcccgggagagcgagaacaccatcgccgcccgggaggtgcggggcctgatggacaccatcgtgcctgagaagatcagcaccagcaccttccagaggcaggccgagcacaagaggaagagctatgagagcgccctggccagcttccaggaggagatcgcccaggtgggcaaggagatggagcccctcatcgtggacacaggaggcctcttcctgaagaagctgacagaaagtgatgaggagatgaacagactcttcctgaaggtggagaatgacaccaacctggaggactacaccatccaggccctgctggagctgtgggacaaggtggccggccgcctgctgctgaggaagcaggagatcaaggagctggatgaggccctgcacagcctggagttcagcaggacagacaagctgaagtctgtgctgaagaagtatgcagaggtgattgagaagaccagctacctgatgaggcctgaggtgtaccgcctcatcaatgaggaggccatggtgatgaactatgccctgctgggcaacaggaaggccctggcccagctgtttgtgaacctgatggagagcaccctgcagcaggagctggacagccgccaccgctggcagggcctggtggacacctggaaggccctgaagaaggaggccctgctgcagagcttcagcgagttcatggccagcgagagcatccacaccccacctgctgtgaccaaggagctggaggtgatgctgaagacccagaatgtgctgcagcagaggcggctgaagcacctgtgcaccatctgtgacctgctgcccccatcctacagcaagacccagctgacagagtggcacagcagcctgaacagcctgaacaaggagctggacacctaccacgtggactgcatgatgaggatccggctgctgtatgagaagacctggcaggagtgcctgatgcacgtgcagaactgcaagaagcagctgctggactggaaggccttcacagaggaggaggccgagaccctggtgaaccagttcttcttccagatggtgggcgccctgcagggcaaggtggaggaggacctggagctgctggacaagagctttgagaccctggccgaccagacagagtggcagagcagccacctgttcaagtacttccaggaggtggtgcagctgtgggaggcccaccagagcgagctgctggtgcaggagctggagctggagaagaggatggagcagcaccggcagaagcacagcctggagagccaggtgcaggaggcccacctggaccggctgctggaccagctgcggcagcagagcgacaaggagaccctggccttccacctggagaaggtgaaggactacctgaagaacatgaagagccgctatgagtgcttccacaccctgctgaccaaggaggtgatggagtacccagccatcatgctgaaggagctgaacagctacagcagcgccctgagccagtacttctttgtgcgggagatctttgagcagaacctggccggggaggtgatcttcaagttccggcagcctgaggcccacgagaagcccagccagaagagggtgaagaagctgaggaagaagcagggcagcaaggaggacatgaccaggtctgaggagagcatcagcagcggcaccagcacagcccggtctgtggaggaggtggaggaggagaatgaccaggagatggagagcttcatcacagaggaggtgctgggccagcagaagaagagccccctgcacgccaagatggatgagagcaaggagggcagcatccagggcctggaggagatgcaggtggagcgggagggcagcctgaaccccagcctgaatgaggagaatgtgaagggccagggcgagaagaaggaggagagcgaggaggaggatgagaaggaggaggaggaggaggaggagaagctggaggaggagaaggaggagaaggaggcccaggaggagcaggagagcctgtctgtgggggaggaggaggacaaggaggagggcctggaggagatctactatgaggacatggagagcttcaccatcagcagcggcaacacctactttgtgtttgtgcccctggaggaggagcactgcaggaagagccacagcaccttcagcgccatgttcatcaatgacaccagcagcgccaagttcatcgagcaggtgaccatccccagccgcctcatcctggagatcaagaagcagctgttcagcgagggcggcaacttcagccccaaggagatcaacagcctgtgcagccggctggagaaggaggccgccagaattgagctggtggagagcgtcatcatgctgaacatggagaagctggagaatgagtacctggaccaggccaatgatgtgatcaacaagtttgagagcaagttccacaacctgtctgtggacctgatcttcatcgagaagatccagaggctgctgaccaacctgcaggtgaagatcaagtgccaggtggccaagagcaacagccagaccaacggcctgaacttcagcctgcagcagctgcagaacaagatcaagacctgccaggagagcagaggagagaagaccaccgtgaccacagaggagctgctgagctttgtgcagacctggaaggagaagctgagccagaggatccagtacctgaactgcagcctggacagagtgtccatgacagagctggtgttcaccaacaccatcctgaaggaccaggaggaggacagcgacatcctgaccagcagcgaggccctggaggaggaggccaagctggatgtggtgaccccagagagcttcacccagctgagccgggtgggcaagcccctgattgaggaccctgctgtggatgtgatcaggaagctgctgcagctgcccaacaccaagtggcccacccaccactgtgacaaggaccccagccagacaggcttcaagaggcaccgctgccagcctgagaacagcggcaagaaggctgtgcccagcgccagcgccaccagcgctggcagcctgcagaccacccacccccccctgagccacagcttcaccccccaccccaagcccaacaagatggagaggaagtacagagtgctgggggacaagcccccacctgctgctgaggacttcaagggcatcatcctgaccctgctgtgggagagcagcgagaacctgctgactgtggccgaggagttctacaggaaggagaagaggcctgtgaccaggccagactgcatgtgtgacacctttgaccagtgtgccgagaacatcagcaagaagatcctggagtaccagagccaggccaacaagtaccacaacagctgcctgattgagctgcgcatccagatccgccgctttgaggagctgctgccccaggtgtgctggctggtgatggagaacttcaaggagcaccactggaagaagttcttcacctctgtgaaggagatccggggccagtttgaggagcagcagaagaggctggagaagaggaaggacaagaatgcccagaagctgcacctgaacctgggccaccctgtgcacttccaggagatggagagcctgcacctgtctgaggaggagcggcaggaggagctggacagcatgatccgcatgaacaaggagaagctggaggagtgcaccaggagaaatggccaggtgttcatcaccaacctggccaccttcacagagaagttcctgctgcagctggatgaggtggtgaccattgatgatgtgcaggtggccaggatggagccccccaagcagaagctgtccatgctgatccggaggaagctggccggcctgagcctgaaggaggagagcgagaagcccctgattgagcggggcagcaggaagtggccaggcatcaagcccacagaggtgaccatccagaacaagatcctgctgcagcccaccagcagcatcagcaccaccaagaccaccctgggccacctggccgctgtggaggccagagatgctgtgtacctgaagtacctggccagctttgaggaggagctgaagaggatccaggatgactgcaccagccagatcaaggaggcccagcgctggaaggacagctggaagcagagcctgcacaccatccagggcctgtatgtgtag

SEQ ID NO: 33453 - DNA, 5106 bp, Artificial Sequence
  Description of Artificial Sequence: Synthetic coding sequence
atgagaggaggagaaaatcggcccccagcccgggtgcagagcagcagcgaggagctggagctgcggcaccagagcctggatgccttccctggccggcggctgcccggccggggcatccagcctgctgccaagatgagctctgtgggcaaggtgacccaggtgcccaacgggaaggcctaccagcagatcttccaggccgaggtgcagctggtgcacagcctggccgccaccaggaagagagctgctgagaggtctgtgaccctgaagagcggccgcatccccatgatgaagaaggtggagaccccagagggggaggtgatgagcccccggcagcagaagtggatgcacagcctgcccaatgactggatcatggagaaccctgtgctgcaccgggagaaggagcgggccaagcgggagaaggcccgggagagcgagaacaccatcgccgcccgggaggtgcggggcctgatggacaccatcgtgcctgagaagatcagcaccagcaccttccagaggcaggccgagcacaagaggaagagctatgaaagtgccctggccagcttccaggaggagatcgcccaggtgggcaaggagatggagcccctgattgtggacaccggcggcctcttcctgaagaagctgacagaaagtgatgaggagatgaacagactcttcctgaaggtggagaatgacaccaacctggaggactacaccatccaggccctgctggagctgtgggacaaggtggccggccgcctgctgctgaggaagcaggagatcaaggagctggatgaggccctgcacagcctggagttcagcaggacagacaagctgaagtctgtgctgaagaagtatgcagaggtgattgagaagaccagctacctgatgaggcctgaggtgtaccgcctcatcaatgaggaggccatggtgatgaactatgccctgctgggcaacaggaaggccctggcccagctgtttgtgaacctgatggagagcaccctgcagcaggagctggacagccgccaccgctggcagggcctggtggacacctggaaggccctgaagaaggaggccctgctgcagagcttcagcgagttcatggccagcgagagcatccacaccccacctgctgtgaccaaggagctggaggtgatgctgaagacccagaatgtgctgcagcagaggcggctgaagcacctgtgcaccatctgtgacctgctgccccccagctacagcaagacccagctgacagagtggcacagcagcctgaacagcctgaacaaggagctggacacctaccacgtggactgcatgatgaggatccggctgctgtatgagaagacctggcaggagtgcctgatgcacgtgcagaactgcaagaagcagctgctggactggaaggccttcacagaggaggaggccgagaccctggtgaaccagttcttcttccagatggtgggcgccctgcagggcaaggtggaggaggacctggagctgctggacaagagctttgagaccctggccgaccagacagagtggcagagcagccacctgttcaagtacttccaggaggtggtgcagctgtgggaggcccaccagagcgagctgctggtgcaggagctggagctggagaagaggatggagcagcaccggcagaagcacagcctggagagccaggtgcaggaggcccacctggaccggctgctggaccagctgcggcagcagagcgacaaggagaccctggccttccacctggagaaggtgaaggactacctgaagaacatgaagagccgctatgagtgcttccacaccctgctgaccaaggaggtgatggagtacccagccatcatgctgaaggagctgaacagctacagcagcgccctgagccagtacttctttgtgcgggagatctttgagcagaacctggccggggaggtgatcttcaagttccggcagcctgaggcccacgagaagcccagccagaagagggtgaagaagctgaggaagaagcagggcagcaaagaagacatgaccaggtctgaggagagcatcagcagcggcaccagcacagcccggtctgtggaggaggtggaggaggagaatgaccaggagatggagagcttcatcacagaggaggtgctgggccagcagaagaagagccccctgcacgccaagatggatgagagcaaggagggcagcatccagggcctggaggagatgcaggtggagcgggagggcagcctgaaccccagcctgaatgaagaaaatgtgaagggccagggcgagaagaaggaggagagcgaggaggaggatgagaaggaggaggaggaggaggaggagaagctggaggaggagaaggaggagaaggaggcccaggaggagcaggagagcctgtctgtgggggaggaggaggacaaggaggagggcctggaggagatctactatgaggacatggagagcttcaccatcagcagcggcaacacctactttgtgtttgtgcccctggaggaggagcactgcaggaagagccacagcaccttcagcgccatgttcatcaatgacaccagcagcgccaagttcatcgagcaggtgaccatccccagccgcctcatcctggagatcaagaagcagctgcgggccggcttctttgagcacctggagaagtggtttgaccagtgcagcctgaacaccagggtgacagtggccaccaagatcaatgagctggacagcgagctggagctgcacctgcacctgcaccagccccgggcccagcagatcgagaaggacatccacaacgtgcgggctgctgagctgctgctgcaccaggagcagctggacagccactgtgccggcgtgacagagaccctgaagaagaagaggctgatgttctgccagttccaggaggagcagaatgtgcgcagcaagaacttccggctgaagatctatgacatggagcacatcttcctgaatgccaccaggagccagaagctggtgaccctgagcaacaccctgcaccaggagctgctgtcctatgtggatgtgacccaggtgtccctgcgctccttccggcagtacctggaggagagcctgggcaagctgcgctacagcaacatcgagttcatcaagcactgccgcctcttcagcgagggcggcaacttcagccccaaggagatcaacagcctgtgcagccggctggagaaggaggccgcccgcatcgagctggtggagagcgtcatcatgctgaacatggagaagctggagaatgagtacctggaccaggccaatgatgtgatcaacaagtttgagagcaagttccacaacctgtctgtggacctgatcttcatcgagaagatccagaggctgctgaccaacctgcaggtgaagatcaagtgccaggtggccaagagcaacagccagaccaacggcctgaacttcagcctgcagcagctgcagaacaagatcaagacctgccaggagagcagaggagagaagaccaccgtgaccacagaggagctgctgagctttgtgcagacctggaaggagaagctgagccagaggatccagtacctgaactgcagcctggacagagtgtccatgacagagctggtgttcaccaacaccatcctgaaggaccaggaggaggacagcgacatcctgaccagcagcgaggccctggaggaggaggccaagctggatgtggtgaccccagagagcttcacccagctgagccgggtgggcaagcccctgattgaagatcctgctgtggatgtgatcaggaagctgctgcagctgcccaacaccaagtggcccacccaccactgtgacaaggaccccagccagacaggccgcggggcctgggcctgtggcagccggggcagcagcgaggccggggccggcggcgctgtgtgcagcccccctgtgctgtgcagctgccccggccccagcagccccaagggcttcaagaggcaccgctgccagcctgagaacagcggcaagaaggctgtgcccagcgccagcgccaccagcgctggcagcttcaccccccaccccaagcccaacaagatggagaggaagtacagagtgctgggggacaagcccccacctgctgctgaggacttcaagggcatcatcctgaccctgctgtgggagagcagcgagaacctgctgactgtggccgaggagttctacaggaaggagaagaggcctgtgaccaggccagactgcatgtgtgacacctttgaccagtgtgccgagaacatcagcaagaagatcctggagtaccagagccaggccaacaagtaccacaacagctgcctgattgagctgcgcatccagatcagaagatttgaggagctgctgccccaggtgtgctggctggtgatggagaacttcaaggagcaccactggaagaagttcttcacctctgtgaaggagatccggggccagtttgaggagcagcagaagaggctggagaagaggaaggacaagaatgcccagaagctgcacctgaacctgggccaccctgtgcacttccaggagatggagagcctgcacctgtctgaggaggagcggcaggaggagctggacagcatgatccgcatgaacaaggagaagctggaggagtgcaccaggagaaatggccaggtgttcatcaccaacctggccaccttcacagagaagttcctgctgcagctggatgaggtggtgaccattgatgatgtgcaggtggccaggatggagccccccaagcagaagctgtccatgctgatccggaggaagctggccggcctgagcctgaaggaggagagcgagaagcccctcatcgagcggggcagcaggaagtggccaggcatcaagcccacagaggtgaccatccagaacaagatcctgctgcagcccaccagcagcatcagcaccaccaagaccaccctgggccacctggccgctgtggaggccagagatgctgtgtacctgaagtacctggccagctttgaggaggagctgaagaggatccaggatgactgcaccagccagatcaaggaggcccagcgctggaaggacagctggaagcagagcctgcacaccatccagggcctgtatgtgtag

SEQ ID NO: 33454 - DNA, 663 bp, Artificial Sequence
  Description of Artificial Sequence: Synthetic coding sequence
atgtggcacggcaaccacgtgcagcccggggccacccaccggcccaaccagggcctggagatgctgcagggcctgggcatcggcatcctgaccatcagcatcgtggtgggcctgatgatcctgcagatgtgcatcgccgccagcttcttcctgcagcccaagctgggcacagctgacaagcagaagcccctggccctgaacaacaggaaggccttccacaacttcaactacttcctgttcttctacaacgtgctgctgggcctgggcgcctgcctgagccggctgctgatcagctgcctgctgggcatgtggctgattgccagaattgacaggaccatcatgcagagcggctatgagggcgctgacatgggcttcagcgcctggattggcatgctgtacatggaccactaccacatcaaccctgtgctggtgtccttctgccacatcctgatcaccaaccaccgggagaagaagctgcagcagagcaccaagtactggtgcctgaaccagagcgctggcccccacgtgtctgcccggagcaggacccgctggttcctgctgcagaccctgattgacaacccccggctgaccatgcacaggaagctgaagctgggccacagcagccaggagagccagatcctgatggcctgcagcgagagctag

SEQ ID NO: 33455 - DNA, 2049 bp, Artificial Sequence
  Description of Artificial Sequence: Synthetic coding sequence
atgtggcacggcaaccacgtgcagcccggggccacccaccggcccaaccagggcctggagatgctgcagggcctgggcatcggcatgaaggccttccacaacttcaactacttcctgttcttctacaacgtgctgctgggcctgggcgcctgcctgagccggctgctgatcagctgcctgctgggcatgtggctgattgccagaattgacaggaccatcatgcagagcggctatgagggcgctgacatgggcttcagcgcctggattggcatgctgtacatggaccactaccacatcaaccctgtgctggtgtccttctgccacatcctgatcaccaaccaccgggagaagaagctgcagcagagcaccaagtactggtgcctgaaccagagcgctgagagcctgcgcatctgtgccatgaggggcggggagaacagacctccagcccgggtgcagagcagcagcgaggagctggagctgcggcaccagagcctggatgccttccctggaagaaggctgcccggccggggcatccagcctgctgccaagatgagctctgtgggcaaggtgacccaggtgcccaacgggaaggcctaccagcagatcttccaggccgaggtgcagctggtgcacagcctggccgccaccaggaagagagctgctgagaggtctgtgaccctgaagagcggccgcatccccatgatgaagaaggtggagaccccagagggggaggtgatgagcccccggcagcagaagtggatgcacagcctgcccaatgactggatcatggagaaccctgtgctgcaccgggagaaggagcgggccaagcgggagaaggcccgggagagcgagaacaccatcgccgcccgggaggtgcggggcctgatggacaccatcgtgcctgagaagatcagcaccagcaccttccagaggcaggccgagcacaagaggaagagctatgagagcgccctggccagcttccaggaggagatcgcccaggtgggcaaggagatggagcccctcatcgtggacacaggaggcctcttcctgaagaagctgacagaaagtgatgaggagatgaacagactcttcctgaaggtggagaatgacaccaacctggaggactacaccatccaggccctgctggagctgtgggacaaggtggccggccgcctgctgctgaggaagcaggagatcaaggagctggatgaggccctgcacagcctggagttcagcaggacagacaagctgaagtctgtgctgaagaagtatgcagaggtgattgagaagaccagctacctgatgaggcctgaggtgtaccgcctcatcaatgaggaggccatggtgatgaactatgccctgctgggcaacaggaaggccctggcccagctgtttgtgaacctgatggagagcaccctgcagcaggagctggacagccgccaccgctggcagggcctggtggacacctggaaggccctgaagaaggaggccctgctgcagagcttcagtgacctgctgcccccatcctacagcaagacccagctgacagagtggcacagcagcctgaacagcctgaacaaggagctggacacctaccacgtggactgcatgatgaggatccggctgctgtatgagaagacctggcaggagtgcctgatgcacgtgcagaactgcaagaagcagctgctggactggaaggccttcacagaggaggaggccgagaccctggtgaaccagttcttcttccagatggtgggcgccctgcagggcaaggtggaggaggacctggagctgctggatgtgcgggccggggactgcagcactggagagctgaggaaccccagccggctgtggcagatccggcagagcggccgggtgcacaccagcagcagcatcagccgccgctggtacaactgtggccgccacacccgggccagctgctggtgccgctcctggagctggaggcggggctggagcagcacaggccgcagcacagcctggagggcccgctgccggcggcccaccagcatcggctcctggaccaactag

SEQ ID NO: 33456 - DNA, 2712 bp, Artificial Sequence
  Description of Artificial Sequence: Synthetic coding sequence
atgagaggaggagaaaatcggcccccagcccgggtgcagagcagcagcgaggagctggagctgcggcaccagagcctggatgccttccctggccggcggctgcccggccggggcatccagcctgctgccaagatgagctctgtgggcaaggtgacccaggtgcccaacgggaaggcctaccagcagatcttccaggccgaggtgcagctggtgcacagcctggccgccaccaggaagagagctgctgagaggtctgtgaccctgaagagcggccgcatccccatgatgaagaaggtggagaccccagagggggaggtgatgagcccccggcagcagaagtggatgcacagcctgcccaatgactggatcatggagaaccctgtgctgcaccgggagaaggagcgggccaagcgggagaaggcccgggagagcgagaacaccatcgccgcccgggaggtgcggggcctgatggacaccatcgtgcctgagaagatcagcaccagcaccttccagaggcaggccgagcacaagaggaagagctatgaaagtgccctggccagcttccaggaggagatcgcccaggagatggagcccctcatcgtggacacaggaggcctcttcctgaagaagctgacagaaagtgatgaggagatgaacagactcttcctgaaggtggagaatgacaccaacctggaggactacaccatccaggccctgctggagctgtgggacaaggtggccggccgcctgctgctgaggaagcaggagatcaaggagctggatgaggccctgcacagcctggagttcagcaggacagacaagctgaagtctgtgctgaagaagtatgcagaggtgattgagaagaccagctacctgatgaggcctgaggtgtaccgcctcatcaatgaggaggccatggtgatgaactatgccctgctgggcaacaggaaggccctggcccagctgtttgtgaacctgatggagagcaccctgcagcaggagctggacagccgccaccgctggcagggcctggtggacacctggaaggccctgaagaaggaggccctgctgcagagcttcagcgagttcatggccagcgagagcatccacaccccacctgctgtgaccaaggagctggaggtgatgctgaagacccagaatgtgctgcagcagaggcggctgaagcacctgtgcaccatctgtgacctgctgcccccatcctacagcaagacccagctgacagagtggcacagcagcctgaacagcctgaacaaggagctggacacctaccacgtggactgcatgatgaggatccggctgctgtatgagaagacctggcaggagtgcctgatgcacgtgcagaactgcaagaagcagctgctggactggaaggccttcacagaggaggaggccgagaccctggtgaaccagttcttcttccagatggtgggcgccctgcagggcaaggtggaggaggacctggagctgctggacaagagctttgagaccctggccgaccagacagagtggcagagcagccacctgttcaagtacttccaggaggtggtgcagctgtgggaggcccaccagagcgagctgctggtgcaggagctggagctggagaagaggatggagcagcaccggcagaagcacagcctggagagccaggtgcaggaggcccacctggaccggctgctggaccagctgcggcagcagagcgacaaggagaccctggccttccacctggagaaggtgaaggactacctgaagaacatgaagagccgctatgagtgcttccacaccctgctgaccaaggaggtgatggagtacccagccatcatgctgaaggagctgaacagctacagcagcgccctgagccagtacttctttgtgcgggagatctttgagcagaacctggccggggaggtgatcttcaagttccggcagcctgaggcccacgagaagcccagccagaagagggtgaagaagctgaggaagaagcagggcagcaaggaggacatgaccaggtctgaggagagcatcagcagcggcaccagcacagcccggtctgtggaggaggtggaggaggagaatgaccaggagatggagagcttcatcacagaggaggtgctgggccagcagaagaagagccccctgcacgccaagatggatgagagcaaggagggcagcatccagggcctggaggagatgcaggtggagcgggagggcagcctgaaccccagcctgaatgaggagaatgtgaagggccagggcgagaagaaggaggagagcgaggaggaggatgagaaggaggaggaggaggaggaggagaagctggaggaggagaaggaggagaaggaggcccaggaggagcaggagagcctgtctgtgggggaggaggaggacaaggaggagggcctggaggagatctactatgaggacatggagagcttcaccatcagcagcggcaacacctactttgtgtttgtgcccctggaggaggagcactgcaggaagagccacagcaccttcagcgccatgttcatcaatgacaccagcagcgccaagttcatcgagcaggtgaccatccccagccgcctcatcctggagatcaagaagcaccgggcctggtggtgtgtgcctgtgatcccagccacccaggaggccgaggccggggagagccctgagcccaggagaagaaggctgcagtag

SEQ ID NO: 33457 - DNA, 5106 bp, Artificial Sequence; identical to SEQ ID NO: 33453
  Description of Artificial Sequence: Synthetic coding sequence

SEQ ID NO: 33458 - DNA, 2700 bp, Artificial Sequence
  Description of Artificial Sequence: Synthetic coding sequence
ggccggcctgctgctgtggtggccggccctgccctggccgccctgcgggagagcctgcgcatctgtgccatgaggggcggggagaacagacctccagcccgggtgcagagcagcagcgaggagctggagctgcggcaccagagcctggatgccttccctggaagaaggctgcccggccggggcatccagcctgctgccaagatgagctctgtgggcaaggtgacccaggtgcccaacgggaaggcctaccagcagatcttccaggccgaggtgcagctggtgcacagcctggccgccaccaggaagagagctgctgagaggtctgtgaccctgaagagcggccgcatccccatgatgaagaaggtggagaccccagagggggaggtgatgagcccccggcagcagaagtggatgcacagcctgcccaatgactggatcatggagaaccctgtgctgcaccgggagaaggagcgggccaagcgggagaaggcccgggagagcgagaacaccatcgccgcccgggaggtgcggggcctgatggacaccatcgtgcctgagaagatcagcaccagcaccttccagaggcaggccgagcacaagaggaagagctatgagagcgccctggccagcttccaggaggagatcgcccaggtgggcaaggagatggagcccctcatcgtggacacaggaggcctcttcctgaagaagctgacagaaagtgatgaggagatgaacagactcttcctgaaggtggagaatgacaccaacctggaggactacaccatccaggccctgctggagctgtgggacaaggtggccggccgcctgctgctgaggaagcaggagatcaaggagctggatgaggccctgcacagcctggagttcagcaggacagacaagctgaagtctgtgctgaagaagtatgcagaggtgattgagaagaccagctacctgatgaggcctgaggtgtaccgcctcatcaatgaggaggccatggtgatgaactatgccctgctgggcaacaggaaggccctggcccagctgtttgtgaacctgatggagagcaccctgcagcaggagctggacagccgccaccgctggcagggcctggtggacacctggaaggccctgaagaaggaggccctgctgcagagcttcagcgagttcatggccagcgagagcatccacaccccacctgctgtgaccaaggagctggaggtgatgctgaagacccagaatgtgctgcagcagaggcggctgaagcacctgtgcaccatctgtgacctgctgcccccatcctacagcaagacccagctgacagagtggcacagcagcctgaacagcctgaacaaggagctggacacctaccacgtggactgcatgatgaggatccggctgctgtatgagaagacctggcaggagtgcctgatgcacgtgcagaactgcaagaagcagctgctggactggaaggccttcacagaggaggaggccgagaccctggtgaaccagttcttcttccagatggtgggcgccctgcagggcaaggtggaggaggacctggagctgctggacaagagctttgagaccctggccgaccagacagagtggcagagcagccacctgttcaagtacttccaggaggtggtgcagctgtgggaggcccaccagagcgagctgctggtgcaggagctggagctggagaagaggatggagcagcaccggcagaagcacagcctggagagccaggtgcaggaggcccacctggaccggctgctggaccagctgcggcagcagagcgacaaggagaccctggccttccacctggagaaggtgaaggactacctgaagaacatgaagagccgctatgagtgcttccacaccctgctgaccaaggaggtgatggagtacccagccatcatgctgaaggagctgaacagctacagcagcgccctgagccagtacttctttgtgcgggagatctttgagcagaacctggccggggaggtgatcttcaagttccggcagcctgaggcccacgagaagcccagccagaagagggtgaagaagctgaggaagaagcagggcagcaaggaggacatgaccaggtctgaggagagcatcagcagcggcaccagcacagcccggtctgtggaggaggtggaggaggagaatgaccaggagatggagagcttcatcacagaggaggtgctgggccagcagaagaagagccccctgcacgccaagatggatgagagcaaggagggcagcatccagggcctggaggagatgcaggtggagcgggagggcagcctgaaccccagcctgaatgaggagaatgtgaagggccagggcgagaagaaggaggagagcgaggaggaggatgagaaggaggaggaggaggaggaggagaagctggaggaggagaaggaggagaaggaggcccaggaggagcaggagagcctgtctgtgggggaggaggaggacaaggaggagggcctggaggagatctactatgaggacatggagagcttcaccatcagcagcggcaacacctactttgtgtttgtgcccctggaggaggagcactgcaggaagagccacagcaccttcagcgccatgttcatcaatgacaccagcagcgccaagttcatcgagcaggtgaccatccccagccgcctcatcctggagatcaagaagtag

SEQ ID NO: 33459 - DNA, 585 bp, Artificial Sequence
  Description of Artificial Sequence: Synthetic coding sequence
atggccaagagaagagctgctgagcctgtgaccttccacgtgccctggaagaggctgctgctgtgtgactttgctgagcagcccccacctccacccctgtggatccggcccccaggagtggcccatgctggccagctgctgggcgtgcctgagcagcacaggaagaggaagattgatgctggcaccatggccgagcccagcgccagccccagcaagagaagagacagcggggacaacagcgcccccagcggccaggagcgggaggaccacggcctggagaccggggacccccccctgcccccacctcctgtgctgcccggccctggagaggagctgcccggggcccggctgcccggcggcggcggagatgatggagctggccgggccggcccccccaggggggactggggcgtggccagccggcagcacaatgaggagttctggcagtacaacaccttccagtactggaggaaccccctgccccccatcgacctggccgacatcgaggacctgtctgaggacaccctgacagaggccaccctgcagggcagaaatgaaggagctgaggtggacatggagagctag

SEQ ID NO: 33460 - DNA, 558 bp, Artificial Sequence
  Description of Artificial Sequence: Synthetic coding sequence
atgcccaggctcttcctgttccacctgctggagttctgcctgctgctgaaccagttcagcagagctgtggccgccaagtggaaggatgatgtgatcaagctgtgtggccgggagctggtgcgggcccagatcgccatctgtggcatgagcacctggagcaagaggagcctgagccaggaggatgccccccagacccccaggcctgtggccgagatcgtgcccagcttcatcaacaaggacacagagaccatcatcatcatgctggagttcatcgccaacctgcccccagagctgaaggccgccctgtctgagcggcagcccagcctgcctgagctgcagcagtatgtgcctgccctgaaggacagcaacctgagctttgaggagttcaagaagctgatccggaaccggcagagcgaggccgctgacagcaaccccagcgagctgaagtacctgggcctggacacccacagccagaagaagagaagaccctacgtggccctgtttgagaagtgctgcctgattggctgcaccaagaggagcctggccaagtactgctag

SEQ ID NO: 33461 - DNA, 486 bp, Artificial Sequence
  Description of Artificial Sequence: Synthetic coding sequence
atgaagaagattgagatcagcggcacctgcctgtccttccacctgctgtttggcctggagatccgcatgaggcgcatcgtgtttgctggggtcatcctcttccggctgctgggcgtcatcctcttccggctgctgggcgtcatcctgtttggccgcctgggggacctgggcacctgccagaccaagccaggccagtactggaaggaggaggtgcacatccaggatgtgggcggcctcatctgccgggcctgcaacctgagcctgcccttccacggctgcctgctggacctgggcacctgccaggccgagcccggccagtactgcaaggaggaggtgcacatccagggcggcatccagtggtacagcgtgaagggctgcaccaagaacaccagcgagtgcttcaagagcaccctggtgaagaggatcctgcagctgcacgagctggtgaccacccactgctgcaaccacagcctgtgcaacttctag

SEQ ID NO: 33462 - DNA, 384 bp, Artificial Sequence
  Description of Artificial Sequence: Synthetic coding sequence
atgggcgtgggcttcacagagctggagtacctggccccctggctgcggccccccttcagtgacctgggcacctgccagaccaagccaggccagtactggaaggaggaggtgcacatccaggatgtgggcggcctcatctgccgggcctgcaacctgagcctgcccttccacggctgcctgctggacctgggcacctgccaggccgagcccggccagtactgcaaggaggaggtgcacatccagggcggcatccagtggtacagcgtgaagggctgcaccaagaacaccagcgagtgcttcaagagcaccctggtgaagaggatcctgcagctgcacgagctggtgaccacccactgctgcaaccacagcctgtgcaacttctag

SEQ ID NO: 33463 - DNA, 513 bp, Artificial Sequence
  Description of Artificial Sequence: Synthetic coding sequence
atgcagaacagaacaggcctcatcctgtgtgccctggccctgctgatgggcttcctgatggtgtgcctgggcgccttcttcatctcctggggcagcatctttgactgccagggcagcctgattgctgcctacctgctgctgcccctgggctttgtgatcctgctgagcggcatcttctggagcaactaccggcaggtgacagagagcaagggcgtgctgcggcacatgctgcggcagcacctggcccatggagccctgcctgtggccaccgtggacagaccagacttctaccccccagcctatgaggagagcctggaggtggagaagcagagctgcccagctgagcgggaggccagcggcatccccccacccctgtacacagaaacaggcctggagttccaggatggaaatgacagccaccctgaggccccacccagctaccgggagagcattgctggcctggtggtgacagccatcagtgaagatgcccagaggcggggccaggagtgctag

SEQ ID NO: 33464 - DNA, 4338 bp, Artificial Sequence
  Description of Artificial Sequence: Synthetic coding sequence
atgggcaacctggtgatccccctgggcaagggccgggccggccgggtggagagcggccagagaattcctcctccagccccccggcccagcgtggagtgcacaggagatgacatcgccctgcagatggagaagatgctgttccccctgaagagccccagcgccacctggctgagccccagcagcaccccctggatgatggacttcatcctgacctctgtgtgtggcctggtgctgctcttcctgctgctgctgtatgtgcacagcgacccccccagccccccacctggcaggaagaggagcagccgggagccccagcgggagaggagcggccgcagccgcagcaggaagatcagcgccctgaaggcctgccgcatcctgctgcgggagctggaggagacccgggacctgaactacctgctggagagccacctgaggaagctggccggggagggcagcagccacctgcccctgggcggggaccccctgggagatgtgtgcaagcctgtgcctgccaaggcccaccagccccacggcaagtgcatgcaggaccccagccctgccagcctgagccccccagcccccccagcccccctggccagcaccctgagccctggccccatgaccttcagcgagcccttcggcccccacagcaccctgagcgccagcggccccccagagcccctgctgcccctgaagtgcccagccacccagccccacgtggtgtttcctcccagcccccagccccacggccccctggccagcagccccccacctccagacagcagcctggccggcctgcagtgtggcagcaccacctgccctgtgccccagagcagccccctgcacaaccaggtgctgcccccacccaccagggtcatcagcggcctgggctgcagcagtgaccccatctgggacctgtactgctggagggaggccgccaccacctggggcctgagcacctacagccacggcaagagccagcccaggcacctgcctgaccacaccagcgaggccagcttctggggagaccccacccccaagcacatggaggtgggcggctgcaccttcatccacccagatgtgcagaagctgctggagaccctgattgccaagagggccctgatgaagatgtggcaggagaaggagaggaagagagctgaccacccccacatgaccagcctgggcaaggagtgggacatcaccaccctgaaccccttctggaatgtgtccacccagccccagcagctgccccggccccagcaggtgtctgatgccaccaccgtgggcaaccacctgcagcagaagaggagccagctgttctgggacctgcccagcctgaacagcgagagcctggccaccaccgtgtgggtgtccaggaaccccagcagccagaatgcccacagcgtgcccctggacaaggccagcaccagcctgcctggagagcctgaggtggaggccagcagccagctgagccaggccccaccccagccccaccacatggcccagccccagcacttcaccccagcctggccccagagccagcccccacccctggccgagatccagacccaggcccacctgagcccccctgtgcccagcctgggctgcagcagccccccccagatccggggctgtggggccagctaccccaccagccaggagaggacccagagcgtcatccccaccgggaaggagtacctggagtggcccctgaagaagaggcccaagtggaagagggtgctgcccagcctgctgaagaagagccaggccgtgctgagccagcccacagcccacctgccccaggagaggcctgcctcctggagccccaagagcgcccccatcctgcccggggtggtgaccagccctgagctgcctgagcactggtggcagggcagaaatgccatccaccaggagcagagctgtggcccccccagccggctgcaggccagcggggacctgctgcagccagatggagagttccctggccggccccagagccaggccgaggacacccagcaggccctgctgcccagccagcccagcgactttgctgggaagggcaggaaggatgtgcagaagacaggcttccgcagcagcggccgcttcagtgacaagggctgcctgggcagcaagctgggccctgaccccagccgggaccagggcagcggccgcacctctgtgaaggccctggatgaggacaaggaggccgagggggacctgcggcgctcctggaagtaccagagcgtgagcagcaccccccgggaccctgacaaggagcacctggagaacaagctgcagatccacctggccaggaaggtgggggagatcaaggagggctggatccccatgcctgtgcggcgctcctggctgatggccaagtgtgctgtgcccaagagtgacacccacaggaagccaggcaagctggcctcctggaggggcggcaaggcccacgtgaacaccagccaggagctgtccttcctgcacccctgcacccagcagatcctggaggtgcacctggtgcgcttctgtgtgcgccacagctggggcacagacctgcagagcctggagcccatcaacgtgtggagcggggaggcccaggccccacccttcccccagagcaccttcaccccctgggcctcctgggtgtcccgggtggagagcgtgcccaaggtgcccatcttcctgggcaagaggccccagaatggacctggggacaacagaaccaccagcaagtctgtgcccaccgtgtctggccccctggccgcccctcctcctgagcaggagggcgtgcagaggcctccccggggcagccagagcgctgacacccacggccgctctgaggccttccccaccggccacaagggccggggctgcagccagccccccacctgcagcctggtgggccgcacctggcagagcaggacagtgctggagagcggcaagcccaagccccggctggagggctccatgggcagcgagatggctggaaatgaggcctggctggagagcgagagcatgagccctggggacccctgcagcagccgggccctgcaggtgctgagcatcggcagccagtgggcccgggcagaagatgccctgcaggccctgaaggtgggggagaagccacccacctgggaggtgaccctgggcgcctctgtgcgggccagcagcggctctgtgcaggaggacctgcggagcactggagccctgggcaccactggaaaccccagcgccagctctgtgtgtgtggcccaggaccctgagcagctgcacctgaaggcccaggtggtgtctgagatcgccctgattgtgcaggtggacagcgaggagcagctgcccggccgggcccctggcatcctgctgcaggatggagccaccggcctgtgcctgcccggccgccacatggacatgctgacagctgctgaccggctgcccacccaggcccccctgagcaccagccagagcgtgtctgggaagaacatgacagccagccagggcccctgtgccctgctgtggaagggcggggacagccctggccagcaggagcccggcagccccaaggccaaggccccccagaagagccagaagaccctgggctgtgccgacaagggggaggcccaccggcggcccaggactggagagcagggccacaggagcaagggccccaggaccagcgaggccagcggccgcagccacccagcccaggcccgggagattggagacaagcaggagaggaagtacaaccagctgcagctggagaagggccagaccccacctgagagccacttccagaggaagatcagccaccacccccagggcctgcaccccaggaagggcggcacccgctgggaggatgtgctgcagaagggcaagccaggagcagatgccttccagagctggggcagcggccccccccggcagttcatggactgcatggctgacaaggcctggaccatcagccgggtggtgggccagatcctggtggacaagctgggcctgcagtggggccggggccccagcgaggtgaacagacacaagggggacttccgggcccaggagaatgtgcccagctgctgccaccggggccactgccaccaggagaggagccgggagatgagggccctggcctgcagccccaaggccacccccaagggccaccactgccctgtgaagaacagaggcatccgggaccgggacagctcctgggcccccccaccccgggagcctgtgtccccagctggcccccaccaccaccggcccaggatggccagcaccagcggcggcccccacccccagctgcaggagctgatgtctgcccagcgctgcctggccagctag

SEQ ID NO: 33465 - DNA, 1761 bp, Artificial Sequence
  Description of Artificial Sequence: Synthetic coding sequence
atggaggtgggcggctgcaccttcatccacccagatgtgcagaagctgctggagaccctgattgccaagagggccctgatgaagatgtggcaggagaaggagaggaagagagctgaccacccccacatgaccagcctgggcaaggagtgggacatcaccaccctgaaccccttctggaatgtgtccacccagccccagcagctgccccggccccagcaggtgtctgatgccaccaccgtgggcaaccacctgcagcagaagaggagccagctgttctgggacctgcccagcctgaacagcgagagcctggccaccaccgtgtgggtgtccaggaaccccagcagccagaatgcccacagcgtgcccctggacaaggccagcaccagcctgcctggagagcctgaggtggaggccagcagccagctgagccaggccccaccccagccccaccacatggcccagccccagcacttcaccccagcctggccccagagccagcccccacccctggccgagatccagacccaggcccacctgagcccccctgtgcccagcctgggctgcagcagccccccccagatccggggctgtggggccagctaccccaccagccaggagaggacccagagcgtcatccccaccgggaaggagtacctggagtggcccctgaagaagaggcccaagtggaagagggtgctgcccagcctgctgaagaagagccaggccgtgctgagccagcccacagcccacctgccccaggagaggcctgcctcctggagccccaagagcgcccccatcctgcccggggtggtgaccagccctgagctgcctgagcactggtggcagggcagaaatgccatccaccaggagcagagctgtggcccccccagccggctgcaggccagcggggacctgctgcagccagatggagagttccctggccggccccagagccaggccgaggacacccagcaggccctgctgcccagccagcccagcgactttgctgggaagggcaggaaggatgtgcagaagacaggcttccgcagcagcggccgcttcagtgacaagggctgcctgggcagcaagctgggccctgaccccagccgggaccagggcagcggccgcacctctgtgaaggccctggatgaggacaaggaggccgagggggacctgcggcgctcctggaagtaccagagcgtgagcagcaccccccgggaccctgacaaggagcacctggagaacaagctgcagatccacctggccaggaaggtgggggagatcaaggagggctggatccccatgcctgtgcggcgctcctggctgatggccaagtgtgctgtgcccaagagtgacacccacaggaagccaggcaagctggcctcctggaggggcggcaaggcccacgtgaacaccagccaggagctgtccttcctgcacccctgcacccagcagatcctggaggtgcacctggtgcgcttctgtgtgcgccacagctggggcacagacctgcagagcctggagcccatcaacgtgtggagcggggaggcccaggccccacccttcccccagagcaccttcaccccctgggcctcctgggtgtcccgggtggagagcgtgcccaaggtgcccatcttcctgggcaagaggccccagaatggacctggggacaacagaaccaccagcaagtctgtgcccaccgtgtctggccccctggccgccactggagtgacagccaccaagaatgtggccgagaggtag

SEQ ID NO: 33466 - DNA, 1029 bp, Artificial Sequence
  Description of Artificial Sequence: Synthetic coding sequence
atggcctgtgagccccaggtggaccccggggccaccggccccctgccccccagcagccctggctggagcgccctgcccggcggcagccccccaggctggggccaggagctgcacaacggccaggtgctgactgtgctgagaattgacaacacctgtgcccccatcagctttgacctgggcgctgctgaggagcagctgcagacctggggcatccaggtgcctgctgaccagtaccgcagcctggccgagagcgccctgctggagccccaggtgcggcgctacatcatctacaacagccggcccatgaggctggcctttgctgtggtgttctacgtggtggtgtgggccaacatctacagcaccagccagatgtttgccctgggcaaccactgggccggcatgctgctggtgaccctggccgctgtgtccctgaccctgaccctggtgctggtgtttgagcggcaccagaagaaggccaacaccaacacagacctgcggctggccgccgccaatggagccctgctgcggcaccgggtgctgctgggcgtgacagacacagtggagggctgccagagcgtcatccagctgtggtttgtgtactttgacctggagaactgtgtgcagttcctgagtgaccacgtgcaggagatgaagaccagccaggagagcctgctgcggagccggctgagccagctgtgtgtggtgatggagaccggggtgtccccagccacagctgagggccctgagaacctggaggatgcccccctgctgcccggcaacagctgccccaatgaaagacccctgatgcagacagagctgcaccagctggtgcctgaggccgagcctgaggagatggcccggcagctgctggccgtgtttggaggctactacatccggctgctggtgaccagccagctgccccaggccatgggcaccaggcacaccaacagcccccgcatcccctgcccctgccagctgattgaggcctacatcctgggcaccggctgctgccccttcctggccaggtag

SEQ ID NO: 33467 - DNA, 1032 bp, Artificial Sequence
  Description of Artificial Sequence: Synthetic coding sequence
atggcctgtgagccccaggtggaccccggggccaccggccccctgccccccagcagccctggctggagcgccctgcccggcggcagccccccaggctggggccaggagctgcacaacggccaggtgctgactgtgctgagaattgacaacacctgtgcccccatcagctttgacctgggcgctgctgaggagcagctgcagacctggggcatccagcaggtgcctgctgaccagtaccgcagcctggccgagagcgccctgctggagccccaggtgcggcgctacatcatctacaacagccggcccatgaggctggcctttgctgtggtgttctacgtggtggtgtgggccaacatctacagcaccagccagatgtttgccctgggcaaccactgggccggcatgctgctggtgaccctggccgctgtgtccctgaccctgaccctggtgctggtgtttgagcggcaccagaagaaggccaacaccaacacagacctgcggctggccgccgccaacggggccctgctgcggcaccgggtgctgctgggcgtgacagacacagtggagggctgccagagcgtcatccagctgtggtttgtgtactttgacctggagaactgtgtgcagttcctgagtgaccacgtgcaggagatgaagaccagccaggagagcctgctgcggagccggctgagccagctgtgtgtggtgatggagactggagtgtccccagccacagctgagggccctgagaacctggaggatgcccccctgctgcccggcaacagctgccccaatgaaagacccctgatgcagacagagctgcaccagctggtgcctgaggccgagcctgaggagatggcccggcagctgctggccgtgtttggaggctactacatccggctgctggtgaccagccagctgccccaggccatgggcaccaggcacaccaacagcccccgcatcccctgcccctgccagctgattgaggcctacatcctgggcaccggctgctgccccttcctggccaggtag

SEQ ID NO: 33468 - DNA, 2136 bp, Artificial Sequence
  Description of Artificial Sequence: Synthetic coding sequence
atggcccggagccgcagccgcagcccccgctggaagcacaggagcctgagccctgtgcccagaaatgctgagcactacaagcagaggcacagccacggccactacggctgtgagtacaggaaggaccccaagaggcctgtggcctggaggatggattctgagaagcacggccagagcaagccccgcatccccagccggggcaacatctactaccagagctatgagcacaggagccccagccccaacatccggaacagcctggagaatgtgtacatgtacaagccccaccggggctacagccctggccgcggggacagcaacagaagagcccagtacatgcccaagtacagcgagggcatcccctacaaggagcatgaaagaaattcctacccccagaaggtgcagggcggccacagcccagatgaccaccgggtgcggggcagcggcaagggcggcaagccaccccagaggagcattgctgacagcttccgctttgagggcaagtggcatgaagatgagctgcggcaccagaggatccaggaggagaagtacagccagagcacccggcggggctctgaagattttgagaccaggagcagcttccagaagcgctacccagaagatcgggacttcagaaaatatggccacaccagcaagaggcccaaggatgtggagagatatgagagccgggagcccgccaggaaccccaagtggaagccagagcacagcctgcccccctaccaggaggacacagaccagtggaacctgggcccccagacctacagacatgctgagcgggagcaccctgagaccagcagcgccaccaaggtgtcctatgactaccgccacaagaggcccaagctgctggatggagaccaggacttcagtgatggccgcacccagaagtactgcaaggaggaggacaggaagtacagcttccagaagggccccctgaaccgggagctggactgcttcaacacaggccggggccgggagacccaggacggccaggtgaaggagcccttcaagcccagcaagaaggacagcatcgcctgcacctacagcaacaagaatgatgtggacctgcggagcagcaatgacaagtggaaggagaagatcaagaaggagggggactgcaggaaggagagcaacagcagcagcaaccagctggacaagagccagaagctgcctgatgtgaagcccagccccatcaacctgaggaagaagagcctgactgtgaaggtggatgtgaagaagacagtggacaccttccgggtggccagcagctacagcacagagcggcagatgagccatgacctggtggccgtgggcaggaagtctgagaacttccaccctgtgtttgagcacctggacagcacccagaacacagagaacaagcccaccggggagtttgcccaggagatcatcaccatcatccaccaggtgaaggccaactacttccccagccctggcatcaccctgcacgagcgcttcagcaccatgcaggacatccacaaggcagatgtgaatgagatccccctgaacagcgaccctgagatccacagaagaattgacatgagcctggccgagctgcagagcaagcaggccgtcatctatgaaagtgagcagaccctcatcaagatcatcgaccccaatgacctgcggcatgacatcgagaggaggaggaaggagcggctgcagaatgaagatgagcacatcttccacatcgccagcgctgctgagagagatgaccagaacagcagcttcagcaaggtgaagaatgtgcacacagatggcttccagaagcccacccacttcatcaagagcaacttcagaaaatgtattgagaagccctacatgaactacaccacccagaggaaggacatcatcacccacaagccctttgaggtggagggcaaccacaggaacaccagggtgcggcccttcaagagcaacttccggggcggccgctgccagcccaactacaagagcggcctggtgcagaagagcctgtacatccaggccaagtaccagaggctgcgcttcaccggcccccggggcttcatcacccacaagttccgggagcggctgatgaggaagaagaaggagtacacagatgtggccaccggcatctag

SEQ ID NO: 33469 - DNA, 1509 bp, Artificial Sequence
  Description of Artificial Sequence: Synthetic coding sequence
atggccatccacctggacaagcagaacatcatcctgaagaatgacaaggatgagtacctgaagaagaccagagatggagtgctgcccccctaccaggatgccaagccacccagccctgccagcatcaagaagacctacaccaccagcaagttcaatgatgctgagcccgccaagggcaacctcttcatcggcgtggaggtgctgcctgagaacctgcacctggatgaaagtgagaccagcgaggaggaccacggcagcctggagaaggagaagtatgagcagttcctgagcctggaggagggcaccaaggcccactacttctttgagaaggtggtgaatgctgcccagacctggttcagcctgtttggctggccagagggcccccacagcttcagcatccctgagaccatcagaagagatgtgtacaagatgcagttctacagcagcaccagccccccccagaagttcagccggcagaatgacttcagcaagtacaacaagaccatctatgatgtgctgctgcacctgagcggcaagatgcctcctggcatcaacagcagccagagcctgcctgtggacaaccacgagaagagggtcatccagctgcacctgcagcacagcagcctgctggacttcctgaatgcccagggcggctgcatcagccacgtgctgcctgagttcctgctggagcctgaggactacaagcgctggattgagatcatgagcagcaccaacaccatgcctgtgagcagctgcacccccaagaagaagtgcagcatcgtcatcgagatgagcaagtttgaggcctggagcaagagggcctggacagatgtgttcctgcagatctacaaggtgctggtgctgagccgggtggtgccctactgcagcaacaacatgccacccatctgtgtgcagaacacccccaaggtgaacccctgctttgccagcagcaacatctacagcgacagcgagcgcatcctgctgtcctggatgaacatcaactatgagaacaccaggcatgtgatctggaagaactgccacaaggatgtgatccccagcgagcgctggatcgtgaactttgacaaggacctgagtgatggcctggtgtttgccacccagctgggcgcctactgccccttcctgattgagagccacttcatcaacatgtacacccggcccaagagccctgaggagtacctgcacaactgcctgatcatcgtgaacaccctgtatgaaattgactttgatgtggagatccaggtgtgcctgcgggtcttccccaaggagatggatgctggggtgtctggcctgaggaaggaggacatgcccagcgtgtgggtggtgaccatccggctggccgtggccgtggcccggaccaagaggcagaagaagggggacatccagtttgcctgcttctttgtgtgcctcttcttcttcatctttgtggtgatctccttcagcctgtggagcaggatgcacttcttcctgctgctgcccctggacatctag

SEQ ID NO: 33470 - DNA, 1509 bp, Artificial Sequence; identical to SEQ ID NO: 33469
  Description of Artificial Sequence: Synthetic coding sequence

SEQ ID NO: 33471 - DNA, 471 bp, Artificial Sequence
  Description of Artificial Sequence: Synthetic coding sequence
atgctgctgaactacatccctgtgtgctacaagatcctgcacctgaccggggaggtgaagagccctgagctgctgtttgacccccccttcatcttcttcacccctgtgcccctggacatcaccaccgtgatggacatcaacatcctgccccagaactacttcaggaacagcaccctgtgtgtgcagatccccaccgtgcggctgctggatggagaggagatccaccccctgtctgtgaagttccccaagggccgggtcatccctggcagccacagcggcatcaacaacaagctgacctgccacctgtccttcaagagcagcaagcctgtgtccttcttcaccaacctgctcttctgtgatgacaggaagaactggtgcttccacttccagctgctgcagcagcagaagacagccttcctgctcttcacccacatctggcagttcatctggatcagcaagaccctcttctag

SEQ ID NO: 33472 - DNA, 462 bp, Artificial Sequence
  Description of Artificial Sequence: Synthetic coding sequence
atgctgctgaactacatccctgtgtgctacaagatcctgcacctgaccggggaggtgaagagccctgagctgctgtttgacccccccttcatcttcttcacccctgtgcccctggacatcaccaccgtgatggacatcaacatcctgccccagaactacttcaggaacagcaccctgtgtgtgcagatccccaccgtgcggctgctggatggagaggagatccaccccctgtctgtgaagttccccaagggccgggtcatccctggcagccacagcggcatcaacaacaagctgacctgccacctgtccttcaagagcagcaagcctgtgtccttcttcaccaacctgctcttctgtgatgacaggaagaactggtgcttccacttccagctgctgcagcagcagaagacagccttcctgctcttcacccacatctggcagttcatctggatcagcaagtag

SEQ ID NO: 33473 - DNA, 1086 bp, Artificial Sequence
  Description of Artificial Sequence: Synthetic coding sequence
atgaacctggtgatctgtgtgctgctgctgagcatctggaagaacaactgcatgaccaccaaccagaccaacggcagcagcaccactggagacaagcctgtggagagcatgcagaccaagctgaactacctgcggaggaacctgctgatcctggtgggcatcatcatcatggtgtttgtgttcatctgcttctgctacctgcactacaactgcctgagtgatgatgccagcaaggccggcatggtgaagaagaagggcattgctgccaagagcagcaagaccagcttcagcgaggccaagacagccagccagtgcagccctgagacccagcccatgctgagcacagctgacaagagcagtgacagcagcagccctgagcgggccagcgcccagagcagcacagagaagctgatccggcccagcagcctgcagaagcccagcatccccaacagcgctgggaagctgacccggcccagctaccccaagaggagcagcaagagcagctgcagcaagaagctgagcaagagcagccacctggagaaggcccacaagaagggcagcctggagaagctgtgcaagctggactatgcctgcaagctggccagcagtgacaagcctgtgcggcccccccagctgttcaagcccctgtacagcagccacccccagaatgagatcagccccagcaagcccttcggcccccaggagctggccaagccacccaagcacttcaaccccaagaggtctgtgtccctgggccgggccgccctgctgagcaacagcgagctggccgagacctgccagccctacaagaagaagcacctggtggccaagacctaccggcccctggtgaatgacatcagcgaggccaaggagaagaacacccagaacctgcacgtgagcagcaaggtgaagagcagcagccgctccttcaggaagctggacagcaggaacaatgcctacggggaccacgtgaatgacagcgacaccatgaagtactacagcgaggtggacagcgacaaggtgatcatcatcacctgtgaccggggctacaaccaggtgaccagcgaggtgaccctgaatgactag

SEQ ID NO: 33474 - DNA, 300 bp, Artificial Sequence
  Description of Artificial Sequence: Synthetic coding sequence
atggagccccagaagctgctgatcatcggcttcctgctgtgcagcctgacctgcctgctgctggagaccgtggccagcagccccctgcccctgagcgccctgggcatccaggagaagacaggcagcaagcccaggtctgggggcaaccaccgctcctggctgaacaacttccgggactacctgtggcagctgatcaagagcgccctgcccccagctgccatcgtggccttcctgctgaccagcgccctgatgggcatcctgtgctgcttcaccatcctggtggtggaccctgtgcactag

SEQ ID NO: 33475 - DNA, 6054 bp, Artificial Sequence
  Description of Artificial Sequence: Synthetic coding sequence
atgagcctgggcctggcccgggcccaggaggtggagctgaccctggagaccgtcatccagaccctggagagctctgtgctgtgccaggagaagggcctgggcgcccgggacctggcccaggatgcccagatcaccagcctgcctgccctgatccgggagatcgtgaccaggaacctgagccagcctgagagccctgtgctgctgcctgccacagagatggccagcctgctgagcctgcaggaggagaaccagctgctgcagcaggagctgagccgggtggaggacctgctggcccagagcagagctgagagagatgagctggccatcaagtacaatgctgtgtctgagcggctggagcaggccctgcggctggagcccggggagctggagacccaggagccccggggcctggtgcggcagagcgtggagctgcggcggcagctgcaggaggagcaggccagctacagaaggaagctgcaggcctaccaggagggccagcagaggcaggcccagctggtgcagaggctgcagggcaagatcctgcagtacaagaagcgctgcagcgagctggagcagcagctgctggagaggtctggagagctggagcagcagaggctgcgggacacagagcacagccaggacctggagagcgccctgatccggctggaggaggagcagcagaggtctgccagcctggcccaggtgaatgccatgctgcgggagcagctggaccaggccggcagcgccaaccaggccctgtctgaggacatcaggaaggtgaccaatgactggacccgctgcaggaaggagctggagcaccgggaggccgcctggaggcgggaggaggagagcttcaatgcctacttcagcaatgagcacagccggctgctgctgctgtggaggcaggtggtgggcttccggcggctggtgtctgaggtgaagatgttcacagagcgggacctgctgcagctgggcggggagctggcccggaccagcagagctgtgcaggaggccggcctgggcctgagcacaggcctgcggctggccgagagcagagctgaggccgccctggagaagcaggccctgctgcaggcccagctggaggagcagctgcgggacaaggtgctgcgggagaaggacctggcccagcagcagatgcagagcgacctggacaaggctgacctgagcgcccgggtgacagagctgggcctggccgtgaagaggctggagaagcagaacctggagaaggaccaggtgaacaaggacctgacagagaagctggaggccctggagagcctgcggctgcaggagcaggccgccctggagacagaagatggagagggcctgcagcagaccctgcgggacctggcccaggccgtgctgagtgacagcgagagcggcgtgcagctgagcggcagcgagaggacagcagatgccagcaatggcagcctgcggggcctgagcggccagaggacccccagccccccaagaagaagcagccctggccggggccgcagcccccggcggggccccagccctgcctgcagcgacagcagcaccctggccctgatccacagcgccctgcacaagaggcagctgcaggtgcaggacatgaggggccgctatgaggccagccaggacctgctgggcaccctgaggaagcagctgagtgacagcgagagcgagcggcgggccctggaggagcagctgcagaggctgcgggacaagacagatggagccatgcaggcccatgaagatgcccagcgggaggtgcagaggctgcggagcgccaatgagctgctgagccgggagaagagcaacctggcccacagcctgcaggtggcccagcagcaggccgaggagctgcggcaggagcgggagaagctgcaggccgcccaggaggagctgcggcggcagagggaccggctggaggaggagcaggaggatgctgtgcaggatggagcccgggtgcggcgggagctggagaggagccaccggcagctggagcagctggagggcaagaggtctgtgctggccaaggagctggtggaggtgcgggaggccctgagccgggccaccctgcagagggacatgctgcaggccgagaaggccgaggtggccgaggccctgaccaaggccgaggccggccgggtggagctggagctgtccatgaccaagctgcgggcagaggaggccagcctgcaggacagcctgagcaagctgagcgccctgaatgaaagcctggcccaggacaagctggacctgaaccggctggtggcccagctggaggaggagaagagcgccctgcagggccggcagaggcaggccgagcaggaggccaccgtggcccgggaggagcaggagcggctggaggagctgcggctggagcaggaggtggcccggcagggcctggagggcagcctgcgggtggccgagcaggcccaggaggccctggagcagcagctgcccaccctgcggcatgagaggagccagctgcaggagcagctggcccagctgagccggcagctgagcggccgggagcaggagctggagcaggcccggcgggaggcccagaggcaggtggaggccctggagagagctgcccgggagaaggaggccctggccaaggagcacgccggcctggccgtgcagctggtggccgctgagcgggagggccgcaccctgtctgaggaggccacccggctgcggctggagaaggaggccctggagggcagcctgtttgaggtgcagaggcagctggcccagctggaggcccggcgggagcagctggaggccgagggccaggccctgctgctggccaaggagaccctgactggagagctggccggcctgcggcagcagatcatcgccacccaggagaaggccagcctggacaaggagctgatggcccagaagctggtgcaggccgagcgggaggcccaggccagcctgcgggagcagagagctgcccacgaggaggacctgcagaggctgcagcgggagaaggaggccgcctggagggagctggaggccgagcgggcccagctgcagagccagctgcagcgggagcaggaggagctgctggcccggctggaggccgagaaggaggagctgtctgaggagattgctgccctgcagcaggagagagatgagggcctgctgctggccgagagcgagaagcagcaggccctgagcctgaaggagagcgagaagacagccctgtctgagaagctgatgggcaccaggcacagcctggccaccatcagcctggagatggagcggcagaagagagatgcccagagccggcaggagcaggacaggagcacagtgaatgccctgaccagcgagctgcgggacctgcgggcccagcgggaggaggccgctgctgcccacgcccaggaggtgcggcggctgcaggagcaggcccgggacctgggcaagcagagggacagctgcctgcgggaggccgaggagctgcggacccagctgcggctgctggaggatgccagagatggcctgcggcgggagctgctggaggcccagaggaagctgcgggagagccaggagggccgggaggtgcagaggcaggaggccggggagctgcggcgcagcctgggggagggcgccaaggagcgggaggccctgcggcgcagcaatgaggagctgcggtctgctgtgaagaaggccgagagcgagcgcatcagcctgaagctggccaatgaagacaaggagcagaagctggccctgctggaggaggccaggacagctgtgggcaaggaggccggggagctgaggacaggcctgcaggaggtggagaggagccggctggaggcccggcgggagctgcaggagctgcggcggcagatgaagatgctggacagcgagaacacccggctgggccgggagctggccgagctgcagggccgcctggccctgggggagcgggcagagaaggagagcagaagagagaccctgggcctgcggcagaggctgctgaagggggaggccagcctggaggtgatgaggcaggagctgcaggtggcccagaggaagctgcaggagcaggagggggagttccgcacccgggagcggcggctgctgggcagcctggaggaggcccggggcacagagaagcagcagctggaccacgcccggggcctggagctgaagctggaggccgcccgggcagaggccgctgagctgggcctgcggctgtctgctgctgagggccgggcccagggcctggaggccgagctggcccgggtggaggtgcagaggagagctgctgaggcccagctgggcggcctgcggagcgccctgcggcggggcctgggcctgggccgggcccccagccctgcccccaggcctgtgcccggcagccctgccagagatgccccagctgagggcagcggggagggcctgaacagccccagcaccctggagtgcagccctggcagccagccccccagccctggccctgccaccagccctgccagcccagacctggaccctgaggccgtgcggggggccctgcgggagttcctgcaggagctgcggagcgcccagcgggagagagatgagctgcggacccagaccagcgccctgaaccggcagctggccgagatggaggccgagcgggacagcgccaccagccgggcccggcagctgcagaaggctgtggccgagagcgaggaggccaggagatctgtggatggccgcctgtctggagtgcaggccgagctggccctgcaggaggagagcgtgagaagaagtgagcgggagcggcgggccaccctggaccaggtggccaccctggagaggagcctgcaggccacagagagcgagctgcgggccagccaggagaagatcagcaagatgaaggccaatgagaccaagctggagggggacaagaggcggctgaaggaggtgctggatgccagcgagagcaggacagtgaagctggagctgcagaggaggagcctggagggggagctgcagaggagccggctgggcctgagtgaccgggaggcccaggcccaggccctgcaggacagagtggacagcctgcagaggcaggtggccgacagcgaggtgaaggccggcaccctgcagctgactgtggagcggctgaatggagccctggccaaggtggaggagagcgagggcgccctgcgggacaaggtgcggggcctgacagaggccctggcccagagcagcgccagcctgaacagcacccgggacaagaacctgcacctgcagaaggccctgacagcctgtgaacatgaccggcaggtgctgcaggagcggctggatgctgcccggcaggccctgtctgaggccaggaagcagagcagcagcctgggggagcaggtgcagaccctgcggggggaggtggccgacctggagctgcagagggtggaggccgagggccagctgcagcagctgcgggaggtgctgcggcagaggcaggagggggaggccgccgccctgaacacagtgcagaagctgcaggatgagcggcggctgctgcaggagcggctgggcagcctgcagagggccctggcccagctggaggccgagaagcgggaggtggagaggtctgccctgcggctggagaaggacagagtggccctgcggaggaccctggacaaggtggagcgggagaagctgcggagccatgaggacacagtgcggctgtctgctgagaagggccgcctggacaggaccctgactggagctgagctggagctggccgaggcccagaggcagatccagcagctggaggcccaggtggtggtgctggagcagagccacagccctgcccagctggaggtggatgcccagcagcagcagctggagctgcagcaggaggtggagcggctgcggagcgcccaggcccagacagagaggaccctggaggcccgggagcgggcccaccggcagagggtgcggggcctggaggagcaggtgtccaccctgaagggccagctgcagcaggagctgcggcgcagcagcgcccccttcagcccccccagcggccccccagagaagtag

SEQ ID NO: 33476 - DNA, 5697 bp, Artificial Sequence
  Description of Artificial Sequence: Synthetic coding sequence
gagaagggcctgggcgcccgggacctggcccaggatgcccagatcaccagcctgcctgccctgatccgggagatcgtgaccaggaacctgagccagcctgagagccctgtgctgctgcctgccacagagatggccagcctgctgagcctgcaggaggagaaccagctgctgcagcaggagctgagccgggtggaggacctgctggcccagagcagagctgagagagatgagctggccatcaagtacaatgctgtgtctgagcgggacacagagcacagccaggacctggagagcgccctgatccggctggaggaggagcagcagaggtctgccagcctggcccaggtgaatgccatgctgcgggagcagctggaccaggccggcagcgccaaccaggccctgtctgaggacatcaggaaggtgaccaatgactggacccgctgcaggaaggagctggagcaccgggaggccgcctggaggcgggaggaggagagcttcaatgcctacttcagcaatgagcacagccggctgctgctgctgtggaggcaggtggtgggcttccggcggctggtgtctgaggtgaagatgttcacagagcgggacctgctgcagctgggcggggagctggcccggaccagcagagctgtgcaggaggccggcctgggcctgagcacaggcctgcggctggccgagagcagagctgaggccgccctggagaagcaggccctgctgcaggcccagctggaggagcagctgcgggacaaggtgctgcgggagaaggacctggcccagcagcagatgcagagcgacctggacaaggctgacctgagcgcccgggtgacagagctgggcctggccgtgaagaggctggagaagcagaacctggagaaggaccaggtgaacaaggacctgacagagaagctggaggccctggagagcctgcggctgcaggagcaggccgccctggagacagaagatggagagggcctgcagcagaccctgcgggacctggcccaggccgtgctgagtgacagcgagagcggcgtgcagctgagcggcagcgagaggacagcagatgccagcaatggcagcctgcggggcctgagcggccagaggacccccagccccccccggcgcagcagccctggccggggccgcagcccccggcggggccccagccctgcctgcagcgacagcagcaccctggccctgatccacagcgccctgcacaagaggcagctgcaggtgcaggacatgaggggccgctatgaggccagccaggacctgctgggcaccctgaggaagcagctgagtgacagcgagagcgagcggcgggccctggaggagcagctgcagaggctgcgggacaagacagatggagccatgcaggcccatgaagatgcccagcgggaggtgcagaggctgcggagcgccaatgagctgctgagccgggagaagagcaacctggcccacagcctgcaggtggcccagcagcaggccgaggagctgcggcaggagcgggagaagctgcaggccgcccaggaggagctgcggcggcagagggaccggctggaggaggagcaggaggatgctgtgcaggatggagcccgggtgagaagagagctggagaggagccaccggcagctggagcagctggagggcaagaggtctgtgctggccaaggagctggtggaggtgcgggaggccctgagccgggccaccctgcagagggacatgctgcaggccgagaaggccgaggtggccgaggccctgaccaaggccgaggccggccgggtggagctggagctgtccatgaccaagctgcgggcagaggaggccagcctgcaggacagcctgagcaagctgagcgccctgaatgaaagcctggcccaggacaagctggacctgaaccggctggtggcccagctggaggaggagaagagcgccctgcagggccggcagaggcaggccgagcaggaggccaccgtggcccgggaggagcaggagcggctggaggagctgcggctggagcaggaggtggcccggcagggcctggagggcagcctgcgggtggccgagcaggcccaggaggccctggagcagcagctgcccaccctgcggcatgagaggagccagctgcaggagcagctggcccagctgagccggcagctgagcggccgggagcaggagctggagcaggcccggcgggaggcccagaggcaggtggaggccctggagcgggccgcccgggagaaggaggccctggccaaggagcacgccggcctggccgtgcagctggtggccgctgagcgggagggccgcaccctgtctgaggaggccacccggctgcggctggagaaggaggccctggagggcagcctgtttgaggtgcagaggcagctggcccagctggaggcccggcgggagcagctggaggccgagggccaggccctgctgctggccaaggagaccctgaccggggagctggccggcctgcggcagcagatcatcgccacccaggagaaggccagcctggacaaggagctgatggcccagaagctggtgcaggccgagcgggaggcccaggccagcctgcgggagcagagagctgcccacgaggaggacctgcagaggctgcagcgggagaaggaggccgcctggagggagctggaggccgagcgggcccagctgcagagccagctgcagcgggagcaggaggagctgctggcccggctggaggccgagaaggaggagctgtctgaggagattgctgccctgcagcaggagagagatgagggcctgctgctggccgagagcgagaagcagcaggccctgagcctgaaggagagcgagaagacagccctgtctgagaagctgatgggcaccaggcacagcctggccaccatcagcctggagatggagcggcagaagagagatgcccagagccggcaggagcaggacaggagcacagtgaatgccctgaccagcgagctgcgggacctgcgggcccagcgggaggaggccgccgccgcccacgcccaggaggtgcggcggctgcaggagcaggcccgggacctgggcaagcagagggacagctgcctgcgggaggccgaggagctgcggacccagctgcggctgctggaggatgccagagatggcctgcggcgggagctgctggaggcccagaggaagctgcgggagagccaggagggccgggaggtgcagaggcaggaggccggggagctgcggcgcagcctgggggagggcgccaaggagcgggaggccctgcggcgcagcaatgaggagctgcggtctgctgtgaagaaggccgagagcgagcgcatcagcctgaagctggccaatgaagacaaggagcagaagctggccctgctggaggaggccaggacagctgtgggcaaggaggccggggagctgaggacaggcctgcaggaggtggagaggagccggctggaggcccggcgggagctgcaggagctgcggcggcagatgaagatgctggacagcgagaacacccggctgggccgggagctggccgagctgcagggccgcctggccctgggggagagagctgagaaggagagccggcgggagaccctgggcctgcggcagaggctgctgaagggggaggccagcctggaggtgatgaggcaggagctgcaggtggcccagaggaagctgcaggagcaggagggggagttccgcacccgggagcggcggctgctgggcagcctggaggaggcccggggcacagagaagcagcagctggaccacgcccggggcctggagctgaagctggaggccgcccgggcagaggccgctgagctgggcctgcggctgtctgctgctgagggccgggcccagggcctggaggccgagctggcccgggtggaggtgcagaggagagctgctgaggcccagctgggcggcctgcggagcgccctgcggcggggcctgggcctgggccgggcccccagccctgcccccaggcctgtgcccggcagccctgccagagatgccccagctgagggcagcggggagggcctgaacagccccagcaccctggagtgcagccctggcagccagccccccagccctggccctgccaccagccctgccagcccagacctggaccctgaggccgtgcggggggccctgcgggagttcctgcaggagctgcggagcgcccagcgggagagagatgagctgcggacccagaccagcgccctgaaccggcagctggccgagatggaggccgagcgggacagcgccaccagccgggcccggcagctgcagaaggctgtggccgagagcgaggaggcccggcgctctgtggatggccgcctgagcggcgtgcaggccgagctggccctgcaggaggagagcgtgcggcgctctgagcgggagcggcgggccaccctggaccaggtggccaccctggagaggagcctgcaggccacagaaagtgagctgcgggccagccaggagaagatcagcaagatgaaggccaatgagaccaagctggagggggacaagaggcggctgaaggaggtgctggatgccagcgagagcaggacagtgaagctggagctgcagaggaggagcctggagggggagctgcagaggagccggctgggcctgagtgaccgggaggcccaggcccaggccctgcaggacagagtggacagcctgcagaggcaggtggccgacagcgaggtgaaggccggcaccctgcagctgactgtggagcggctgaatggagccctggccaaggtggaggagagcgagggcgccctgcgggacaaggtgcggggcctgacagaggccctggcccagagcagcgccagcctgaacagcacccgggacaagaacctgcacctgcagaaggccctgacagcctgtgaacatgaccggcaggtgctgcaggagcggctggatgctgcccggcaggccctgtctgaggccaggaagcagagcagcagcctgggggagcaggtgcagaccctgcggggggaggtggccgacctggagctgcagagggtggaggccgagggccagctgcagcagctgcgggaggtgctgcggcagaggcaggagggggaggccgccgccctgaacacagtgcagaagctgcaggatgaaagaaggctgctgcaggagcggctgggcagcctgcagagggccctggcccagctggaggccgagaagcgggaggtggagaggtctgccctgcggctggagaaggacagagtggccctgcggaggaccctggacaaggtggagcgggagaagctgcggagccatgaagatactgtgcggctgtctgctgagaagggccgcctggacaggaccctgaccggggctgagctggagctggccgaggcccagaggcagatccagcagctggaggcccaggtggtggtgctggagcagagccacagccctgcccagctggaggtggatgcccagcagcagcagctggagctgcagcaggaggtggagcggctgcggagcgcccaggcccagacagagaggaccctggaggcccgggagcgggcccaccggcagagggtgcggggcctggaggagcaggtgtccaccctgaagggccagctgcagcaggagctgcggcgcagcagcgcccccttcagccccccatctggccccccagagaagtag

SEQ ID NO: 33477 - DNA, 3612 bp, Artificial Sequence
  Description of Artificial Sequence: Synthetic coding sequence
atggagcaggcccccaacatggccgagccccggggccctgtggaccacggcgtgcagatccgcttcatcacagagcctgtgtctggagctgagatgggcaccctgcggcggggcggccggcggcctgccaaggatgcccgggccagcacctatggagtggccgtgcgggtgcagggcattgctggccagccctttgtggtgctgaacagcggggagaagggcggggacagctttggagtgcagatcaagggggccaatgaccagggcgccagcggggccctgagcagtgacctggagctgcctgagaacccctacagccaggtgaagggcttccctgcccccagccagagcagcaccagtgatgaggagcccggggcctactggaatggcaagctgctgcggagccacagccaggccagcctggccggccctggccctgtggaccccagcaacagaagcaacagcatgctggagctggcccccaaggtggccagccctggcagcaccatcgacacagcccccctgagctctgtggacagcctcatcaacaagtttgacagccagctgggcggccaggcccggggccgcactggaagaaggaccaggatgctgcccccagagcagaggaagaggagcaagagcctggacagccggctgccccgggacacctttgaggagcgggagcggcagagcaccaaccactggaccagcagcaccaagtatgacaaccacgtgggcaccagcaagcagcctgcccagagccagaacctgagccccctgagcggcttcagccgcagccggcagacccaggactgggtgctgcagagctttgaggagcccaggagaagtgcccaggaccccaccatgctgcagttcaagagcaccccagacctgctgcgggaccagcaggaggccgcccctcctggctctgtggaccacatgaaggccaccatctacggcatcctgcgggagggcagcagcgagagcgagacctctgtgcggaggaaggtgtccctggtgctggagaagatgcagcccctggtgatggtgagcagcggcagcaccaaggctgtggccggccagggcgagctgaccaggaaggtggaggagctgcagaggaagctggatgaggaggtgaagaagaggcagaagctggagcccagccaggtgggcctggagcggcagctggaggagaagacagaggagtgcagccggctgcaggagctgctggagaggaggaagggggaggcccagcagagcaacaaggagctgcagaacatgaagaggctgctggaccagggcgaggacctgcggcacggcctggagacccaggtgatggagctgcagaacaagctgaagcacgtgcagggccctgagcccgccaaggaggtgctgctgaaggacctgctggagacccgggagctgctggaggaggtgctggagggcaagcagagggtggaggagcagctgcggctgcgggagcgggagctgacagccctgaagggggccctgaaggaggaggtggccagccgggaccaggaggtggagcacgtgcggcagcagtaccagagggacacagagcagctgcggcgctccatgcaggatgccacccaggaccatgctgtgctggaggccgagcggcagaagatgtctgccctggtgcggggcctgcagcgggagctggaggagaccagcgaggagaccggccactggcagagcatgttccagaagaacaaggaggacctgcgggccaccaagcaggagctgctgcagctgaggatggagaaggaggagatggaggaggagctgggggagaagattgaggtgctgcagcgggagctggagcaggcccgggccagcgctggggacacccggcaggtggaggtgctgaagaaggagctgctgcggacccaggaggagctgaaggagctgcaggccgagcggcagagccaggaggtggccggccgccaccgggaccgggagctggagaagcagctggccgtgctgcgggtggaggccgaccggggccgggagctggaggagcagaacctgcagctgcagaagaccctgcagcagctgcggcaggactgtgaggaggccagcaaggccaagatggtggccgaggccgaggccaccgtgctgggccagaggagagctgctgtggagaccaccctgcgggagacccaggaggagaatgatgagttcagaagacgcatcctgggcctggagcagcagctgaaggagacccggggcctggtggatggaggagaggccgtggaggcccggctgcgggacaagctgcagaggctggaggccgagaagcagcagctggaggaggccctgaatgccagccaggaggaggagggcagcctggccgccgccaagagggccctggaggcccggctggaggaggcccagaggggcctggcccggctgggccaggagcagcagaccctgaacagagccctggaggaggagggcaagcagcgggaggtgctgcggcggggcaaggccgagctggaggagcagaagaggctgctggacagaacagtggaccggctgaacaaggagctggagaagattggagaggacagcaagcaggccctgcagcagctgcaggcccagctggaggactacaaggagaaggcccggcgggaggtggctgatgcccagaggcaggccaaggactgggccagcgaggccgagaagaccagcggcggcctgagccggctgcaggatgagatccagaggctgcggcaggccctgcaggccagccaggccgagcgggacacagcccggctggacaaggagctgctggcccagaggctgcagggcctggagcaggaggccgagaacaagaagaggagccaggatgaccgggcccggcagctgaagggcctggaggagaaggtgtcccggctggagacagagctggatgaggagaagaacacagtggagctgctgacagacagagtgaacagaggccgggaccaggtggaccagctgaggacagagctgatgcaggagaggtctgcccggcaggacctggagtgtgacaagatcagcctggagcggcagaacaaggacctgaagacccggctggccagcagcgagggcttccagaagcccagcgccagcctgagccagctggagagccagaaccagctgctgcaggagcggctgcaggccgaggagcgggagaagacagtgctgcagagcaccaacaggaagctggagaggaaggtgaaggagctgagcatccagattgaagatgagcggcagcacgtgaatgaccagaaggaccagctgagcctgcgggtgaaggccctgaagaggcaggtggatgaagctgaggaggagattgagcggctggatggcctgaggaagaaggcccagcgggaggtggaggagcagcacgaggtgaatgagcagctgcaggcccgcatcaagagcctggagaaggacagctggaggaaggccagccgctctgctgctgagagcgccctgaagaatgaaggcctgagcagtgatgaggagtttgacagcgtgtatgaccccagcagcatcgccagcctgctgacagagagcaacctgcagaccagcagctgctag

SEQ ID NO: 33478 - DNA, 876 bp, Artificial Sequence
  Description of Artificial Sequence: Synthetic coding sequence
atggagcaggcccccaacatggccgagccccggggccctgtggaccacggcgtgcagatccgcttcatcacagagcctgtgtctggagctgagatgggcaccctgcggcggggcggccggcggcctgccaaggatgcccgggccagcacctatggagtggccgtgcgggtgcagggcattgctggccagccctttgtggtgctgaacagcggggagaagggcggggacagctttggagtgcagatcaagggggccaatgaccagggcgccagcggggccctgagcagtgacctggagctgcctgagaacccctacagccaggtgaagggcttccctgcccccagccagagcagcaccagtgatgaggagcccggggcctactggaatggcaagctgctgcggagccacagccaggccagcctggccggccctggccctgtggaccccagcaacagaagcaacagcatgctggagctggcccccaaggtggccagccctggcagcaccatcgacacagcccccctgagctctgtggacagcctcatcaacaagtttgacagccagctgggcggccaggcccggggccgcactggaagaaggaccaggatgctgcccccagagcagaggaagaggagcaagagcctggacagccggctgccccgggacacctttgaggagcgggagcggcagagcaccaaccactggaccagcagcaccaagtatgacaaccacgtgggcaccagcaagcagcctgcccagagccagaacctgagccccctgagcggcttcagccgcagccggcagacccaggactgggtgctgcagagctttgaggagcccaggagaagtgcccaggaccccaccatgctgcagtag

SEQ ID NO: 33479 - DNA, 513 bp, Artificial Sequence
  Description of Artificial Sequence: Synthetic coding sequence
atggagcaggcccccaacatggccgagccccggggccctgtggaccacggcgtgcagatccgcttcatcacagagcctgtgtctggagctgagatgggcaccctgcggcggggcggccggcggcctgccaaggatgcccgggccagcacctatggagtggccgtgcgggtgcagggcattgctggccagccctttgtggtgctgaacagcggggagaagggcggggacagctttggagtgcagatcaagggggccaatgaccagggcgccagcggggccctgagcagtgacctggagctgcctgagaacccctacagccaggtgaagggcttccctgcccccagccagagcagcaccagtgatgaggagcccggggcctactggaatggcaagctgctgcggagccacagccaggccagcctggccggccctggccctgtggaccccagcaacagaagcaacagcatgctggagctggcccccaaggtggccagccctggcagcaccatctag

SEQ ID NO: 33480 - DNA, 513 bp, Artificial Sequence; identical to SEQ ID NO: 33479
  Description of Artificial Sequence: Synthetic coding sequence

SEQ ID NO: 33481 - DNA, 699 bp, Artificial Sequence
  Description of Artificial Sequence: Synthetic coding sequence
atgcctggctggttcaagaaggcctggtacggcctggccagcctgctgtccttcagcagcttcatcctgatcatcgtggccctggtggtgccccactggctgagcggcaagatcctgtgccagacaggagtggacctggtgaatgccacagaccgggagctggtgaagttcatcggggacatctactacggcctcttccggggctgcaaggtgcggcagtgtggcctgggcggccggcagagccagttcaccatcttcccccacctggtgaaggagctgaatgccggcctgcacgtgatgatcctgctgctgctcttcctggccctggccctggccctggtgtccatgggctttgccatcctgaacatgatccaggtgccctacagagctgtgtctggccctgggggcatctgcctgtggaatgtgctggccggcggcgtggtggccctggccatcgccagctttgtggccgctgtgaagttccatgacctgacagagcgcatcgccaacttccaggagaagctgttccagtttgtggtggtggaggagcagtatgaggagagcttctggatctgtgtggccagcgccagcgcccacgccgccaacctggtggtggtggccatcagccagatccccctgcctgagatcaagaccaagattgaggaggccaccgtgacagctgaggacatcctgtactag

SEQ ID NO: 33482 - DNA, 681 bp, Artificial Sequence
  Description of Artificial Sequence: Synthetic coding sequence
atgcccaccaccaagaagaccctgatgttcctgagcagcttcttcaccagcctgggcagcttcatcgtcatctgcagcatcctgggcacccaggcctggatcaccagcaccatcgctgtgcgggacagcgccagcaatggcagcatcttcatcacctacggcctcttccggggggagagcagcgaggagctgagccacggcctggccgagcccaagaagaagtttgctgtgctggagatcctgaacaacagcagccagaagaccctgcacagcgtgaccatcctcttcctggtgctgagcctcatcaccagcctgctgagcagcggcttcaccttctacaacagcatcagcaacccctaccagaccttcctgggccccactggagtgtacacctggaatggcctgggcgccagctttgtgtttgtgaccatgatcctgtttgtggccaacacccagagcaaccagctgtctgaggagctgttccagatgctgtacccagccaccaccagcaagggcaccacccacagctatggctacagcttctggctgatcctgctggtgatcctgctgaacatcgtgacagtgaccatcatcatcttctaccagaaggcccgctaccagaggaagcaggagcagaggaagcccatggagtatgcccccagagatggcatcctcttctag

SEQ ID NO: 33483 - DNA, 687 bp, Artificial Sequence
  Description of Artificial Sequence: Synthetic coding sequence
atggccagcacagccagcgagatcatcgccttcatggtgtccatcagcggctgggtgctggtgagcagcaccctgcccacagactactggaaggtgtccaccattgatggcaccgtcatcaccacagccacctactgggccaacctgtggaaggcctgtgtgacagacagcactggagtgagcaactgcaaggacttccccagcatgctggccctggatggctacatccaggcctgccggggcctgatgattgctgctgtgtccctgggcttcttcggcagcatctttgccctgtttggcatgaagtgcaccaaggtgggcggcagtgacaaggccaaggccaagatcgcctgcctggccggcatcgtgttcatcctgagcggcctgtgcagcatgacaggctgcagcctgtatgccaacaagatcaccacagagttctttgaccccctgtttgtggagcagaagtatgagctgggcgccgccctcttcatcggctgggccggggccagcctgtgcatcatcggcggcgtcatcttctgcttcagcatcagtgacaacaacaagaccccccgctacacctacaatggagccacctctgtgatgagcagcaggaccaagtaccacggcggggaggacttcaagaccaccaaccccagcaagcagtttgacaagaatgcctacgtgtag

SEQ ID NO: 33484 - DNA, 222 bp, Artificial Sequence
  Description of Artificial Sequence: Synthetic coding sequence
atgattgctgctgtgtccctgggcttcttcggcagcatctttgccctgtttggcatgaagtgcaccaaggtgggcggcagtgacaaggccaaggccaagatcgcctgcctggccggcatcgtgttcatcctgagcggcctgtgcagcatgacaggctgcagcctgtatgccaacaagatcaccacagagttctttgaccccctgtttgtggagcagaagtag

SEQ ID NO: 33485 - DNA, 681 bp, Artificial Sequence
  Description of Artificial Sequence: Synthetic coding sequence
atgagccgggcccagatctgggccctggtgtctggagtgggcggctttggagccctggtggccgccaccaccagcaatgagtggaaggtgaccacccgggccagcagcgtcatcacagccacctgggtgtaccagggcctgtggatgaactgtgctggaaatgccctgggcagcttccactgccggccccacttcaccatcttcaaggtggccggctacatccaggcctgccggggcctgatgattgctgctgtgtccctgggcttcttcggcagcatctttgccctgtttggcatgaagtgcaccaaggtgggcggcagtgacaaggccaaggccaagatcgcctgcctggccggcatcgtgttcatcctgagcggcctgtgcagcatgacaggctgcagcctgtatgccaacaagatcaccacagagttctttgaccccctgtttgtggagcagaagtatgagctgggcgccgccctcttcatcggctgggccggggccagcctgtgcatcatcggcggcgtcatcttctgcttcagcatcagtgacaacaacaagaccccccgctacacctacaatggagccacctctgtgatgagcagcaggaccaagtaccacggcggggaggacttcaagaccaccaaccccagcaagcagtttgacaagaatgcctacgtgtag

SEQ ID NO: 33486 - DNA, 735 bp, Artificial Sequence
  Description of Artificial Sequence: Synthetic coding sequence
atgggctgcagagatgtgcacgccgccaccgtgctgtccttcctgtgtggcatcgcctctgtggccggcctgtttgctggcaccctgctgcccaactggaggaagctgcggctcatcaccttcaacagaaatgagaagaacctgactgtgtacacaggcctgtgggtgaagtgtgcccgctatgatggcagcagtgactgcctgatgtatgacaccacctggtacagctctgtggaccagctggacctgcgggtgctgcagtttgccctgcccctgtccatgctgattgccatgggcgccctgctgctgtgcctgattggcatgtgcaacacagccttccgcagctctgtgcccaacatcaagctggccaagtgcctggtgaacagcgctggctgccacctggtggccggcctgctcttcttcctggccggcaccgtgtccctgagccccagcatctgggtgatcttctacaacatccacctgaacaagaagtttgagcctgtgttctcctttgattatgctgtgtatgtgaccatcgccagcgctgggggcctcttcatgaccagcctcatcctcttcatctggtactgcacctgcaagagcctgcccagccccttctggcagcccctgtacagccacccccccagcatgcacacctacagccagccctacagcgcccggagccggctgagcgccattgaaattgacatccctgtggtgagccacaccacctag

SEQ ID NO: 33487 - DNA, 564 bp, Artificial Sequence
  Description of Artificial Sequence: Synthetic coding sequence
atgggctgcagagatgtgcacgccgccaccgtgctgtccttcctgtgtggcatcgcctctgtggccggcctgtttgctggcaccctgctgcccaactggaggaagctgcggctcatcaccttcaacagaaatgagaagaacctgactgtgtacacaggcctgtgggtgaagtgtgcccgctatgatggcagcagtgactgcctgatgtatgacaccacctggtacagctctgtggaccagctggacctgcgggtgctgcagtttgccctgcccctgtccatgctgattgccatgggcgccctgctgctgtgcctgattggcatgtgcaacacagccttccgcagctctgtgcccaacatcaagctggccaagtgcctggtgaacagcgctggctgccacctggtggccggcctgctcttcttcctggccggcaccgtgtccctgagccccagcatctgggtgatcttctacaacatccacctgaacaagaagtttgagcctgtgttctcctttgattatgctgtgtatgtgaccatcgccagcgctgggggcctcttcatgtag

SEQ ID NO: 33488 - DNA, 735 bp, Artificial Sequence; identical to SEQ ID NO: 33486
  Description of Artificial Sequence: Synthetic coding sequence

SEQ ID NO: 33489 - DNA, 528 bp, Artificial Sequence
  Description of Artificial Sequence: Synthetic coding sequence
atgggctgcagagatgtgcacgccgccaccgtgctgtccttcctgtgtggcatcgcctctgtggccggcctgtttgctggcaccctgctgcccaactggaggaagctgcggctcatcaccttcaacagaaatgagaagaacctgactgtgtacacaggcctgtgggtgaagtgtgcccgctatgatggcagcagtgactgcctgatgtatgacaccacctggtacagctctgtggaccagctggacctgcgggtgctgcagtttgccctgcccctgtccatgctgattgccatgggcgccctgctgctgtgcctgattggcatgtgcaacacagccttccgcagctctgtgcccaacatcaagctggccaagtgcctggtgaacagcgctggctgccacctggtggccggcctgctcttcttcctggccggcaccgtgtccctgagccccagcatctgggtgatcttctacaacatccacctgaacaagaagtttgagcctgtgttctcctttgattatgctgtgtag

SEQ ID NO: 33490 - DNA, 528 bp, Artificial Sequence; identical to SEQ ID NO: 33489
  Description of Artificial Sequence: Synthetic coding sequence

SEQ ID NO: 33491 - DNA, 381 bp, Artificial Sequence
  Description of Artificial Sequence: Synthetic coding sequence
atgggctgcagagatgtgcacgccgccaccgtgctgtccttcctgtgtggcatcgcctctgtggccggcctgtttgctggcaccctgctgcccaactggaggaagctgcggctcatcaccttcaacagaaatgagaagaacctgactgtgtacacaggcctgtgggtgaagtgtgcccgctatgatggcagcagtgactgcctgatgtatgacaccacctggtacagctctgtggaccagctggacctgcgggtgctgcagtttgccctgcccctgtccatgctgattgccatgggcgccctgctgctgtgcctgattggcatgtgcaacacagccttccgcagctctgtgcccaacatcaagctggccaagtgcctgtag

SEQ ID NO: 33492 - DNA, 735 bp, Artificial Sequence; identical to SEQ ID NO: 33486
  Description of Artificial Sequence: Synthetic coding sequence

SEQ ID NO: 33493 - DNA, 735 bp, Artificial Sequence; identical to SEQ ID NO: 33486
  Description of Artificial Sequence: Synthetic coding sequence

SEQ ID NO: 33494 - DNA, 687 bp, Artificial Sequence
  Description of Artificial Sequence: Synthetic coding sequence
atgtccatggctgtggagaccttcggcttcttcatggccaccgtgggcctgctgatgctgggcgtgaccctgcccaacagctactggagggtgtccacagtgcatggaaatgtcatcaccaccaacaccatctttgagaacctgtggttcagctgtgccacagacagcctgggcgtgtacaactgctgggagttccccagcatgctggccctgagcggctacatccaggcctgccgggccctgatgatcacagccatcctgctgggcttcctgggcctgctgctgggcattgctggcctgcgctgcaccaacattggaggcctggagctgagcaggaaggccaagctggccgccacagctggggccctgcacatcctggccggcatctgtggcatggtggccatctcctggtacgccttcaacatcacccgggacttctttgaccccctgtacccaggcaccaagtatgagctgggccctgccctgtacctgggctggagcgccagcctcatcagcatcctgggcggcctgtgcctgtgcagcgcctgctgctgcggcagtgatgaagatcctgctgccagcgcccggcggccctaccaggcccctgtgtctgtgatgcctgtggccaccagtgaccaggagggggacagcagctttgggaagtatggaagaaatgcctacgtgtag

SEQ ID NO: 33495 - DNA, 687 bp, Artificial Sequence; identical to SEQ ID NO: 33494
  Description of Artificial Sequence: Synthetic coding sequence

SEQ ID NO: 33496 - DNA, 675 bp, Artificial Sequence
  Description of Artificial Sequence: Synthetic coding sequence
atggccttctaccccctgcagattgctggcctggtgctgggcttcctgggcatggtgggcaccctggccaccaccctgctgccccagtggagggtgtctgcctttgtgggcagcaacatcatcgtgtttgagcggctgtgggagggcctgtggatgaactgcatccggcaggcccgggtgcggctgcagtgcaagttctacagcagcctgctggccctgcccccagccctggagacagcccgggccctgatgtgtgtggccgtggccctgagcctgattgccctgctgattggcatctgtggcatgaagcaggtgcagtgcaccggcagcaatgaaagagccaaggcctacctgctgggcaccagcggcgtgctcttcatcctgaccggcatctttgtgctgatccctgtgtcctggacagccaacatcatcatccgggacttctacaacccagccatccacatcggccagaagcgggagctgggcgccgccctcttcctgggctgggccagcgctgctgtgctcttcatcggcggcggcctgctgtgtggcttctgctgctgcaacaggaagaagcagggctaccgctaccctgtgcccggctacagagtgccccacacagacaagagaagaaacaccaccatgctgagcaagaccagcaccagctatgtgtag

SEQ ID NO: 33497 - DNA, 693 bp, Artificial Sequence
  Description of Artificial Sequence: Synthetic coding sequence
atggccagcctgggcctgcagctggtgggctacatcctgggcctgctgggcctgctgggcaccctggtggccatgctgctgcccagctggaagaccagcagctatgtgggcgccagcatcgtgacagctgtgggcttcagcaagggcctgtggatggagtgtgccacccacagcacaggcatcacccagtgtgacatctacagcaccctgctgggcctgcctgctgacatccaggccgcccaggccatgatggtgaccagcagcgccatcagcagcctggcctgcatcatctctgtggtgggcatgcgctgcaccgtcttctgccaggagagccgggccaaggacagagtggccgtggccggcggcgtcttcttcatcctgggcggcctgctgggcttcatccctgtggcctggaacctgcacggcatcctgcgggacttctacagccccctggtgcctgacagcatgaagtttgagatcggggaggccctgtacctgggcatcatcagcagcctcttcagcctgattgctggcatcatcctgtgcttcagctgcagcagccagaggaacagaagcaactactatgatgcctaccaggcccagcccctggccaccaggagcagccccaggcctggccagccccccaaggtgaagtctgagttcaacagctacagcctgaccggctacgtgtag

SEQ ID NO: 33498 - DNA, 693 bp, Artificial Sequence; identical to SEQ ID NO: 33497
  Description of Artificial Sequence: Synthetic coding sequence

SEQ ID NO: 33499 - DNA, 693 bp, Artificial Sequence; identical to SEQ ID NO: 33497
  Description of Artificial Sequence: Synthetic coding sequence

SEQ ID NO: 33500 - DNA, 660 bp, Artificial Sequence
  Description of Artificial Sequence: Synthetic coding sequence
atggccagcgctggcctgcagctgctggccttcatcctggccctgagcggcgtgtctggagtgctgacagccaccctgctgcccaactggaaggtgaatgtggatgtggacagcaacatcatcacagccatcgtgcagctgcacggcctgtggatggactgcacctggtacagcacaggcatgttcagctgtgccctgaagcacagcatcctgagcctgcccatccacgtgcaggccgcccgggccaccatggtgctggcctgtgtgctgagcgccctgggcatctgcaccagcacagtgggcatgaagtgcacccggctgggcggggaccgggagaccaagagccacgccagctttgctgggggcgtgtgcttcatgtctgctggcatcagcagcctcatcagcacagtgtggtacaccaaggagatcatcgccaacttcctggacctgactgtgcctgagagcaacaagcatgagcccggcggggccatctacatcggcttcatcagcgccatgctgctcttcatcagcggcatgatcttctgcaccagctgcatcaagaggaaccctgaggcccggctggacccccccacccagcagcccatcagcaacacccagctggagaacaacagcacccacaacctgaaggactatgtgtag

SEQ ID NO: 33501 - DNA, 663 bp, Artificial Sequence
  Description of Artificial Sequence: Synthetic coding sequence
atggccctggtgttcagaacagtggcccagctggccggcgtgtccctgagcctgctgggctgggtgctgagctgcctgaccaactacctgccccactggaagaacctgaacctggacctgaatgagatggagaactggaccatgggcctgtggcagacctgtgtgatccaggaggaggtgggcatgcagtgcaaggactttgacagcttcctggccctgcctgctgagctgcgggtgagccgcatcctgatgttcctgagcaatggcctgggcttcctgggcctgctggtgtctggcttcggcctggactgcctgagaattggagagagccagagggacctgaagaggcggctgctgatcctgggcggcatcctgtcctgggccagcggcgtgacagccctggtgcctgtgtcctgggtggcccacaagacagtgcaggagttctgggatgaaaatgtgcctgactttgtgccccgctgggagtttggagaggccctcttcctgggctggtttgctggcctgagcctgctgctgggcggctgcctgctgcactgtgccgcctgcagcagccacgcccccctggccagcggccactatgctgtggcccagacccaggaccaccaccaggagctggagaccaggaacaccaacctgaagcactag

SEQ ID NO: 33502 - DNA, 879 bp, Artificial Sequence
  Description of Artificial Sequence: Synthetic coding sequence
atgaggacccctgtggtgatgaccctgggcatggtgctggccccctgtggcctgctgctgaacctgaccggcaccctggcccctggctggaggctggtgaagggcttcctgaaccagcctgtggatgtggagctgtaccagggcctgtgggacatgtgccgggagcagagcagccgggagcgggagtgtggccagacagaccagtggggctactttgaggcccagcctgtgctggtggcccgggccctgatggtgaccagcctggccgccaccgtgctgggcctgctgctggccagcctgggcgtgcgctgctggcaggatgagcccaactttgtgctggccggcctgtctggagtggtgctgtttgtggccggcctgctgggcctcatccctgtgtcctggtacaaccacttcctgggggacagagatgtgctgcctgccccagccagccctgtgacagtgcaggtgtcctacagcctggtgctgggctacctgggcagctgcctgctgctgctgggcggcttcagcctggccctgagctttgccccctggtgtgatgagcgctgcagaagaagaaggaagggccccagcgctggccccaggaggagctctgtgtccaccatccaggtggagtggccagagccagacctggccccagccatcaagtactacagtgatggccagcacaggcctcctccagcccagcacaggaagcccaagcccaagcccaaggtgggcttccccatgccccggccccggcccaaggcctacaccaacagcgtggatgtgctggatggagagggctgggagagccaggatgcccccagctgcagcacccacccctgtgacagcagcctgccctgtgacagcgacctgtag

SEQ ID NO: 33503 - DNA, 690 bp, Artificial Sequence
  Description of Artificial Sequence: Synthetic coding sequence
atggcctggagcttccgggccaaggtgcagctgggcggcctgctgctgagcctgctgggctgggtgtgcagctgtgtgaccaccatcctgccccagtggaagaccctgaacctggagctgaatgagatggagacctggatcatgggcatctgggaggtgtgtgtggaccgggaggaggtggccaccgtgtgcaaggcctttgagagcttcctgagcctgccccaggagctgcaggtggcccgcatcctgatggtggccagccacggcctgggcctgctgggcctgctgctgtgcagctttggaagtgagtgcttccagttccaccgcatccgctgggtgttcaagaggcggctgggcctgctgggccgcaccctggaggccagcgccagcgccaccaccctgctgcctgtgtcctgggtggcccacgccaccatccaggacttctgggatgacagcatcccagacatcatcccccgctgggagtttggaggagccctgtacctgggctgggccgccggcatcttcctggccctgggcggcctgctgctgatcttcagcgcctgcctgggcaaggaggatgtgcccttccccctgatggccggccccaccgtgcccctgagctgtgcccctgtggaggagagtgatggcagcttccacctgatgctgcggcccaggaacctggtgatctag

SEQ ID NO: 33504 - DNA, 663 bp, Artificial Sequence
  Description of Artificial Sequence: Synthetic coding sequence
atggccagcgctggcatgcagatcctgggcgtggtgctgaccctgctgggctgggtgaatggcctggtgtcctgtgccctgcccatgtggaaggtgacagccttcatcggcaacagcatcgtggtggcccaggtggtgtgggagggcctgtggatgagctgtgtggtgcagagcacaggccagatgcagtgcaaggtgtatgacagcctgctggccctgccccaggacctgcaggccgcccgggccctgtgtgtgattgccctgctggtggccctgtttggcctgctggtgtacctggccggggccaagtgcaccacctgtgtggaggagaaggacagcaaggcccggctggtgctgaccagcggcatcgtgtttgtgatcagcggcgtgctgaccctcatccctgtgtgctggacagcccacgccatcatccgggacttctacaaccccctggtggccgaggcccagaagcgggagctgggcgccagcctgtacctgggctgggccgccagcggcctgctgctgctgggcggcggcctgctgtgctgcacctgccccagcggcggcagccagggccccagccactacatggcccgctacagcaccagcgccccagccatcagccggggccccagcgagtaccccaccaagaactacgtgtag

SEQ ID NO: 33505 - DNA, 663 bp, Artificial Sequence; identical to SEQ ID NO: 33504
  Description of Artificial Sequence: Synthetic coding sequence

SEQ ID NO: 33506 - DNA, 636 bp, Artificial Sequence
  Description of Artificial Sequence: Synthetic coding sequence
atggccaacagcggcctgcagctgctgggcttctccatggccctgctgggctgggtgggcctggtggcctgcacagccatcccccagtggcagatgagcagctatgctggggacaacatcatcacagcccaggccatgtacaagggcctgtggatggactgtgtgacccagagcacaggcatgatgagctgcaagatgtatgattctgtgctggccctgtctgctgccctgcaggccacccgggccctgatggtggtgtccctggtgctgggcttcctggccatgtttgtggccaccatgggcatgaagtgcacccgctgtggaggagatgacaaggtgaagaaggcccgcatcgccatgggcggcggcatcatcttcatcgtggccggcctggccgccctggtggcctgctcctggtacggccaccagatcgtgacagacttctacaaccccctcatccccaccaacatcaagtatgaatttggacctgccatcttcatcggctgggccggcagcgccctggtgatcctgggcggggccctgctgagctgcagctgccctggaaatgaaagcaaggccggctacagagtgcccaggagctaccccaagagcaacagcagcaaggagtatgtgtag

SEQ ID NO: 33507 - DNA, 636 bp, Artificial Sequence; identical to SEQ ID NO: 33506
  Description of Artificial Sequence: Synthetic coding sequence

SEQ ID NO: 33508 - DNA, 438 bp, Artificial Sequence
  Description of Artificial Sequence: Synthetic coding sequence
atggccaacagcggcctgcagctgctgggcttctccatggccctgctgggctgggtgggcctggtggcctgcacagccatcccccagtggcagatgagcagctatgctggggacaacatcatcacagcccaggccatgtacaagggcctgtggatggactgtgtgacccagagcacaggcatgatgagctgcaagatgtatgattctgtgctggccctgtctgctgccctgcaggccacccgggccctgatggtggtgtccctggtgctgggcttcctggccatgtttgtggccaccatgggcatgaagtgcacccgctgtggaggagatgacaaggtgaagaaggcccgcatcgccatgggcggcggcatcatcttcatcgtggccggcatgagcctggccctgcccagcctgctggccggccagggcctgccctag

SEQ ID NO: 33509 - DNA, 678 bp, Artificial Sequence
  Description of Artificial Sequence: Synthetic coding sequence
atggccacccacgccctggagattgctggcctcttcctgggcggcgtgggcatggtgggcaccgtggccgtgacagtgatgccccagtggagggtgtctgccttcatcgagaacaacatcgtggtgtttgagaacttctgggagggcctgtggatgaactgtgtgcggcaggccaacatccgcatgcagtgcaagatctatgacagcctgctggccctgagcccagacctgcaggccgcccggggcctgatgtgtgccgcctctgtgatgtccttcctggccttcatgatggccatcctgggcatgaagtgcacccgctgcaccggggacaatgagaaggtgaaggcccacatcctgctgacagctggcatcatcttcatcatcaccggcatggtggtgctgatccctgtgtcctgggtggccaatgccatcatccgggacttctacaacagcatcgtgaatgtggcccagaagcgggagctgggggaggccctgtacctgggctggaccacagccctggtgctgattgtgggcggggccctcttctgctgcgtgttctgctgcaatgagaagagcagcagctaccgctacagcatccccagccacaggaccacccagaagagctaccacacaggcaagaagagccccagcgtgtacagccgcagccagtatgtgtag

SEQ ID NO: 33510 - DNA, 678 bp, Artificial Sequence; identical to SEQ ID NO: 33509
  Description of Artificial Sequence: Synthetic coding sequence

SEQ ID NO: 33511 - DNA, 702 bp, Artificial Sequence
  Description of Artificial Sequence: Synthetic coding sequence
atggccacccacgccctggagattgctggcctcttcctgggcggcgtgggcatggtgggcaccgtggccgtgacagtgatgccccagtggagggtgtctgccttcatcgagaacaacatcgtggtgtttgagaacttctgggagggcctgtggatgaactgtgtgcggcaggccaacatccgcatgcagtgcaagatctatgacagcctgctggccctgagcccagacctgcaggccgcccggggcctgatgtgtgccgcctctgtgatgtccttcctggccttcatgatggccatcctgggcatgaagtgcacccgctgcaccggggacaatgagaaggtgaaggcccacatcctgctgacagctggcatcatcttcatcatcaccggcatggtggtgctgatccctgtgtcctgggtggccaatgccatcatccgggacttctacaacagcatcgtgaatgtggcccagaagcgggagctgggggaggccctgtacctgggctggaccacagccctggtgctgattgtgggcggggccctcttctgctgcgtgttctgctgcaatgagaagagcagcagctaccgctacagcatccccagccacaggaccacccagaagagctaccacacaggcaagaagagccggctgctgcagaagtctgtgtgtgtggtggtgtatgtgttcctgaccctgctgtag

SEQ ID NO: 33512 - DNA, 654 bp, Artificial Sequence
  Description of Artificial Sequence: Synthetic coding sequence
atggccagcacaggcctggagctgctgggcatgaccctggccgtgctgggctggctgggcaccctggtgtcctgtgccctgcccctgtggaaggtgacagccttcatcggcaacagcatcgtggtggcccaggtggtgtgggagggcctgtggatgagctgtgtggtgcagagcacaggccagatgcagtgcaaggtgtatgacagcctgctggccctgccccaggacctgcaggccgcccgggccctgtgtgtgattgccctgctgctggccctgctgggcctgctggtggccatcaccggggcccagtgcaccacctgtgtggaggatgagggcgccaaggccagaattgtgctgacagctggggtcatcctgctgctggccggcatcctggtgctgatccctgtgtgctggacagcccacgccatcatccaggacttctacaaccccctggtggccgaggccctgaagcgggagctgggcgccagcctgtacctgggctgggccgctgctgccctgctgatgctgggcggcggcctgctgtgctgcacctgccccccaccccaggtggagcggccccggggcccccggctgggctacagcatccccagccgcagcggggccagcggcctggacaagagggactatgtgtag

SEQ ID NO: 33513 - DNA, 762 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcccacaccaacaggaaggagtacaccctgatgaaggcctacagagtggcctag

SEQ ID NO: 33514 - DNA, 762 bp, Artificial Sequence; identical to SEQ ID NO: 33513
  Description of Artificial Sequence: Synthetic coding sequence

SEQ ID NO: 33515 - DNA, 762 bp, Artificial Sequence; identical to SEQ ID NO: 33513
  Description of Artificial Sequence: Synthetic coding sequence

SEQ ID NO: 33516 - DNA, 762 bp, Artificial Sequence; identical to SEQ ID NO: 33513
  Description of Artificial Sequence: Synthetic coding sequence

SEQ ID NO: 33517 - DNA, 831 bp, Artificial Sequence
  Description of Artificial Sequence: Synthetic coding sequence
atgggcggggaccggctggagaacaagacctctgtgtctgtggcctcctggagcagcctgaatgccaggatggacaacagatttgccacagccttcgtcatcgcctgtgtgctgagcctcatcagcaccatctacatggccgccagcatcggcacagacttctggtatgagtaccgcagccctgtgcaggagaacagcagtgacctgaacaagagcatctgggatgagttcatcagtgatgaagcagatgagaagacctacaatgatgccctcttccgctacaatggaacagtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgcttcggggccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcccacaccaacaggaaggagtacaccctgatgaaggcctacagagtggcctag

SEQ ID NO: 33518 - DNA, 720 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcccacacctag

SEQ ID NO: 33519 - DNA, 762 bp, Artificial Sequence; identical to SEQ ID NO: 33513
  Description of Artificial Sequence: Synthetic coding sequence

SEQ ID NO: 33520 - DNA, 270 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactag

SEQ ID NO: 33521 - DNA, 534 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcactag

SEQ ID NO: 33522 - DNA, 438 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgcccttctag

SEQ ID NO: 33523 - DNA, 519 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgcctag

SEQ ID NO: 33524 - DNA, 714 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcctag

SEQ ID NO: 33525 - DNA, 762 bp, Artificial Sequence; identical to SEQ ID NO: 33513
  Description of Artificial Sequence: Synthetic coding sequence

SEQ ID NO: 33526 - DNA, 477 bp, Artificial Sequence
  Description of Artificial Sequence: Synthetic coding sequence
atgggagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgcttcggggccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcccacaccaacaggaaggagtacaccctgatgaaggcctacagagtggcctag

SEQ ID NO: 33527 - DNA, 294 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacatag

SEQ ID NO: 33528 - DNA, 762 bp, Artificial Sequence; identical to SEQ ID NO: 33513
  Description of Artificial Sequence: Synthetic coding sequence

SEQ ID NO: 33529 - DNA, 738 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggctggagcttctgcctggcctgtgtgtctgcccccctgcagttcatggccagcgccctcttcatctgggccgcccacaccaacaggaaggagtacacctag

SEQ ID NO: 33530 - DNA, 642 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggccggcctgtgcaccctgggctctgtgtcctgctacgtggccggcatcgagctgctgcaccagaagctggagctgcctgacaacgtgtctggagaatttggatag

SEQ ID NO: 33531 - DNA, 543 bp, Artificial Sequence
  Description of Artificial Sequence: Synthetic coding sequence
atggacaacagatttgccacagcctttgtgattgcctgtgtgctgagcctcatcagcaccatctacatggccgccagcattggaacagacttctggtatgagtaccgcagccctgtgcaggagaacagcagtgacctgaacaagagcatctgggatgagttcatcagtgatgaagcagatgagaagacctacaatgatgccctcttccgctacaacggcaccgtgggcctgtggaggcgctgcatcaccatccccaagaacatgcactggtacagccccccagagaggacagagagctttgatgtggtgaccaagtgtgtgtccttcaccctgacagagcagttcatggagaagtttgtggaccccggcaaccacaacagcggcatcgacctgctgcggacctacctgtggcgctgccagttcctgctgccctttgtgtccctgggcctgatgtgctttggagccctgattggcctgtgtgcctgcatctgccgcagcctgtaccccaccatcgccaccggcatcctgcacctgctggcctag

SEQ ID NO: 33532 - DNA, 504 bp, Artificial Sequence
  Description of Artificial Sequence: Synthetic coding sequence
atgggcgtgaagaggagcctgcagagcggcggcatcctgctgagcctggtggccaacgtgctgatggtgctgagcacagccaccaactactggacccggcagcaggagggccacagcggcctgtggcaggagtgcaaccacggcatctgcagcagcatcccctgccagaccaccctggccgtgacagtggcctgcatggtgctggccgtgggcgtgggcgtggtgggcatggtgatgggcctgcgcatccgctgtgatgaaggagagagcctgcggggccagaccaccagcgccttcctgttcctgggcggcctgctgctgctgacagccctgattggctacacagtgaagaatgcctggaagaacaacgtgttcttctcctggagctacttcagcggctggctggccctgcccttcagcatcctggccggcttctgcttcctgctggccgacatgatcatgcagagcacagatgccatcagcggcttccctgtgtgcctgtag

SEQ ID NO: 33533 - DNA, 1065 bp, Artificial Sequence
  Description of Artificial Sequence: Synthetic coding sequence
atgggccctgtgtccctgctgcccaagtaccagaagctgaacacctggaatggagacctggccaagatgacccacctgcaggccggcctgagccctgagaccatcgagaaggcccggctggagctgaatgaaaatccagatgtgctgcaccaggacatccagcaggtgcgggacatgatcatcaccaggccagacatcggcttcctgaggacagatgatgccttcatcctgcgcttcctgcgggccaggaagttccaccaggctgatgccttccggctgctggcccagtacttccagtaccggcagctgaacctggacatgttcaagaacttcaaggcagatgaccccggcatcaagagggccctgattgatggcttccctggggtgctggagaacagagaccactacggcaggaagatcctgctgctgtttgctgccaactgggaccagagcaggaacagcttcacagacatcctgcgggccatcctgctgagcctggaggtgctgattgaagatcctgagctgcagatcaatggcttcatcctgatcatcgactggagcaacttctccttcaagcaggccagcaagctgacccccagcatcctgaagctggccatcgagggcctgcaggacagcttccctgccaggtttggaggagtgcactttgtgaaccagccctggtacatccacgccctgtacaccctcatcaagcccttcctgaaggacaagaccaggaagaggatcttcctgcacggcaacaacctgaacagcctgcaccagctgatccaccctgagttcctgcccagcgagtttggaggcaccctgcccccctatgacatgggcacctgggcccggaccctgctgggccctgactacagtgatgaaaatgactacacccacaccagctacaatgccatgcacgtgaagcacaccagcagcaacctggagcgggagtgcagccccaagctgatgaagaggagccagagcgtggtggaggccggcaccctgaagcatgaggagaagggagaaaatgaaaacacccagcccctgctggccctggactag

SEQ ID NO: 33534 - DNA, 1065 bp, Artificial Sequence; identical to SEQ ID NO: 33533
  Description of Artificial Sequence: Synthetic coding sequence

SEQ ID NO: 33535 - DNA, 240 bp, Artificial Sequence
  Description of Artificial Sequence: Synthetic coding sequence
atgggccctgtgtccctgctgcccaagtaccagaagctgaacacctggaatggagacctggccaagatgacccacctgcaggccggcctgagccctgagaccatcgagaaggcccggctggagctgaatgaaaatccagatgtgctgcaccaggacatccagcaggtgcgggacatgatcatcaccaggccagacatcggcttcctgaggacagatgatgccttcatcctgcgcttctag

SEQ ID NO: 33536 - DNA, 984 bp, Artificial Sequence
  Description of Artificial Sequence: Synthetic coding sequence
atgacccacctgcaggccggcctgagccctgagaccctggagaaggcccggctggagctgaatgaaaatccagacaccctgcaccaggacatccaggaggtgcgggacatggtgatcaccaggccagacatcggcttcctgaggacagatgatgccttcatcctgcgcttcctgcgggccaggaagttccaccactttgaggccttccggctgctggcccagtactttgagtaccggcagcagaacctggacatgttcaagagcttcaaggccacagaccccggcatcaagcaggccctgaaggatggcttccctgggggcctggccaacctggaccactacggcaggaagatcctggtgctgtttgctgccaactgggaccagagccgctacaccctggtggacatcctgcgggccatcctgctgagcctggaggccatgattgaagatcctgagctgcaggtgaatggatttgtgctgatcatcgactggagcaacttcaccttcaagcaggccagcaagctgacccccagcatgctgcggctggccatcgagggcctgcaggacagcttccctgccaggtttggaggcatccactttgtgaaccagccctggtacatccacgccctgtacaccgtcatccggcccttcctgaaggagaagaccaggaagaggatcttcctgcacggcaacaacctgaacagcctgcaccagctgatccaccctgagatcctgcccagcgagtttggaggcatgctgcccccctatgacatgggcacctgggcccggaccctgctggaccacgagtatgatgatgacagcgagtacaacgtggacagctacagcatgcctgtgaaggaggtggagaaggagctgagccccaagtccatgaagaggagccagagcgtggtggaccccaccgtgctgaagaggatggacaagaatgaggaggagaacatgcagcccctgctgagcctggactag

SEQ ID NO: 33537 - DNA, 546 bp, Artificial Sequence
  Description of Artificial Sequence: Synthetic coding sequence
atgattgaagatcctgagctgcaggtgaatggatttgtgctgatcatcgactggagcaacttcaccttcaagcaggccagcaagctgacccccagcatgctgcggctggccatcgagggcctgcaggacagcttccctgccaggtttggaggcatccactttgtgaaccagccctggtacatccacgccctgtacaccgtcatccggcccttcctgaaggagaagaccaggaagaggatcttcctgcacggcaacaacctgaacagcctgcaccagctgatccaccctgagatcctgcccagcgagtttggaggcatgctgcccccctatgacatgggcacctgggcccggaccctgctggaccacgagtatgatgatgacagcgagtacaacgtggacagctacagcatgcctgtgaaggaggtggagaaggagctgagccccaagtccatgaagaggagccagagcgtggtggaccccaccgtgctgaagaggatggacaagaatgaggaggagaacatgcagcccctgctgagcctggactag

SEQ ID NO: 33538 - DNA, 2010 bp, Artificial Sequence
  Description of Artificial Sequence: Synthetic coding sequence
atggctgctgcccaggaggctgatggagcccggtctgctgtggtggccgccggcggcggcagcagcggccaggtgaccagcaatggcagcatcggccgggaccccccagctgagacccagccccagaaccccccagcccagcctgccccaaatgcctggcaggtgatcaagggcgtgctcttccgcatcttcatcatctgggccatcagctcctggttccggcggggccctgccccccaggaccaggccggccctggaggagccccccgggtggccagcaggaacctcttccccaaggacaccctgatgaacctgcacgtgtacatcagcgagcacgagcacttcacagacttcaatgccaccagcgccctcttctgggagcagcacgacctggtgtatggagactggaccagcggggagaacagtgatggctgctatgagcactttgctgagctggacatcccccagagcgtgcagcagaatggcagcatctacatccacgtgtacttcaccaagagcggcttccacccagacccccggcagaaggccctgtaccgccgcctggccaccgtgcacatgagcaggatgatcaacaagtacaagagaagacgcttccagaagaccaagaacctgctgactggagaaacagaggccgaccctgagatgatcaagagagcagaagattatggccctgtggaggtgatcagccactggcaccccaacatcaccatcaacatcgtggatgaccacaccccctgggtgaagggctctgtgcccccacccctggaccagtatgtgaagtttgatgctgtgtctggggactactaccccatcatctacttcaatgactactggaacctgcagaaggactactaccccatcaatgaaagcctggccagcctgcccctgcgggtgtccttctgccccctgagcctgtggcgctggcagctgtatgctgcccagagcaccaagagcccctggaacttcctgggagatgagctgtatgagcagagtgatgaggagcaggacagcgtgaaggtggccctgctggagaccaacccctacctgctggccctgaccatcatcgtgtccatcgtgcacagcgtgtttgagttcctggccttcaagaatgacatccagttctggaacagccggcagagcctggagggcctgtctgtgcgctctgtgttcttcggggtcttccagagctttgtggtgctgctgtacatcctggacaatgagaccaactttgtggtgcaggtgtctgtgttcatcggcgtgctgattgacctgtggaagatcaccaaggtgatggatgtgcggctggaccgggagcaccgggtggccggcatcttcccccggctgtccttcaaggacaagagcacctacatcgagagcagcaccaaggtgtatgatgacatggccttccgctacctgtcctggatcctcttccccctgctgggctgctatgctgtgtacagcctgctgtacctggagcacaagggctggtacagctgggtgctgtccatgctgtatggcttcctgctgaccttcggcttcatcaccatgaccccccagctgttcatcaactacaagctgaagtctgtggcccacctgccctggaggatgctgacctacaaggccctgaacaccttcattgatgacctgtttgcctttgtgatcaagatgcctgtgatgtacagaattggctgcctgagagatgatgtggtgttcttcatctacctgtaccagcgctggatctacagagtggaccccaccagggtgaatgaatttggcatgtctggagaggaccccacagctgctgcccctgtggccgaggtgcccacagctgctggggccctgacccccaccccagcccccaccaccaccacagccacccgggaggaggccagcaccagcctgcccaccaagcccacccagggcgccagcagcgccagcgagccccaggaggccccacccaagccagctgaggacaagaagaaggactag

SEQ ID NO: 33539 - DNA, 2061 bp, Artificial Sequence
  Description of Artificial Sequence: Synthetic coding sequence
atggctgctgcccaggaggctgatggagcccggtctgctgtggtggccgccggcggcggcagcagcggccaggtgaccagcaatggcagcatcggccgggaccccccagctgagacccagccccagaaccccccagcccagcctgccccaaatgcctggcaggtgatcaagggcgtgctcttccgcatcttcatcatctgggccatcagctcctggttccggcggggccctgccccccaggaccaggccggccctggaggagccccccgggtggccagcaggaacctcttccccaaggacaccctgatgaacctgcacgtgtacatcagcgagcacgagcacttcacagacttcaatgccaccagcgccctcttctgggagcagcacgacctggtgtatggagactggaccagcggggagaacagtgatggctgctatgagcactttgctgagctggacatcccccagagcgtgcagcagaatggcagcatctacatccacgtgtacttcaccaagagcggcttccacccagacccccggcagaaggccctgtaccgccgcctggccaccgtgcacatgagcaggatgatcaacaagtacaagagaagacgcttccagaagaccaagaacctgctgactggagaaacagaggccgaccctgagatgatcaagagagcagaagattatggccctgtggaggtgatcagccactggcaccccaacatcaccatcaacatcgtggatgaccacaccccctgggtgaagggctctgtgcccccacccctggaccagtatgtgaagtttgatgctgtgtctggggactactaccccatcatctacttcaatgactactggaacctgcagaaggactactaccccatcaatgaaagcctggccagcctgcccctgcgggtgtccttctgccccctgagcctgtggcgctggcagctgtatgctgcccagagcaccaagagcccctggaacttcctgggagatgagctgtatgagcagagtgatgaggagcaggacagcgtgaaggtggccctgctggagaccaacccctacctgctggccctgaccatcatcgtgtccatcgtgcacagcgtgtttgagttcctggccttcaagaatgacatccagttctggaacagccggcagagcctggagggcctgtctgtgcgctctgtgttcttcggggtcttccagagctttgtggtgctgctgtacatcctggacaatgagaccaactttgtggtgcaggtgtctgtgttcatcggcgtgctgattgacctgtggaagatcaccaaggtgatggatgtgcggctggaccgggagcaccgggtggccggcatcttcccccggctgtccttcaaggacaagagcacctacatcgagagcagcaccaaggtgtatgatgacatggccttccgctacctgtcctggatcctcttccccctgctgggctgctatgctgtgtacagcctgctgtacctggagcacaagggctggtacagctgggtgctgtccatgctgtatggcttcctgctgaccttcggcttcatcaccatgaccccccagctgttcatcaactacaagctgaagtctgtggcccacctgccctggaggatgctgacctacaaggccctgaacaccttcattgatgacctgtttgcctttgtgatcaagatgcctgtgatgtacagaattggctgcctgagagatgatgtggtgttcttcatctacctgtaccagcgctggatctacagagtggaccccaccagggtgaatgaatttggcatgtctggagaggaccccacagctgctgcccctgtggccgaggtgcccacagctgctggggccctgacccccaccccagcccccaccaccaccacagccacccgggaggaggccagcaccagcctgcccaccaagcccacccagggcgccagcagcgccagcgagccccagggcctgtttgtggaggccctgtctgtgcccctgagcctgtgtgtgagcagccacctggccctgcctgcccagcaccactgggagagctggtag

SEQ ID NO: 33540 - DNA, 1968 bp, Artificial Sequence
  Description of Artificial Sequence: Synthetic coding sequence
atgagcaggaaggcccacatcacagagaaggtgaccagcaatggcagcatcggccgggaccccccagctgagacccagccccagaaccccccagcccagcctgccccaaatgcctggcaggtgatcaagggcgtgctcttccgcatcttcatcatctgggccatcagctcctggttccggcggggccctgccccccaggaccaggccggccctggaggagccccccgggtggccagcaggaacctcttccccaaggacaccctgatgaacctgcacgtgtacatcagcgagcacgagcacttcacagacttcaatgccaccagcgccctcttctgggagcagcacgacctggtgtatggagactggaccagcggggagaacagtgatggctgctatgagcactttgctgagctggacatcccccagagcgtgcagcagaatggcagcatctacatccacgtgtacttcaccaagagcggcttccacccagacccccggcagaaggccctgtaccgccgcctggccaccgtgcacatgagcaggatgatcaacaagtacaagagaagacgcttccagaagaccaagaacctgctgactggagaaacagaggccgaccctgagatgatcaagagagcagaagattatggccctgtggaggtgatcagccactggcaccccaacatcaccatcaacatcgtggatgaccacaccccctgggtgaagggctctgtgcccccacccctggaccagtatgtgaagtttgatgctgtgtctggggactactaccccatcatctacttcaatgactactggaacctgcagaaggactactaccccatcaatgaaagcctggccagcctgcccctgcgggtgtccttctgccccctgagcctgtggcgctggcagctgtatgctgcccagagcaccaagagcccctggaacttcctgggagatgagctgtatgagcagagtgatgaggagcaggacagcgtgaaggtggccctgctggagaccaacccctacctgctggccctgaccatcatcgtgtccatcgtgcacagcgtgtttgagttcctggccttcaagaatgacatccagttctggaacagccggcagagcctggagggcctgtctgtgcgctctgtgttcttcggggtcttccagagctttgtggtgctgctgtacatcctggacaatgagaccaactttgtggtgcaggtgtctgtgttcatcggcgtgctgattgacctgtggaagatcaccaaggtgatggatgtgcggctggaccgggagcaccgggtggccggcatcttcccccggctgtccttcaaggacaagagcacctacatcgagagcagcaccaaggtgtatgatgacatggccttccgctacctgtcctggatcctcttccccctgctgggctgctatgctgtgtacagcctgctgtacctggagcacaagggctggtacagctgggtgctgtccatgctgtatggcttcctgctgaccttcggcttcatcaccatgaccccccagctgttcatcaactacaagctgaagtctgtggcccacctgccctggaggatgctgacctacaaggccctgaacaccttcattgatgacctgtttgcctttgtgatcaagatgcctgtgatgtacagaattggctgcctgagagatgatgtggtgttcttcatctacctgtaccagcgctggatctacagagtggaccccaccagggtgaatgaatttggcatgtctggagaggaccccacagctgctgcccctgtggccgaggtgcccacagctgctggggccctgacccccaccccagcccccaccaccaccacagccacccgggaggaggccagcaccagcctgcccaccaagcccacccagggcgccagcagcgccagcgagccccaggaggccccacccaagccagctgaggacaagaagaaggactag

SEQ ID NO: 33541 - DNA, 1704 bp, Artificial Sequence
  Description of Artificial Sequence: Synthetic coding sequence
atgaacctgcacgtgtacatcagcgagcacgagcacttcacagacttcaatgccaccagcgccctcttctgggagcagcacgacctggtgtatggagactggaccagcggggagaacagtgatggctgctatgagcactttgctgagctggacatcccccagagcgtgcagcagaatggcagcatctacatccacgtgtacttcaccaagagcggcttccacccagacccccggcagaaggccctgtaccgccgcctggccaccgtgcacatgagcaggatgatcaacaagtacaagagaagacgcttccagaagaccaagaacctgctgactggagaaacagaggccgaccctgagatgatcaagagagcagaagattatggccctgtggaggtgatcagccactggcaccccaacatcaccatcaacatcgtggatgaccacaccccctgggtgaagggctctgtgcccccacccctggaccagtatgtgaagtttgatgctgtgtctggggactactaccccatcatctacttcaatgactactggaacctgcagaaggactactaccccatcaatgaaagcctggccagcctgcccctgcgggtgtccttctgccccctgagcctgtggcgctggcagctgtatgctgcccagagcaccaagagcccctggaacttcctgggagatgagctgtatgagcagagtgatgaggagcaggacagcgtgaaggtggccctgctggagaccaacccctacctgctggccctgaccatcatcgtgtccatcgtgcacagcgtgtttgagttcctggccttcaagaatgacatccagttctggaacagccggcagagcctggagggcctgtctgtgcgctctgtgttcttcggggtcttccagagctttgtggtgctgctgtacatcctggacaatgagaccaactttgtggtgcaggtgtctgtgttcatcggcgtgctgattgacctgtggaagatcaccaaggtgatggatgtgcggctggaccgggagcaccgggtggccggcatcttcccccggctgtccttcaaggacaagagcacctacatcgagagcagcaccaaggtgtatgatgacatggccttccgctacctgtcctggatcctcttccccctgctgggctgctatgctgtgtacagcctgctgtacctggagcacaagggctggtacagctgggtgctgtccatgctgtatggcttcctgctgaccttcggcttcatcaccatgaccccccagctgttcatcaactacaagctgaagtctgtggcccacctgccctggaggatgctgacctacaaggccctgaacaccttcattgatgacctgtttgcctttgtgatcaagatgcctgtgatgtacagaattggctgcctgagagatgatgtggtgttcttcatctacctgtaccagcgctggatctacagagtggaccccaccagggtgaatgaatttggcatgtctggagaggaccccacagctgctgcccctgtggccgaggtgcccacagctgctggggccctgacccccaccccagcccccaccaccaccacagccacccgggaggaggccagcaccagcctgcccaccaagcccacccagggcgccagcagcgccagcgagccccaggaggccccacccaagccagctgaggacaagaagaaggactag

SEQ ID NO: 33542 - DNA, 2124 bp, Artificial Sequence
  Description of Artificial Sequence: Synthetic coding sequence
atgctgggcagcctggtgctgcggaggaaggccctggccccccggctgctgctgcggctgctgcggagccccaccctgcggggccatggaggagccagcggcagaaatgtgaccaccggcagcctgggggagccccagtggctgcgggtggccaccggcggccggcccggcaccagccctgccctcttcagcggccgcggggccgccaccggcggccggcagggcggccgctttgacaccaagtgcctggccgccgccacctggggccgcctgcccggccctgaggagaccctgcccggccaggacagctggaatggagtgcccagcagagctggcctgggcatgtgtgccctggccgccgccctggtggtgcactgctacagcaagagccccagcaacaaggatgctgccctgctggaggccgcccgggccaacaacatgcaggaggtgtcccggctgctgtctgagggcgcagatgtgaatgccaagcaccggctgggctggacagccctgatggtggccgccatcaacagaaacaacagcgtggtgcaggtgctgctggccgccggggctgaccccaacctgggagatgacttcagctctgtgtacaagacagccaaggagcagggcatccacagcctggaggatggcggccaggatggagccagccgccacatcaccaaccagtggaccagcgccctggagttccgccgctggctgggcctgcctgctggggtgctgatcaccagagaagatgacttcaacaaccggctgaacaacagagccagcttcaagggctgcacagccctgcactatgctgtgctggctgatgactacagaacagtgaaggagctgctggatggaggagccaaccccctgcagagaaatgagatgggccacacccccctggactatgcccgggagggggaggtgatgaagctgctgcggaccagcgaggccaagtaccaggagaagcagaggaagcgggaggccgaggagcggcggcgcttccccctggagcagaggctgaaggagcacatcatcggccaggagagcgccatcgccaccgtgggcgccgccatccggaggaaagaaaatggctggtatgatgaggagcaccccctggtgttcctgttcctgggcagcagcggcatcggcaagacagagctggccaagcagacagccaagtacatgcacaaggatgccaagaagggcttcatccggctggacatgtctgagttccaggagagacatgaggtggccaagttcatcggcagccccccaggctacgtgggccacgaggagggcggccagctgaccaagaagctgaagcagtgccccaatgctgtggtgctgtttgatgaggtggacaaggcccacccagatgtgctgaccatcatgctgcagctgtttgatgagggccgcctgacagatggcaagggcaagaccatcgactgcaaggatgccatcttcatcatgaccagcaatgtggccagtgatgagatcgcccagcacgccctgcagctgcggcaggaggccctggagatgagcaggaacagaattgctgagaacctgggagatgtgcagatcagtgacaagatcaccatcagcaagaacttcaaggaaaatgtcatccggcccatcctgaaggcccacttcagaagagatgagttcctgggccgcatcaatgaaattgtgtacttcctgcccttctgccacagcgagctgatccagctggtgaacaaggagctgaacttctgggccaagagggccaagcagaggcacaacatcaccctgctgtgggaccgggaggtggctgatgtgctggtggatggctacaacgtgcactatggagcccggagcatcaagcatgaggtggagcggcgggtggtgaaccagctggccgccgcctatgagcaggacctgctgcccggcggctgcaccctgcgcatcaccgtggaggacagcgacaagcagctgctgaagagccctgagctgcccagcccccaggccgagaagaggctgcccaagctgcggctggagatcatcgacaaggacagcaagacccggcggctggacatccgggcccccctgcaccctgagaaggtgtgcaacaccatctag

SEQ ID NO: 33543 - DNA, 1989 bp, Artificial Sequence
  Description of Artificial Sequence: Synthetic coding sequence
atgccccggggctgccacctgggcacccccagctggagcagaagaaacacccccaggacaggccagctggagcggggcccccagcagggccgcacaggccacgtgcggcccggccgctctgctgggggcagcctgctgcagcaggagagcgtgcagcagggctgcagccctgtgggcagctgcccctgccagcagtatgcccggagccagcagccccaggagacagccaagaatgatgcccagagccgctcctgggccggcctgaatgctggggtgtccctgaagaacaccaagatcagcagcagcgagtggcccctgcggctgctgtctgagggcgcagatgtgaatgccaagcaccggctgggctggacagccctgatggtggccgccatcaacagaaacaacagcgtggtgcaggtgctgctggccgccggggctgaccccaacctgggagatgacttcagctctgtgtacaagacagccaaggagcagggcatccacagcctggaggatggcggccaggatggagccagccgccacatcaccaaccagtggaccagcgccctggagttccgccgctggctgggcctgcctgctggggtgctgatcacccgggaggatgacttcaacaaccggctgaacaacagagccagcttcaagggctgcacagccctgcactatgctgtgctggctgatgactacagaacagtgaaggagctgctggatggaggagccaaccccctgcagagaaatgagatgggccacacccccctggactatgcccgggagggggaggtgatgaagctgctgcggaccagcgaggccaagtaccaggagaagcagaggaagcgggaggccgaggagcggcggcgcttccccctggagcagaggctgaaggagcacatcatcggccaggagagcgccatcgccaccgtgggcgccgccatccggaggaaagaaaatggctggtatgatgaggagcaccccctggtgttcctgttcctgggcagcagcggcatcggcaagacagagctggccaagcagacagccaagtacatgcacaaggatgccaagaagggcttcatccggctggacatgtctgagttccaggagagacatgaggtggccaagttcatcggcagccccccaggctacgtgggccacgaggagggcggccagctgaccaagaagctgaagcagtgccccaatgctgtggtgctgtttgatgaggtggacaaggcccacccagatgtgctgaccatcatgctgcagctgtttgatgagggccgcctgacagatggcaagggcaagaccatcgactgcaaggatgccatcttcatcatgaccagcaatgtggccagtgatgaaattgcccagcacgccctgcagctgcggcaggaggccctggagatgagcaggaacagaattgctgagaacctgggagatgtgcagatcagtgacaagatcaccatcagcaagaacttcaaggaaaatgtcatccggcccatcctgaaggcccacttcagaagagatgagttcctgggccgcatcaatgagatcgtgtacttcctgcccttctgccacagcgagctgatccagctggtgaacaaggagctgaacttctgggccaagagggccaagcagaggcacaacatcaccctgctgtgggaccgggaggtggctgatgtgctggtggatggctacaacgtgcactacggggcccggagcatcaagcatgaggtggagaggagagtggtgaaccagctggccgccgcctatgagcaggacctgctgcccggcggctgcaccctgcgcatcaccgtggaggacagcgacaagcagctgctgaagagccctgagctgcccagcccccaggccgagaagaggctgcccaagctgcggctggagatcatcgacaaggacagcaagacccggcggctggacatccgggcccccctgcaccctgagaaggtgtgcaacaccatctag

SEQ ID NO: 33544 - DNA, 2034 bp, Artificial Sequence
  Description of Artificial Sequence: Synthetic coding sequence
atgctgggcagcctggtgctgcggaggaaggccctggccccccggctgctgctgcggctgctgcggagccccaccctgcggggccatggaggagccagcggcagaaatgtgaccaccggcagcctgggggagccccagtggctgcgggtggccaccggcggccggcccggcaccagccctgccctcttcagcggccgcggggccgccaccggcggccggcagggcggccgctttgacaccaagtgcctggccgccgccacctggggccgcctgcccggccctgaggagaccctgcccggccaggacagctggaatggagtgcccagcagagctggcctgggcatgtgtgccctggccgccgccctggtggtgcactgctacagcaagagccccagcaacaaggatgctgccctgctggaggccgcccgggccaacaacatgcaggaggtgtcccggctgctgtctgagggcgcagatgtgaatgccaagcaccggctgggctggacagccctgatggtggccgccatcaacagaaacaacagcgtggtgcaggtgctgctggccgccggggctgaccccaacctgggagatgacttcagctctgtgtacaagacagccaaggagcagggcatccacagcctggaggtgctgatcaccagagaagatgacttcaacaaccggctgaacaacagagccagcttcaagggctgcacagccctgcactatgctgtgctggctgatgactacagaacagtgaaggagctgctggatggaggagccaaccccctgcagagaaatgagatgggccacacccccctggactatgcccgggagggggaggtgatgaagctgctgcggaccagcgaggccaagtaccaggagaagcagaggaagcgggaggccgaggagcggcggcgcttccccctggagcagaggctgaaggagcacatcatcggccaggagagcgccatcgccaccgtgggcgccgccatccggaggaaagaaaatggctggtatgatgaggagcaccccctggtgttcctgttcctgggcagcagcggcatcggcaagacagagctggccaagcagacagccaagtacatgcacaaggatgccaagaagggcttcatccggctggacatgtctgagttccaggagagacatgaggtggccaagttcatcggcagccccccaggctacgtgggccacgaggagggcggccagctgaccaagaagctgaagcagtgccccaatgctgtggtgctgtttgatgaggtggacaaggcccacccagatgtgctgaccatcatgctgcagctgtttgatgagggccgcctgacagatggcaagggcaagaccatcgactgcaaggatgccatcttcatcatgaccagcaatgtggccagtgatgagatcgcccagcacgccctgcagctgcggcaggaggccctggagatgagcaggaacagaattgctgagaacctgggagatgtgcagatcagtgacaagatcaccatcagcaagaacttcaaggaaaatgtcatccggcccatcctgaaggcccacttcagaagagatgagttcctgggccgcatcaatgaaattgtgtacttcctgcccttctgccacagcgagctgatccagctggtgaacaaggagctgaacttctgggccaagagggccaagcagaggcacaacatcaccctgctgtgggaccgggaggtggctgatgtgctggtggatggctacaacgtgcactatggagcccggagcatcaagcatgaggtggagcggcgggtggtgaaccagctggccgccgcctatgagcaggacctgctgcccggcggctgcaccctgcgcatcaccgtggaggacagcgacaagcagctgctgaagagccctgagctgcccagcccccaggccgagaagaggctgcccaagctgcggctggagatcatcgacaaggacagcaagacccggcggctggacatccgggcccccctgcaccctgagaaggtgtgcaacaccatctag

SEQ ID NO: 33545 - DNA, 1521 bp, Artificial Sequence
  Description of Artificial Sequence: Synthetic coding sequence
atggtggccgccatcaacagaaacaacagcgtggtgcaggtgctgctggccgccggggctgaccccaacctgggagatgacttcagctctgtgtacaagacagccaaggagcagggcatccacagcctggaggtgctgatcacccgggaggatgacttcaacaaccggctgaacaacagagccagcttcaagggctgcacagccctgcactatgctgtgctggctgatgactacagaacagtgaaggagctgctggatggaggagccaaccccctgcagagaaatgagatgggccacacccccctggactatgcccgggagggggaggtgatgaagctgctgcggaccagcgaggccaagtaccaggagaagcagaggaagcgggaggccgaggagcggcggcgcttccccctggagcagaggctgaaggagcacatcatcggccaggagagcgccatcgccaccgtgggcgccgccatccggaggaaagaaaatggctggtatgatgaggagcaccccctggtgttcctgttcctgggcagcagcggcatcggcaagacagagctggccaagcagacagccaagtacatgcacaaggatgccaagaagggcttcatccggctggacatgtctgagttccaggagagacatgaggtggccaagttcatcggcagccccccaggctacgtgggccacgaggagggcggccagctgaccaagaagctgaagcagtgccccaatgctgtggtgctgtttgatgaggtggacaaggcccacccagatgtgctgaccatcatgctgcagctgtttgatgagggccgcctgacagatggcaagggcaagaccatcgactgcaaggatgccatcttcatcatgaccagcaatgtggccagtgatgaaattgcccagcacgccctgcagctgcggcaggaggccctggagatgagcaggaacagaattgctgagaacctgggagatgtgcagatcagtgacaagatcaccatcagcaagaacttcaaggaaaatgtcatccggcccatcctgaaggcccacttcagaagagatgagttcctgggccgcatcaatgagatcgtgtacttcctgcccttctgccacagcgagctgatccagctggtgaacaaggagctgaacttctgggccaagagggccaagcagaggcacaacatcaccctgctgtgggaccgggaggtggctgatgtgctggtggatggctacaacgtgcactacggggcccggagcatcaagcatgaggtggagaggagagtggtgaaccagctggccgccgcctatgagcaggacctgctgcccggcggctgcaccctgcgcatcaccgtggaggacagcgacaagcagctgctgaagagccctgagctgcccagcccccaggccgagaagaggctgcccaagctgcggctggagatcatcgacaaggacagcaagacccggcggctggacatccgggcccccctgcaccctgagaaggtgtgcaacaccatctag

SEQ ID NO: 33546 - DNA, 1902 bp, Artificial Sequence
  Description of Artificial Sequence: Synthetic coding sequence
atgcccagctgtggggcctgcacctgtggggctgctgctgtgcggctcatcaccagcagcctggccagcgcccagaggggcatcagcggcggccgcatccacatgtctgtgctgggccgcctgggcacctttgagacccagatcctgcagagggcccccctgcggagcttcacagagaccccagcctactttgccagcaaggatggcatcagcaaggatggcagcggagatggcaacaagaagagcgccagcgagggcagcagcaagaagagcggcagcggcaacagcggcaagggcggcaaccagctgcgctgccccaagtgtggggacctgtgcacccacgtggagacctttgtgagcagcaccaggtttgtgaagtgtgagaagtgccaccacttctttgtggtgctgtctgaggccgacagcaagaagagcatcatcaaggagcctgagagcgctgctgaggccgtgaagctggccttccagcagaagcccccacctccacccaagaagatctacaactacctggacaagtatgtggtgggccagagctttgccaagaaggtgctgtctgtggccgtgtacaaccactacaagaggatctacaacaacatcccagccaacctgcggcagcaggccgaggtggagaagcagaccagcctgaccccccgggagctggagatcagaagaagagaagatgagtaccgcttcaccaagctgctgcagattgctggcatcagcccccatggaaatgccctgggcgcctccatgcagcagcaggtgaaccagcagatcccccaggagaagagaggaggagaggtgctggacagcagccatgatgacatcaagctggagaagagcaacatcctgctgctgggccccactggaagtggcaagaccctgctggcccagaccctggccaagtgcctggatgtgccctttgccatctgtgactgcaccaccctgacccaggccggctacgtgggggaggacatcgagagcgtcatcgccaagctgctgcaggatgccaactacaacgtggagaaggcccagcagggcatcgtgttcctggatgaggtggacaagattggctctgtgcccggcatccaccagctgagagatgtgggcggggagggcgtgcagcagggcctgctgaagctgctggagggcaccatcgtgaatgtgcctgagaagaacagcaggaagctgcggggggagaccgtgcaggtggacaccaccaacatcctgtttgtggccagcggggccttcaacggcctggaccgcatcatcagcaggaggaagaatgagaagtacctgggcttcggcacccccagcaacctgggcaaaggaagaagagctgctgctgctgctgacctggccaacagaagtggagagagcaacacccaccaggacatcgaggagaaggaccggctgctgcggcacgtggaggcccgggacctgattgaatttggcatgatccctgagtttgtgggccgcctgcctgtggtggtgcccctgcacagcctggatgagaagaccctggtgcagatcctgacagagcccagaaatgctgtgatcccccagtaccaggccctcttctccatggacaagtgtgagctgaatgtgacagaagatgccctgaaggccatcgcccggctggccctggagaggaagacaggagcccggggcctgcggagcatcatggagaagctgctgctggagcccatgtttgaggtgcccaacagcgacatcgtgtgtgtggaggtggacaaggaggtggtggagggcaagaaggagcccggctacatccgggcccccaccaaggagagcagcgaggaggagtatgattctggagtggaggaggagggctggccccggcaggctgatgctgccaacagctag

SEQ ID NO: 33547 - DNA, 1602 bp, Artificial Sequence
  Description of Artificial Sequence: Synthetic coding sequence
atgcccagctgtggggcctgcacctgtggggctgctgctgtgcggctcatcaccagcagcctggccagcgcccagaggggcatcagcggcggccgcatccacatgtctgtgctgggccgcctgggcacctttgagacccagatcctgcagagggcccccctgcggagcttcacagagaccccagcctactttgccagcaaggatggcatcagcaaggatggcagcggagatggcaacaagaagagcgccagcgagggcagcagcaagaagagcggcagcggcaacagcggcaagggcggcaaccagctgcgctgccccaagtgtggggacctgtgcacccacgtggagacctttgtgagcagcaccaggtttgtgaagtgtgagaagtgccaccacttctttgtggtgctgtctgaggccgacagcaagaagagcatcatcaaggagcctgagagcgctgctgaggccgtgaagctggccttccagcagaagcccccacctccacccaagaagatctacaactacctggacaagtatgtggtgggccagagctttgccaagaaggtgctgtctgtggccgtgtacaaccactacaagaggatctacaacaacatcccagccaacctgcggcagcaggccgaggtggagaagcagaccagcctgaccccccgggagctggagatcagaagaagagaagatgagtaccgcttcaccaagctgctgcagattgctggcatcagcccccatggaaatgccctgggcgcctccatgcagcagcaggtgaaccagcagatcccccaggagaagagaggaggagaggtgctggacagcagccatgatgacatcaagctggagaagagcaacatcctgctgctgggccccactggaagtggcaagaccctgctggcccagaccctggccaagtgcctggatgtgccctttgccatctgtgactgcaccaccctgacccaggccggctacgtgggggaggacatcgagagcgtcatcgccaagctgctgcaggatgccaactacaacgtggagaaggcccagcagggcatcgtgttcctggatgaggtggacaagattggctctgtgcccggcatccaccagctgagagatgtgggcggggagggcgtgcagcagggcctgctgaagctgctggagggcaccatcgtgaatgtgcctgagaagaacagcaggaagctgcggggggagaccgtgcaggtggacaccaccaacatcctgtttgtggccagcggggccttcaacggcctggaccgcatcatcagcaggaggaagaatgagaagtacctgggcttcggcacccccagcaacctgggcaaaggaagaagagctgctgctgctgctgacctggccaacagaagtggagagagcaacacccaccaggacatcgaggagaaggaccggctgctgcggcacgtggaggcccgggacctgattgaatttggcatgatccctgagtttgtgggccgcctgcctgtggtggtgcccctgcacagcctggatgagaagaccctggtgcagatcctgacagagcccccccacccagccctcttcaccatcttcaaccccttctag

SEQ ID NO: 33548 - DNA, 2625 bp, Artificial Sequence
  Description of Artificial Sequence: Synthetic coding sequence
atgctgaagaagtttgacaagaaggatgaggagagcggcggcggcagcaaccccttccagcacctggagaagtctgctgtgctgcaggaggcccgggtcttcaatgagacccccatcaaccccaggaaatgtgcccacatcctgaccaagatcctgtacctgatcaaccagggcgagcacctgggcaccacagaggccacagaggccttctttgccatgaccaagctgttccagagcaatgaccccaccctgcggaggatgtgctacctgaccatcaaggagatgagctgcatcgccgaggatgtgatcatcgtgaccagcagcctgaccaaggacatgaccgggaaggaggacaactaccggggccctgctgtgcgggccctgtgccagatcacagacagcaccatgctgcaggccatcgagcgctacatgaagcaggccatcgtggacaaggtgcccagcgtgagcagcagcgccctggtgagcagcctgcacctgctgaagtgcagctttgatgtggtgaagcgctgggtgaatgaggcccaggaggccgccagcagtgacaacatcatggtgcagtaccacgccctgggcctgctgtaccacgtgaggaagaatgaccggctggccgtgaacaagatgatcagcaaggtgaccaggcatggcctgaagagcccctttgcctactgcatgatgatccgggtggccagcaagcagctggaggaggaggatggcagccgggacagccccctgtttgacttcatcgagagctgcctgaggaacaagcatgagatggtggtgtatgaggccgccagcgccatcgtgaacctgcccggctgcagcgccaaggagctggccccagctgtgtctgtgctgcagctgttctgcagcagccccaaggccgccctgcgctatgctgctgtgaggaccctgaacaaggtggccatgaagcaccccagcgctgtgacagcctgcaacctggacctggagaacctggtgacagacagcaacagaagcatcgccaccctggccatcaccaccctgctgaagacaggcagcgagagcagcattgaccggctgatgaagcagatcagcagcttcatgtctgagatcagtgatgagttcaaggtggtggtggtgcaggccatcagcgccctgtgccagaagtaccccaggaagcatgctgtgctgatgaacttcctgttcaccatgctgcgggaggagggcggctttgagtacaagagggccatcgtggactgcatcatcagcatcattgaagaaaattctgagagcaaggagaccggcctgagccacctgtgtgagttcatcgaggactgtgagttcaccgtgctggccacccgcatcctgcacctgctgggccaggagggccccaagaccaccaaccccagcaagtacatccgcttcatctacaacagagtggtgctggagcacgaggaggtgcgggccggggctgtgtctgccctggccaagtttggagcccagaatgaggagatgctgcccagcatcctggtgctgctgaagagatgtgtgatggatgatgacaatgaggtgcgggaccgggccaccttctacctgaatgtgctggagcagaagcagaaggccctgaatgccggctacatcctgaatggcctgactgtgtccatccctggcctggagcgggccctgcagcagtacaccctggagcccagcgagaagccctttgacctgaagtctgtgcccctggccacagcccccatggccgagcagaggacagagagcacccccatcacagctgtgaagcagcctgagaaggtggccgccacccggcaggagatcttccaggagcagctggccgctgtgcctgagttccggggcctgggccccctcttcaagagcagccctgagcctgtggccctgacagagagcgagacagaatatgtgatccgctgcaccaagcacaccttcaccaaccacatggtgttccagtttgactgcaccaacaccctgaatgaccagaccctggagaatgtgacagtgcagatggagcccacagaggcctatgaggtgctgtgctacgtgcctgcccggagcctgccctacaaccagcccggcacctgctacaccctggtggccctgcccaaggaggaccccacagctgtggcctgcaccttcagctgcatgatgaagttcaccgtgaaggactgtgaccccaccactggagaaacagatgatgagggctatgaagatgaatatgtgctggaggacctggaggtgacagtggccgaccacatccagaaggtgatgaagctgaactttgaggccgcctgggatgaggtgggagatgaatttgagaaggaggagaccttcaccctgagcaccatcaagaccctggaggaggccgtgggcaacatcgtgaagttcctgggcatgcacccctgtgagaggagtgacaaggtgcctgacaacaagaacacccacaccctgctgctggccggggtcttccggggcggccatgacatcctggtgcgcagccggctgctgctgctggacacagtgaccatgcaggtgacagcccggagcctggaggagctgcctgtggacatcatcctggcctctgtgggctag

SEQ ID NO: 33549 - DNA, 534 bp, Artificial Sequence
  Description of Artificial Sequence: Synthetic coding sequence
atggaggccctgatcctggagcccagcctgtacacagtgaaggccatcctgatcctggacaatgatggagaccggctgtttgccaagtactatgatgacacctaccccagcgtgaaggagcagaaggcctttgagaagaacatcttcaacaagacccacaggacagattctgaaattgccctgctggagggcctgactgtggtgtacaagagcagcattgacctgtacttctacgtgattggcagcagctatgaaaatgagctgatgctgatggctgtgctgaactgcctgtttgacagcctgagccagatgctgaggaagaatgtggagaagagggccctgctggagaacatggagggcctcttcctggccgtggatgagatcgtggatggcggcgtcatcctggagagtgacccccagcaggtggtgcaccgggtggccctgcggggagaagatgtgcccctgacagagcagacagtgtcccaggtgctgcagagcgccaaggagcagatcaagtggagcctgctgaggtag

SEQ ID NO: 33550 - DNA, 381 bp, Artificial Sequence
  Description of Artificial Sequence: Synthetic coding sequence
atgatggagattgacttcctgcccagcaccatgaccacccccacccctgtgagccgcagcaagaggcccctgcggaggaccttcagcacccggcccatcggcctgaccctgatgctgatggctgtgctgaactgcctgtttgacagcctgagccagatgctgaggaagaatgtggagaagagggccctgctggagaacatggagggcctcttcctggccgtggatgaaattgtggatggaggagtcatcctggagagtgacccccagcaggtggtgcaccgggtggccctgcggggggaggatgtgcccctgacagagcagacagtgtcccaggtgctgcagagcgccaaggagcagatcaagtggagcctgctgaggtag

SEQ ID NO: 33551 - DNA, 465 bp, Artificial Sequence
  Description of Artificial Sequence: Synthetic coding sequence
atggaggccctgatcctgtactatgatgacacctaccccagcgtgaaggagcagaaggcctttgagaagaacatcttcaacaagacccacaggacagacagcgagatcgccctgctggagggcctgactgtggtgtacaagagcagcattgacctgtacttctacgtgattggcagcagctatgaaaatgagctgatgctgatggctgtgctgaactgcctgtttgacagcctgagccagatgctgaggaagaatgtggagaagagggccctgctggagaacatggagggcctcttcctggccgtggatgaaattgtggatggaggagtcatcctggagagtgacccccagcaggtggtgcaccgggtggccctgcggggggaggatgtgcccctgacagagcagacagtgtcccaggtgctgcagagcgccaaggagcagatcaagtggagcctgctgaggtag

SEQ ID NO: 33552 - DNA, 279 bp, Artificial Sequence
  Description of Artificial Sequence: Synthetic coding sequence
atggaggccctgatcctggagcccagcctgtacacagtgaaggccatcctgatcctggacaatgatggagaccggctgtttgccaagtactatgatgacacctaccccagcgtgaaggagcagaaggcctttgagaagaacatcttcaacaagacccacaggacagattctgaaattgccctgctggagggcctgactgtggtgtacaagagcagcattgacctgtacttctacgtgattggcagcagctatgaaaatgagctgatgctgatggcctag

SEQ ID NO: 33553 - DNA, 744 bp, Artificial Sequence
  Description of Artificial Sequence: Synthetic coding sequence
atggcctgggccggcagcagaagagtgcctgctggcaccagggctgctgctgagcgctgctgccgcctgagcctgagccctggggcccagcctgcccctcctcctggccccctgcccccaccccggcccatgaggttcctgaccagctgcagcctgctgctgcccagggctgcccagatcctggccgctgaggccggcctgcccagcagccgctccttcatgggctttgctgcccccttcaccaacaagaggaaggcctacagcgagcggcgcatcatgggctacagcatgcaggagatgtatgaggtggtgtccaatgtgcaggagtaccgggagtttgtgccctggtgcaagaagagcctggtggtgagcagcaggaagggccacctgaaggcccagctggaggtgggcttcccccctgtgatggagcgctacaccagcgctgtgtccatggtgaagccccacatggtgaaggctgtgtgcacagatggcaagctgttcaaccacctggagaccatctggaggttcagccctggcatcccagcctaccccaggacctgcaccgtggacttcagcatcagctttgagttccgcagcctgctgcacagccagctggccaccatgttctttgatgaggtggtgaagcagaatgtggccgcctttgaaagaagagctgccaccaagtttggacctgagacagccatcccccgggagctgatgttccacgaggtgcaccagacctag

SEQ ID NO: 33554 - DNA, 648 bp, Artificial Sequence
  Description of Artificial Sequence: Synthetic coding sequence
atgctgctgcaggtggtgcgggagggcaagttcagcggcttcctgaccagctgcagcctgctgctgcccagggctgcccagatcctggccgctgaggccggcctgcccagcagccgctccttcatgggctttgctgcccccttcaccaacaagaggaaggcctacagcgagcggcgcatcatgggctacagcatgcaggagatgtatgaggtggtgtccaatgtgcaggagtaccgggagtttgtgccctggtgcaagaagagcctggtggtgagcagcaggaagggccacctgaaggcccagctggaggtgggcttcccccctgtgatggagcgctacaccagcgctgtgtccatggtgaagccccacatggtgaaggctgtgtgcacagatggcaagctgttcaaccacctggagaccatctggaggttcagccctggcatcccagcctaccccaggacctgcaccgtggacttcagcatcagctttgagttccgcagcctgctgcacagccagctggccaccatgttctttgatgaggtggtgaagcagaatgtggccgcctttgaaagaagagctgccaccaagtttggacctgagacagccatcccccgggagctgatgttccacgaggtgcaccagacctag

SEQ ID NO: 33555 - DNA, 693 bp, Artificial Sequence
  Description of Artificial Sequence: Synthetic coding sequence
atgcacagcagcagccccagccccaccaatgaccggggcctgcggaggaccatccggctggcccccctgagctttggcctgcgcttcctgaccagctgcagcctgctgctgccccgggccgcccagatcctggccgctgaggccggcctgcccagcagccgctccttcatgggctttgctgcccccttcaccaacaagaggaaggcctacagcgagcggcgcatcatgggctacagcatgcaggagatgtatgaggtggtgtccaatgtgcaggagtaccgggagtttgtgccctggtgcaagaagagcctggtggtgagcagcaggaagggccacctgaaggcccagctggaggtgggcttcccccctgtgatggagcgctacaccagcgctgtgtccatggtgaagccccacatggtgaaggctgtgtgcacagatggcaagctgttcaaccacctggagaccatctggaggttcagccctggcatcccagcctaccccaggacctgcaccgtggacttcagcatcagctttgagttccgcagcctgctgcacagccagctggccaccatgttctttgatgaggtggtgaagcagaatgtggccgcctttgagcggcgggccgccaccaagtttggacctgagacagccatcccccgggagctgatgtttcatgaggtgcaccagacctag

SEQ ID NO: 33556 - DNA, 195 bp, Artificial Sequence
  Description of Artificial Sequence: Synthetic coding sequence
tgaagaacctgcaccgtggacttcagcatcagctttgagttccgcagcctgctgcacagccagctggccaccatgttctttgatgaggtggtgaagcagaatgtggccgcctttgagcggcgggccgccaccaagtttggacctgagacagccatcccccgggagctgatgtttcatgaggtgcaccagacctag

SEQ ID NO: 33557 - DNA, 717 bp, Artificial Sequence
  Description of Artificial Sequence: Synthetic coding sequence
atggccgccaggacaggccacacagccctgcggcgggtggtgtctggctgccggcccaagagcgccacagctgctggggcccaggcccctgtgagaaatggccgctacctggccagctgtggcatcctgatgagcaggaccctgcccctgcacaccagcatcctgcccaaggagatctgtgcccggaccttcttcaagatcacagcccccctcatcaacaagaggaaggagtacagcgagcggcgcatcctgggctacagcatgcaggagatgtatgatgtggtgtctggagtggaggactacaagcactttgtgccctggtgcaagaagagtgatgtgatcagcaagaggagcggctactgcaagacccggctggagatcggcttcccccctgtgctggagcgctacacctctgtggtgaccctggtgaagccccacctggtgaaggccagctgcacagatggccgcctcttcaaccacctggagaccatctggaggttcagccctggcctgcccggctaccccaggacctgcaccctggacttcagcatcagctttgagttccgcagcctgctgcacagccagctggccaccctcttctttgatgaggtggtgaagcagatggtggccgcctttgagcggcgggcctgcaagctgtatggccctgagaccaacatcccccgggagctgatgctgcacgaggtgcaccacacctag

SEQ ID NO: 33558 - DNA, 633 bp, Artificial Sequence
  Description of Artificial Sequence: Synthetic coding sequence
atgggcgtgtgtgtgtggagatacctggccagctgtggcatcctgatgagcaggaccctgcccctgcacaccagcatcctgcccaaggagatctgtgcccggaccttcttcaagatcacagcccccctcatcaacaagaggaaggagtacagcgagcggcgcatcctgggctacagcatgcaggagatgtatgatgtggtgtctggagtggaggactacaagcactttgtgccctggtgcaagaagagtgatgtgatcagcaagaggagcggctactgcaagacccggctggagatcggcttcccccctgtgctggagcgctacacctctgtggtgaccctggtgaagccccacctggtgaaggccagctgcacagatggccgcctcttcaaccacctggagaccatctggaggttcagccctggcctgcccggctaccccaggacctgcaccctggacttcagcatcagctttgagttccgcagcctgctgcacagccagctggccaccctcttctttgatgaggtggtgaagcagatggtggccgcctttgagcggcgggcctgcaagctgtatggccctgagaccaacatcccccgggagctgatgctgcacgaggtgcaccacacctag

SEQ ID NO: 33559 - DNA, 588 bp, Artificial Sequence
  Description of Artificial Sequence: Synthetic coding sequence
atgagcaggaccctgcccctgcacaccagcatcctgcccaaggagatctgtgcccggaccttcttcaagatcacagcccccctcatcaacaagaggaaggagtacagcgagcggcgcatcctgggctacagcatgcaggagatgtatgatgtggtgtctggagtggaggactacaagcactttgtgccctggtgcaagaagagtgatgtgatcagcaagaggagcggctactgcaagacccggctggagatcggcttcccccctgtgctggagcgctacacctctgtggtgaccctggtgaagccccacctggtgaaggccagctgcacagatggccgcctcttcaaccacctggagaccatctggaggttcagccctggcctgcccggctaccccaggacctgcaccctggacttcagcatcagctttgagttccgcagcctgctgcacagccagctggccaccctcttctttgatgaggtggtgaagcagatggtggccgcctttgaaagaagagcctgcaagctgtatggccctgagaccaacatcccccgggagctgatgctgcacgaggtgcaccacacctag

SEQ ID NO: 33560 - DNA, 984 bp, Artificial Sequence
  Description of Artificial Sequence: Synthetic coding sequence
atggccgcccctggcagctgtgccctgtggagctactgcggccggggctggagccgggccatgaggggctgccagctgctgggcctgcggagctcctggccaggggacctgctgagcgcccggctgctgagccaggagaagagagctgctgagacccacttcggctttgagaccgtgtctgaggaggagaagggcggcaaggtgtaccaggtgtttgagagcgtggccaagaagtatgatgtgatgaatgacatgatgagcctgggcatccaccgggtgtggaaggacctgctgctgtggaagatgcaccccctgcccggcacccagctgctggatgtggccggcggcactggagacatcgccttccgcttcctgaactacgtgcagagccagcaccagaggaagcagaagaggcagctgcgggcccagcagaacctgtcctgggaggagatcgccaaggagtaccagaatgaggaggacagcctgggcggcagccgggtggtggtgtgtgacatcaacaaggagatgctgaaggtgggcaagcagaaggccctggcccagggctacagagctggcctggcctgggtgctgggagatgctgaggagctgccctttgatgatgacaagtttgacatctacaccatcgccttcggcatcagaaatgtgacccacatcgaccaggccctgcaggaggcccaccgggtgctgaagccaggcggccgcttcctgtgcctggagttcagccaggtgaacaaccccctcatcagccggctgtatgacctgtacagcttccaggtgattcctgtgctgggggaggtgattgctggggactggaagagctaccagtacctggtggagagcatccgccgcttccccagccaggaggagttcaaggacatgattgaagatgctggcttccacaaggtgacctatgagagcctgaccagcggcatcgtggccatccacagcggcttcaagctgtag

SEQ ID NO: 33561 - DNA, 741 bp, Artificial Sequence
  Description of Artificial Sequence: Synthetic coding sequence
atggccgcccctggcagctgtgccctgtggagctactgcggccggggctggagccgggccatgaggggctgccagctgctgggcctgcggagctcctggccaggggacctgctgagcgcccggctgctgagccaggagaagagagctgctgagacccacttcggctttgagaccgtgtctgaggaggagaagggcggcaaggtgtaccaggtgtttgagagcgtggccaagaagtatgatgtgatgaatgacatgatgagcctgggcatccaccgggtgtggaaggacctgctgctgtggaagatgcaccccctgcccggcacccagctgctggatgtggccggcggcactggagacatcaacaaggagatgctgaaggtgggcaagcagaaggccctggcccagggccatgaccggcgctgccgcctgagccagggcgacctgaggaagagcaacatccgccactgcggccacagcttctggctgcagaccctcatccccttcctgtcctggagcatgaaccagagctaccctgtggagagcctggagctgaaggacaacctggccaatgaaacagctgctgagcacctgctgctgcgcatccgggccctggacagctgcctgaacagaacagtgtccaagtggaagaacaagttcctgagcctcttctacagcttcctgtggagctgcttcagccccagcccccggggcatctggagcgtgtccctgctgaactgctag

SEQ ID NO: 33562 - DNA, 1182 bp, Artificial Sequence
  Description of Artificial Sequence: Synthetic coding sequence
atgatcttcaccttcatgaccaggaagagctgctgcagcaagcaggtgcagaggaagtactggaggaactgccagaagctgacagccaccggcagcgcccccttccccctggccctgcagcgcttctctgtggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgggagatggcagcaccttccagaccaagctgctgattggagcagatggccacaacagcggcgtgcggcaggccgtgggcatccagaatgtgtcctggaactatgaccagagcgctgtggtggccaccctgcacctgtctgaggccacagagaacaacgtggcctggcagcgcttcctgcccagcggccccatcgccctgctgcccctgagtgacaccctgagcagcctggtgtggagcaccagccatgagcacgccgctgagctggtgtccatggatgaggagaagtttgtggatgctgtgaacagcgccttctggagcgatgctgaccacacagacttcatcgacacagctggggccatgctgcagtatgctgtgtccctgctgaagcccaccaaggtgtctgcccggcagctgcccccatctgtggcccgggtggatgccaagagccgggtgctcttccccctgggcctgggccacgccgcagaatatgtgcggccccgggtggccctgattggagatgctgcccaccgggtgcaccccctggccggccagggcgtgaacatgggctttggagacatcagcagcctggcccaccacctgagcacagctgccttcaacgggaaggacctgggctctgtgagccacctgaccggctatgaaacagagcggcagaggcacaacacagccctgctggccgccacagacctgctgaagaggctgtacagcaccagcgccagccccctggtgctgctgcggacctggggcctgcaggccaccaatgctgtgagccccctgaaggagcagatcatggcctttgccagcaagtag

SEQ ID NO: 33563 - DNA, 1407 bp, Artificial Sequence
  Description of Artificial Sequence: Synthetic coding sequence
atggccgcccggctggtgagccgctgtggggctgtgcgggccgccccccacagcggccccctggtgtcctggaggcgctggagcggggccagcacagacacagtgtatgatgtggtggtgtctgggggcggcctggtgggcgccgccatggcctgtgccctgggctatgacatccacttccatgacaagaagatcctgctgctggaggccggccccaagaaggtgctggagaagctgtctgagacctacagcaacagagtgagcagcatcagccctggcagcgccaccctgctgagcagctttggagcctgggaccacatctgcaacatgagataccgggccttccggaggatgcaggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgggagatggcagcaccttccagaccaagctgctgattggagcagatggccacaacagcggcgtgcggcaggccgtgggcatccagaatgtgtcctggaactatgaccagagcgctgtggtggccaccctgcacctgtctgaggccacagaaaataatgtggcctggcagcgcttcctgcccagcggccccatcgccctgctgcccctgagtgacaccctgagcagcctggtgtggagcaccagccatgaacatgctgctgagctggtgtccatggatgaggagaagtttgtggatgctgtgaacagcgccttctggagcgatgctgaccacacagacttcatcgacacagctggggccatgctgcagtatgctgtgtccctgctgaagcccaccaaggtgtctgcccggcagctgccccccagcgtggcccgggtggatgccaagagccgggtgctcttccccctgggcctgggccatgctgctgaatatgtgcggccccgggtggccctgattggagatgctgcccaccgggtgcaccccctggccggccagggcgtgaacatgggctttggagacatcagcagcctggcccaccacctgagcacagctgccttcaacgggaaggacctgggctctgtgagccacctgaccggctatgaaacagagcggcagaggcacaacacagccctgctggccgccacagacctgctgaagaggctgtacagcaccagcgccagccccctggtgctgctgcggacctggggcctgcaggccaccaatgctgtgagccccctgaaggagcagatcatggcctttgccagcaagtag

SEQ ID NO: 33564 - DNA, 1332 bp, Artificial Sequence
  Description of Artificial Sequence: Synthetic coding sequence
atgaggggccagggcccccccctgagcagctttggagtgtggctggccagcagagctgccagtgaccccagccggccccggcggcagggctatgacatccacttccatgacaagaagatcctgctgctggaggccggccccaagaaggtgctggagaagctgtctgagacctacagcaacagagtgagcagcatcagccctggcagcgccaccctgctgagcagctttggagcctgggaccacatctgcaacatgagataccgggccttccggaggatgcaggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgggagatggcagcaccttccagaccaagctgctgattggagcagatggccacaacagcggcgtgcggcaggccgtgggcatccagaatgtgtcctggaactatgaccagagcgctgtggtggccaccctgcacctgtctgaggccacagagaacaacgtggcctggcagcgcttcctgcccagcggccccatcgccctgctgcccctgagtgacaccctgagcagcctggtgtggagcaccagccatgagcacgccgctgagctggtgtccatggatgaggagaagtttgtggatgctgtgaacagcgccttctggagcgatgctgaccacacagacttcatcgacacagctggggccatgctgcagtatgctgtgtccctgctgaagcccaccaaggtgtctgcccggcagctgcccccatctgtggcccgggtggatgccaagagccgggtgctcttccccctgggcctgggccacgccgcagaatatgtgcggccccgggtggccctgattggagatgctgcccaccgggtgcaccccctggccggccagggcgtgaacatgggctttggagacatcagcagcctggcccaccacctgagcacagctgccttcaacgggaaggacctgggctctgtgagccacctgaccggctatgaaacagagcggcagaggcacaacacagccctgctggccgccacagacctgctgaagaggctgtacagcaccagcgccagccccctggtgctgctgcggacctggggcctgcaggccaccaatgctgtgagccccctgaaggagcagatcatggcctttgccagcaagtag

SEQ ID NO: 33565 - DNA, 441 bp, Artificial Sequence
  Description of Artificial Sequence: Synthetic coding sequence
atggccgcccggctggtgagccgctgtggggctgtgcgggccgccccccacagcggccccctggtgtcctggaggcgctggagcggggccagcacagacacagtgtatgatgtggtggtgtctgggggcggcctggtgggcgccgccatggcctgtgccctgggctatgacatccacttccatgacaagaagatcctgctgctggaggccggccccaagaaggtgctggagaagctgtctgagacctacagcaacagagtgagcagcatcagccctggcagcgccaccctgctgagcagctttggagcctgggaccacatctgcaacatgagataccgggccttccggaggatgcaggtgcccctgtacctgttcaactttgtgaagatgtcctggagcgtgctgcgctaccgcagccccctgagccccagcgtgctgtag

SEQ ID NO: 33566 - DNA, 417 bp, Artificial Sequence
  Description of Artificial Sequence: Synthetic coding sequence
atgacctggtggtgccgggtggaggcctggtgggccctgccctggcctgtgccctgggacatgatcttcaccttcatgaccaggaagagctgctgcagcaagcaggtgcagaggaagtactggaggaactgccagaagctgacagccaccggcagcgcccccttccccctggccctgcagcgcttctctgtggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgtag

SEQ ID NO: 33567 - DNA, 789 bp, Artificial Sequence
  Description of Artificial Sequence: Synthetic coding sequence
atgatcttcaccttcatgaccaggaagagctgctgcagcaagcaggtgcagaggaagtactggaggaactgccagaagctgacagccaccggcagcgcccccttccccctggccctgcagcgcttctctgtggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgggagatggcagcaccttccagaccaagctgctgattggagcagatggccacaacagcggcgtgcggcaggccgtgggcatccagaatgtgtcctggaactatgaccagagcgctgtggtggccaccctgcacctgtctgaggccacagagaacaacgtggcctggcagcgcttcctgcccagcggccccatcgccctgctgcccctgagtgacaccctgagcagcctggtgtggagcaccagccatgagcacgccgctgagctggtgtccatggatgaggagaagtttgtggatgctgtgaacagcgccttctggagcgatgctgaccacacagacttcatcgacacagctggggccatgctgcagtatgctgtgtccctgctgaagcccaccaaggtgtctgcccggcagctgcccccatctgtggccaggtag

SEQ ID NO: 33568 - DNA, 1176 bp, Artificial Sequence
  Description of Artificial Sequence: Synthetic coding sequence
atgatcttcaccttcatgaccaggaagagctgctgcagcaagcaggtgcagaggaagtactggaggaactgccagaagctgacagccaccggcagcgcccccttccccctggccctgcagcgcttctctgtggtgtgggatgcctgcagcgaggccctgatcatgtttgacaaggacaacctggatgacatgggctacatcgtggagaatgatgtgatcatgcacgccctgaccaagcagctggaggccgtgtctgacagagtgacagtgctgtaccgcagcaaggccatccgctacacctggccctgccccttccccatggctgacagcagcccctgggtgcacatcaccctgggagatggcagcaccttccagaccaagctgctgattggagcagatggccacaacagcggcgtgcggcaggccgtgggcatccagaatgtgtcctggaactatgaccagagcgctgtggtggccaccctgcacctgtctgaggccacagagaacaacgtggcctggcagcgcttcctgcccagcggccccatcgccctgctgcccctgagtgacaccctgagcagcctggtgtggagcaccagccatgagcacgccgctgagctggtgtccatggatgaggagaagtttgtggatgctgtgaacagcgccttctggagcgatgctgaccacacagacttcatcgacacagctggggccatgctgcagtatgctgtgtccctgctgaagcccaccaaggtgtctgcccggcagctgcccccatctgtggcccgggtggatgccaagagccgggtgctcttccccctgggcctgggccacgccgcagaatatgtgcggccccgggtggccctgattggagatgctgcccaccgggtgcaccccctggccggccagggcgtgaacatgggctttggagacatcagcagcctggcccaccacctgagcacagctgccttcaacgggaaggacctgggctctgtgagccacctgaccggctatgaaacagagcggcagaggcacaacacagccctgctggccgccacagacctgctgaagaggctgtacagcaccagcgccagccccctggtgctgctgcggacctggggcctgcaggccaccaatgctgtgagccccctgaagatcatggcctttgccagcaagtag

SEQ ID NO: 33569 - DNA, 468 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcgagcagcagctggcccagctgacccagcagctggcccagacagagcagcacctgaacaacctgatggcccagctggaccccctgtttgagaggcctgctggggccagcgagcacgaggccatggaccaccccagggctgctgccaggtag

SEQ ID NO: 33570 - DNA, 414 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcgagcagcagctggcccagctgacccagcagctggcccagacagagcagcacctgaacaacctgatggcccagctggaccccctgtttgaaagatag

SEQ ID NO: 33571 - DNA, 420 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcgagcagcagctggcccagctgacccagcagctggcccagacagagcagcacctgaacaacctgatggcccagctggaccccctgtttgagaggagcttctag

SEQ ID NO: 33572 - DNA, 771 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcgagcagcagctggcccagctgacccagcagctggcccagacagagcagcacctgaacaacctgatggcccagctggaccccctgtttgagcgggtgaccaccctggccggggcccagcaggagctgctgaacatgaagctgtggaccatccacgagctgctgcaggacagcaagccagacaaggacatggaggccagcgagcctgaggccagccggcccctgcctgaggacttctgcctgaaggaggatgaggaggagattggagacagccaggcctgggaggagcccaccaactggagcacagagacctggaacctggccacctcctgggaggtgggccggggcctgcggcggcgctgcagccaggccgtggccaagggccccagccacagcctgggctgggagggcggcaccacagctgagggccgcctgaagcagagcctcttctcctag

SEQ ID NO: 33573 - DNA, 360 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcggcggcttcagccgcagcctgtgctgggtgggcggcgtgtag

SEQ ID NO: 33574 - DNA, 852 bp, Artificial Sequence
  Description of Artificial Sequence: Synthetic coding sequence
atggccggggctgtgtccctgctgggcgtggtgggcctgctgctggtgtctgccctgagcggcgtgctgggggaccgggccaacccagacctgcgggcccaccctggaaatgctgcccaccctggcagcggggccacagagccccggcggcggccccccctgaaggaccagcgggagaggaccagggctggcagcctgcccctgggcgccctgtacacagctgctgtggccgcctttgtgctgtacaagtgcctgcagggcaaggatgaaacagctgtgctgcacgaggaggccagcaagcagcagcccctgcagagcgagcagcagctggcccagctgacccagcagctggcccagacagagcagcacctgaacaacctgatggcccagctggaccccctgtttgagcgggtgaccaccctggccggggcccagcaggagctgctgaacatgaagctgtggaccatccacgagctgctgcaggacagcaagccagacaaggacatggaggccagcgagcccggggagggcagcggcggggagagcgctgggggcggggacaaggtgtctgagaccggcaccttcctgatcagcccccacacagaggccagccggcccctgcctgaggacttctgcctgaaggaggatgaggaggagatcggggacagccaggcctgggaggagcccaccaactggagcacagagacctggaacctggccacctcctgggaggtgggccggggcctgcggcggcgctgcagccaggccgtggccaagggccccagccacagcctgggctgggagggcggcaccacagctgagggccgcctgaagcagagcctcttctcctag

SEQ ID NO: 33575 - DNA, 1011 bp, Artificial Sequence
  Description of Artificial Sequence: Synthetic coding sequence
atgctgcagaggggcctgtggccctggaggacccggctgctgcccaccccaggcacctggaggcctgcccggccctggcccctgcccccaccaccccaggtgctgcgggtgaagctgtgtggaaatgtgaagtactaccagagccaccactacagcacagtggtgcccccagatgagatcaccgtcatctaccgccacggcctgcccctggtgaccctgaccctgcccagcaggaaggagcgctgccagtttgtggtgaagcccatgctgagcacagtgggcagcttcctgcaggacctgcagaatgaagataaaggcatcaagacagctgccatcttcaccgcagatggcaacatgatcagcgccagcaccctgatggacatcctgctgatgaatgacttcaagctggtgatcaacaagatcgcctatgatgtgcagtgccccaagcgggagaagcccagcaatgagcacacagctgagatggagcacatgaagagcctggtgcacaggctcttcaccatcctgcacctggaggagagccagaagaagcgggagcaccacctgctggagaagattgaccacctgaaggagcagctgcagcccctggagcaggtgaaggccggcatcgaggcccacagcgaggccaagaccagcggcctgctgtgggccggcctggccctgctgagcatccagggcggggccctggcctggctgacctggtgggtgtacagctgggacatcatggagcctgtgacctacttcatcacctttgccaacagcatggtgttctttgcctacttcatcgtgacccggcaggactacacctacagcgctgtgaagagccggcagttcctgcagttcttccacaagaagagcaagcagcagcactttgatgtgcagcagtacaacaagctgaaggaggacctggccaaggccaaggagagcctgaagcaggcccggcacagcctgtgcctgcagatgcaggtggaggagctgaatgagaagaactag

SEQ ID NO: 33576 - DNA, 1689 bp, Artificial Sequence
  Description of Artificial Sequence: Synthetic coding sequence
atggacctgcctgagggccctgtgggcggccccacagctgagatgtacctgcgggagaggcctgaggaggcccggctgggcatgcctgtgtccctggaggagcagatcctgaacagcacctttgaggcctgtgacccccagaggactggaacagtggccgtggcccaggtgctggcctacctggaggccgtgacaggccagggcccccaggatgcccggctgcagaccctggccaacagcctggaccccaacggggagggccccaaggccaccgtggacctggacaccttcctggtggtgatgagggactggattgctgcctgccagctgcatggaggcctggagctggaggaggagacagccttccagggcgccctgaccagccggcagctgcccagcggctgcccagaggccgaggagcccgccaacctggagagctttggaggagaggaccccaggcctgagctgcaggccacagctgacctgctgagcagcctggaggacctggagctgagcaacagaaggctggtgggagaaaatgccaagctgcagaggtccatggagacagctgaggagggcagcgcccggctgggggaggagatcctggccctgaggaagcagctgcacagcacccagcaggccctgcagtttgccaaggccatggatgaggagctggaggacctgaagaccctggcccggagcctggaggagcagaacagaagcctgctggcccaggcccggcaggccgagaaggagcagcagcacctggtggccgagatggagaccctgcaggaggagaatggcaagctgctggccgagagagatggagtgaagaagaggagccaggagctggccatggagaaggacaccctgaagaggcagctgtttgaatgtgagcacctgatctgccagagggacaccatcctgtctgagaggaccagagatgtggagagcctggcccagaccctggaggagtacagagtgaccacccaggagctgcggctggagatcagccggctggaggagcagctgagccagacctatgagggcccagatgagctgcctgagggcgcccagctgcggcgggtgggctggacagagctgctgccccccagcctgggcctggagattgaggccatccggcagaagcaggaggtggccacagctgacctgagcaaccccctgtgtggggtgtggcagtgggaggaggtgatccacgagaccagcgaggagacagagttccccagcgaggccccagctgggggccagaggaacttccagggcgagcccgcccaccctgaggagggcaggaaggagcccagcatgtggctgacccggcgggaggaggaggaggatgctgagagccaggtgacagctgacctgcctgtgcccctgggcgcccccaggcctggggacatcccagaaaatcctcctgagaggcctgcccggcgggagctgcagcaggccctggtgcctgtgatgaagaagctggtgcctgtgagaagaagagcctggggccagctgtgcctgcccccccagaggctgcgggtgaccaggcaccccctcatcccagcccctgtgctgggcctgctgctgctgctgctgctgtctgtgctgctgctgggccccagccccccacccacctggccccacctgcagctgtgctacctgcagcccccacctgtgtag

SEQ ID NO: 33577 - DNA, 357 bp, Artificial Sequence
  Description of Artificial Sequence: Synthetic coding sequence
atgaccaagaagaagcgggagaacctgggcgtggccctggagattgatggcctggaggagaagctgagccagtgccggcgggacctggaggccgtgaacagccggctgcacagccgggagctgagccctgaggcccgggagggcacagaggtgtcctctgcccgggagcctgaggagcacgccgccctgtgtggccacctgtaccccccagatgcccggctgtgcctgctggaccacgtgtccctggccctgccccacaaccagcaccggctgcccctgggccccctcatccgcatcaagcaggccctgcaggccagcatcggcccccgctgctggggcgtgcccctgcccacctag

SEQ ID NO: 33578 - DNA, 294 bp, Artificial Sequence
  Description of Artificial Sequence: Synthetic coding sequence
atgaccaagaagaagcgggagaacctgggcgtggccctggagattgatggcctggaggagaagctgagccagtgccggcgggacctggaggccgtgaacagccggctgcacagccgggagctgagccctgaggcccggcgcagcctggagaaggagaagaacagcctgatgaacaaggccagcaactatgagaaggagctgaagttcctgcggcaggagaacaggaagaacatgctgctgtctgtggccatcttcatcctgctgaccctggtgtatgcctactggaccatgtag

SEQ ID NO: 33579 - DNA, 345 bp, Artificial Sequence
  Description of Artificial Sequence: Synthetic coding sequence
atgaccaagaagaagcgggagaacctgggcgtggccctggagattgatggcctggaggagaagctgagccagtgccggcgggacctggaggccgtgaacagccggctgcacagccgggagctgagccctgaggcccgggagggcacagaggtgtcctctgcccgggagcctgaggagcacgccgccctgtgtggccacctgtaccccccagatgcccggctgtgcctgctggaccacgtgtccctggccctgccccacaaccagcaccggctgcccctgggccccctcatccgcatcaagcaggccctgcaggccagcatcggcccccgctgctggggcgtgtag

SEQ ID NO: 33580 - DNA, 753 bp, Artificial Sequence
  Description of Artificial Sequence: Synthetic coding sequence
atggctgctggcaccagcagctactgggaggacctgaggaagcaggcccggcagctggagaatgagctggacctgaagctggtgtccttcagcaagctgtgcaccagctacagccacagcagcaccagagatggccggcgggaccgctacagcagtgacaccacccccctgctgaatggcagcagccaggacaggatgtttgagaccatggccatcgagattgagcagctgctggcccggctgactggagtgaatgacaagatggccgagtacaccaacagcgctggggtgcccagcctgaatgctgccctgatgcacaccctgcagaggcaccgggacatcctgcaggactacacccatgagttccacaagaccaaggccaacttcatggccatccgggagcgggagaacctgatgggctctgtgaggaaggacatcgagagctacaagagcggcagcggcgtgaacaacagaagaacagagctgttcctgaaggagcatgaccacctgaggaacagcgaccggctgattgaggagaccatcagcatcgccatggccaccaaggagaacatgaccagccagaggggcatgctgaagagcatccacagcaagatgaacaccctggccaaccgcttccctgctgtgaacagcctcatccagaggatcaacctgaggaagagaagagacagcctcatcctgggcggcgtgattggcatctgcaccatcctgctgctgctgtatgccttccactag

SEQ ID NO: 33581 - DNA, 1452 bp, Artificial Sequence
  Description of Artificial Sequence: Synthetic coding sequence
atgaaggccttccacaccttctgtgtggtgctgctggtgtttggatctgtgtctgaggccaagtttgatgactttgaagatgaagaagatattgtggagtatgatgacaatgactttgctgagtttgaagatgtgatggaggacagcgtgacagagagcccccagagggtcatcatcacagaagatgatgaagatgagaccaccgtggagctggagggccaggatgagaaccaggagggggactttgaagatgctgacacccaggagggggacacagagagcgagccctatgatgatgaggagtttgagggctatgaggacaagccagacaccagcagcagcaagaacaaggaccccatcaccatcgtggatgtgcctgcccacctgcagaacagctgggagagctactacctggagatcctgatggtgacaggcctgctggcctacatcatgaactacatcatcggcaagaacaagaacagccggctggcccaggcctggttcaacacccaccgggagctgctggagagcaacttcaccctggtgggagatgatggcaccaacaaggaggccaccagcacaggcaagctgaaccaggagaatgagcacatctacaacctgtggtgcagcggccgggtgtgctgtgagggcatgctgatccagctgcgcttcctgaagaggcaggacctgctgaatgtgctggccaggatgatgaggcctgtgtctgaccaggtgcagatcaaggtgaccatgaatgatgaggacatggacacctacgtgtttgctgtgggcaccaggaaggccctggtgcggctgcagaaggagatgcaggacctgtctgagttctgcagcgacaagcccaagagcggggccaagtatggcctgcctgacagcctggccatcctgtctgagatgggagaggtgacagatggcatgatggacaccaagatggtgcacttcctgacccactatgctgacaagattgagagcgtgcacttcagtgaccagttcagcggccccaagatcatgcaggaggagggccagcccctgaagctgcctgacaccaagaggaccctgctcttcaccttcaacgtgcccggcagcggcaacacctaccccaaggacatggaggccctgctgcccctgatgaacatggtgatctacagcattgacaaggccaagaagttccggctgaaccgggagggcaagcagaaggctgacaagaacagagcccgggtggaggagaacttcctgaagctgacccacgtgcagaggcaggaggccgcccagagccggcgggaggagaagaagagagctgagaaggagcgcatcatgaatgaggaggaccctgagaagcagaggcggctggaggaggccgccctgcggcgggagcagaagaagctggagaagaagcagatgaagatgaagcagatcaaggtgaaggccatgtag

SEQ ID NO: 33582 - DNA, 1236 bp, Artificial Sequence
  Description of Artificial Sequence: Synthetic coding sequence
atgatgggccgcagccctggctttgccatgcagcacatcgtgggcgtgccccacgtgctggtgcggcggggcctgctgggccgggacctcttcatgaccaggaccctgtgcagccctggccccagccagcccggggagaagaggcctgaggaggtggccctgggcctgcaccaccggctgcctgccctgggccgggccctgggccacagcatccagcagagggccaccagcacagccaagacctggtgggacagatatgaggagtttgtgggcctgaatgaggtgcgggaggcccagggcaaggtgacagaagctgagaaggtgttcatggtggcccggggcctggtgcgggaggcccgggaggacctggaggtgcaccaggccaagctgaaggaggtgcgggaccggctggacagagtgtcccgggaggacagccagtacctggagctggccaccctggagcacaggatgctgcaggaggagaagaggctgaggacagcctacctgcgggcagaggacagcgagcgggagaagttcagcctcttctctgctgctgtgcgggagagccatgagaaggagaggaccagggctgagaggaccaagaactggagcctcatcggctctgtgctgggcgccctgattggagtggccggcagcacctacgtgaacagagtgcggctgcaggagctgaaggccctgctgctggaggcccagaagggccctgtgtccctgcaggaggccatccgggagcaggccagcagctacagccggcagcagagggacctgcacaacctgatggtggacctgcggggcctggtgcatgctgctggccctggccaggacagcggcagccaggccggcagcccccccacccgggacagagatgtggatgtgctgtctgctgccctgaaggagcagctgagccacagccggcaggtgcacagctgcctggagggcctgcgggagcagctggatggcctggagaagacctgcagccagatggccggcgtggtgcagctggtgaagtctgctgcccaccctggcctggtggagccagcagatggagccatgcccagcttcctgctggagcagggctccatgatcctggccctgagtgacacagagcagaggctggaggcccaggtgaacagaaacaccatctacagcaccctggtgacctgtgtgacctttgtggccaccctgcctgtgctgtacatgctgttcaaggccagctag

SEQ ID NO: 33583 - DNA, 1236 bp, Artificial Sequence; identical to SEQ ID NO: 33582
  Description of Artificial Sequence: Synthetic coding sequence

SEQ ID NO: 33584 - DNA, 909 bp, Artificial Sequence
  Description of Artificial Sequence: Synthetic coding sequence
atggtggcccggggcctggtgcgggaggcccgggaggacctggaggtgcaccaggccaagctgaaggaggtgcgggaccggctggacagagtgtcccgggaggacagccagtacctggagctggccaccctggagcacaggatgctgcaggaggagaagaggctgaggacagcctacctgcgggcagaagattctgagcgggagaagttcagcctcttctctgctgctgtgcgggagagccatgagaaggagaggaccagggctgagaggaccaagaactggagcctgattggctctgtgctgggcgccctgattggagtggccggcagcacctacgtgaacagagtgcggctgcaggagctgaaggccctgctgctggaggcccagaagggccctgtgtccctgcaggaggccatccgggagcaggccagcagctacagccggcagcagagggacctgcacaacctgatggtggacctgcggggcctggtgcacgccgccggccctggccaggacagcggcagccaggccggcagcccccccacccgggacagagatgtggatgtgctgtctgctgccctgaaggagcagctgagccacagccggcaggtgcacagctgcctggagggcctgcgggagcagctggatggcctggagaagacctgcagccagatggccggcgtggtgcagctggtgaagtctgctgcccaccctggcctggtggagccagcagatggagccatgcccagcttcctgctggagcagggctccatgatcctggccctgagtgacacagagcagaggctggaggcccaggtgaacagaaacaccatctacagcaccctggtgacctgtgtgacctttgtggccaccctgcctgtgctgtacatgctgttcaaggccagctag

SEQ ID NO: 33585 - DNA, 189 bp, Artificial Sequence
  Description of Artificial Sequence: Synthetic coding sequence
atgatgggccgcagccctggctttgccatgcagcacatcgtgggcgtgccccacgtgctggtgcggcggggcctgctgggccgggacctcttcatgaccaggaccctgtgcagccctggccccagccagcccggggagaagaggcctgaggaggtggccctgggcctgcaccaccggctgcctgcctag

SEQ ID NO: 33586 - DNA, 909 bp, Artificial Sequence; identical to SEQ ID NO: 33584
  Description of Artificial Sequence: Synthetic coding sequence

SEQ ID NO: 33587 - DNA, 480 bp, Artificial Sequence
  Description of Artificial Sequence: Synthetic coding sequence
atgatgggccgcagccctggctttgccatgcagcacatcgtgggcgtgccccacgtgctggtgcggcggggcctgctgggccgggacctcttcatgaccaggaccctgtgcagccctggccccagccagcccggggagaagaggcctgaggaggtggccctgggcctgcaccaccggctgcctgccctgggccgggccctgggccacagcatccagcagagggccaccagcacagccaagacctggtgggacagatatgaggagtttgtgggcctgaatgaggtgcgggaggcccagggcaaggtgacagaagctgagaaggtgttcatggtggcccggggcctggtgcgggaggcccgggaggacctggaggtgcaccaggccaagctgaaggaggtgcgggaccggctggacagagtgtcccgggaggacagccagtacctggagctggccaccctggagcacaggatgctgcagtag

SEQ ID NO: 33588 - DNA, 909 bp, Artificial Sequence; identical to SEQ ID NO: 33584
  Description of Artificial Sequence: Synthetic coding sequence

SEQ ID NO: 33589 - DNA, 321 bp, Artificial Sequence
  Description of Artificial Sequence: Synthetic coding sequence
atggccagcagcggggccggggaccccctggacagcaagagaggagaggccccctttgcccagagaattgaccccacccgggagaagctgaccccagagcagctgcacagcatgaggcaggccgagctggcccagtggcagaaggtgctgcccaggaggaggaccaggaacatcgtgacaggcctgggcatcggggccctggtgctggccatctacggctacaccttctacagcatcagccaggagcgcttcctggatgagctggaggatgaggccaaggccgcccgggcccgggccctggcccgggccagcggcagctag

SEQ ID NO: 33590 - DNA, 435 bp, Artificial Sequence
  Description of Artificial Sequence: Synthetic coding sequence
atggccgcccccagcggaggagtgaactgtgaggagtttgctgagttccaggagctgctgaaggtgatgaggaccattgatgaccgcatcgtgcatgagctgaacaccaccgtgcccacagccagctttgctgggaagattgatgccagccagacctgcaagcagctgtatgagagcctgatggccgcccacgccagccgggacagagtcatcaagaactgcatcgcccagaccagcgctgtggtgaagaacctgcgggaggagcgggagaagaacctggatgacctgaccctgctgaagcagctgaggaaggagcagaccaagctgaagtggatgcagagcgagctgaatgtggaggaggtggtgaatgaccgctcctggaaggtgttcaatgaacgctgccgcatccacttcaagccacccaagaatgaatag

SEQ ID NO: 33591 - DNA, 774 bp, Artificial Sequence
  Description of Artificial Sequence: Synthetic coding sequence
atggactgtggctctgtgggcggccagaggacccagaggctgcccggccggcagaggctgctcttcctgcctgtgggcctgagcggccggcctgggggcagcgagaccagcgcccggcgctgcctgagcgccctgagtgatggcctgggcgccctgcggccccgggccccagctgcccggggcggcgtgtcccgggccagccccctgctgctgctgctgctggtgcccagcccccggctggccgctgctgccccccggcggcagctgggggactgggagaggagccggctgggctacgccgcccccccagctggccgcagcagcgcctggcgctgcagccctggggtggccgctgctgctggggccctgccccagtaccacggccctgccccagccctggtgtcctgcagaagagagctgagcctgtctgctggcagcctgcagctggagaggaagagaagagacttcaccagcagcggcagcaggaagctgtactttgacacccacgccctggtgtgcctgctggaggacaatgaaagccacagcttcatccaggccggcgtgcagtggcacagcctgggcctgctgcagcccccacctcctggcttcaagaggagcagccacctgatcctgctgagctcctgggactacagacatgccccaccccacctggacaacttcagcgtcttcctgctggagaccggcttccaccacgtgggccaggccggcctgaagctgctgaccagcagtgacccccccaccctggccagctag

SEQ ID NO: 33592 - DNA, 1080 bp, Artificial Sequence
  Description of Artificial Sequence: Synthetic coding sequence
atggactgtggctctgtgggcggccagaggacccagaggctgcccggccggcagaggctgctcttcctgcctgtgggcctgagcggccggcctgggggcagcgagaccagcgcccggcgctgcctgagcgccctgagtgatggcctgggcgccctgcggccccgggccccagctgcccggggcggcgtgtcccgggccagccccctgctgctgctgctgctggtgcccagcccccggctggccgctgctgccccccggcggcagctgggggactgggagaggagccggctgggctacgccgcccccccagctggccgcagcagcgcctggcgctgcagccctggggtggccgctgctgctggggccctgccccagtaccacggccctgccccagccctggtgtcctgcagaagagagctgagcctgtctgctggcagcctgcagctggagaggaagagaagagacttcaccagcagcggcagcaggaagctgtactttgacacccacgccctggtgtgcctgctggaggacaatggatttgccacccagcaggccgagatcatcgtgtctgccctggtgaagatcctggaggccaacatggacatcgtgtacaaggacatggtgaccaagatgcagcaggagatcaccttccagcaggtgatgagccagatcgccaacgtgaagaaggacatgatcatcctggagaagtctgagttcagcgccctgcgggcagaaaatgagaagatcaagctggagctgcaccagctgaagcagcaggtgatggatgaggtgatcaaggtgaggacagacaccaagctggacttcaacctggagaagagccgggtgaaggagctgtacagcctgaatgagaagaagctgctggagctgaggacagagatcgtggccctgcacgcccagcaggaccgggccctgacccagacagacaggaagattgaaacagaggtggccggcctgaagaccatgctggagagccacaagctggacaacatcaagtacctggccggcagcatcttcacctgcctgactgtggccctgggcttctaccgcctgtggatctag

SEQ ID NO: 33593 - DNA, 738 bp, Artificial Sequence
  Description of Artificial Sequence: Synthetic coding sequence
atgctggccaactgtggctctgtgtgtgaggagacccagttccggggcaccaccgtggccccagccctgggggagttcttcaccaccaccaccaaggagggctatgacagaagacctgtggacatcacccccctggagcagaggaagctgacctttgacacccacgccctggtgcaggacctggagacccacggctttgacaagacccaggccgagaccatcgtgtctgccctgacagccctgagcaatgtgtccctggacaccatctacaaggagatggtgacccaggcccagcaggagatcaccgtgcagcagctgatggcccacctggatgccatcaggaaggacatggtgatcctggagaagtcagaatttgccaacctgcgggcagaaaatgagaagatgaagattgagctggaccaggtgaagcagcagctgatgcatgagaccagccgcatccgggctgacaacaagctggacatcaacctggagaggagccgggtgacagacatgttcacagaccaggagaagcagctgatggagaccaccacagagttcaccaagaaggacacccagaccaagagcatcatcagcgagaccagcaacaagattgatgctgagatcgccagcctgaagaccctgatggagagcaacaagctggagaccatccgctacctggccgcctctgtgttcacctgcctggccatcgccctgggcttctaccgcttctggaagtag

SEQ ID NO: 33594 - DNA, 462 bp, Artificial Sequence
  Description of Artificial Sequence: Synthetic coding sequence
atggtgacccaggcccagcaggagatcaccgtgcagcagctgatggcccacctggatgccatcaggaaggacatggtgatcctggagaagtcagaatttgccaacctgcgggcagaaaatgagaagatgaagattgagctggaccaggtgaagcagcagctgatgcatgagaccagccgcatccgggctgacaacaagctggacatcaacctggagaggagccgggtgacagacatgttcacagaccaggagaagcagctgatggagaccaccacagagttcaccaagaaggacacccagaccaagagcatcatcagcgagaccagcaacaagattgatgctgagatcgccagcctgaagaccctgatggagagcaacaagctggagaccatccgctacctggccgcctctgtgttcacctgcctggccatcgccctgggcttctaccgcttctggaagtag

SEQ ID NO: 33595 - DNA, 462 bp, Artificial Sequence; identical to SEQ ID NO: 33594
  Description of Artificial Sequence: Synthetic coding sequence

SEQ ID NO: 33596 - DNA, 765 bp, Artificial Sequence
  Description of Artificial Sequence: Synthetic coding sequence
atgaacagccggcaggcctggaggctcttcctgagccagggccgcggggaccgctgggtgtcccggccccggggccacttctccccagccctgcggcgggagttcttcaccaccaccaccaaggagggctatgaccggcggcctgtggacatcacccccctggagcagaggaagctgacctttgacacccacgccctggtgcaggacctggagacccacggctttgacaagacccaggccgagaccatcgtgtctgccctgacagccctgagcaatgtgtccctggacaccatctacaaggagatggtgacccaggcccagcaggagatcaccgtgcagcagctgatggcccacctggatgccatcaggaaggacatggtgatcctggagaagtcagaatttgccaacctgcgggcagaaaatgagaagatgaagattgagctggaccaggtgaagcagcagctgatgcatgagaccagccgcatccgggctgacaacaagctggacatcaacctggagaggagccgggtgacagacatgttcacagaccaggagaagcagctgatggagaccaccacagagttcaccaagaaggacacccagaccaagagcatcatcagcgagaccagcaacaagattgatgctgagatcgccagcctgaagaccctgatggagagcaacaagctggagaccatccgctacctggccgccagcgtcttcacctgcctggccatcgccctgggcttctaccgcttctggaagtag

SEQ ID NO: 33597 - DNA, 1236 bp, Artificial Sequence
  Description of Artificial Sequence: Synthetic coding sequence
atgcccatgtggaacaaggtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatccccaaggcccagatccagcagagcacccacacccacctggacatcagcctcttccccctgggcctgacagatgagaagagcaatggcaccatcgccctggtggatgacagtgaagatcctggggccaacgtgagcaacatccagctgcagcagaagatcagcagcctggagatcaagctgaaggtgtctgaggaggagaagcagaggatcaagcaggatgtggagagcctgatggagaagcacaacgtgctggagaagggcttcctgaaggagaaggagcaggaggccatctccttccaggaccgctacaaggagctgcaggagaagcacaagcaggagctggaggacatgaggaaggccggccacgaggccctgagcatcatcgtggatgagtacaaggccctgctgcagagctctgtgaagcagcaggtggaggccatcgagaagcagtacatcagcgccatcgagaagcaggcccacaagtgtgaggagctgctgaatgcccagcaccagaggctgctggagatgctggacacagagaaggagctgctgaaggagaagatcaaggaggccctgatccagcagagccaggagcagaaggagatcctggagaagtgcctggaggaggagcggcagaggaacaaggaggccctggtgtctgctgccaagctggagaaggaggccgtgaaggatgctgtgctgaaggtggtggaggaggagaggaagaacctggagaaggcccacgccgaggagcgggagctgtggaagacagagcacgccaaggaccaggagaaggtgtcccaggagatccagaaggccatccaggagcagaggaagatcagccaggagaccgtgaaggccgccatcatcgaggagcagaagaggtctgagaaggctgtggaggaggccgtgaagaggaccagagatgagctgattgagtacatcaaggagcagaagaggctggaccaggtgatccggcagaggagcctgagcagcctggagctgttcctgagctgtgcccagaagcagctgagcgccctgattgccacagagcctgtggacatcgagtag

SEQ ID NO: 33598 - DNA, 1218 bp, Artificial Sequence
  Description of Artificial Sequence: Synthetic coding sequence
atggatgatgatgactttggaggctttgaagctgctgagacctttgatggcggcagcggggagacccagaccaccagccctgccatcccctgggccgccttccctgctgtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatccccaaggcccagatccagcagagcacccacacccacctggacatcagcctcttccccctgggcctgacagatgagaagagcaatggcaccatcgccctggtggatgacagtgaagatcctggggccaacgtgagcaacatccagctgcagcagaagatcagcagcctggagatcaagctgaaggtgtctgaggaggagaagcagaggatcaagcaggatgtggagagcctgatggagaagcacaacgtgctggagaagggcttcctgaaggagaaggagcaggaggccatctccttccaggaccgctacaaggagctgcaggagaagcacaagcaggagctggaggacatgaggaaggccggccacgaggccctgagcatcatcgtggatgagtacaagcaccagaggctgctggagatgctggacacagagaaggagctgctgaaggagaagatcaaggaggccctgatccagcagagccaggagcagaaggagatcctggagaagtgcctggaggaggagcggcagaggaacaaggaggccctggtgtctgctgccaagctggagaaggaggccgtgaaggatgctgtgctgaaggtggtggaggaggagaggaagaacctggagaaggcccacgccgaggagcgggagctgtggaagacagagcacgccaaggaccaggagaaggtgtcccaggagatccagaaggccatccaggagcagaggaagatcagccaggagaccgtgaaggccgccatcatcgaggagcagaagaggtctgagaaggctgtggaggaggccgtgaagaggaccagagatgagctgattgagtacatcaaggagcagaagaggctggaccaggtgatccggcagaggagcctgagcagcctggagctgttcctgagctgtgcccagaagcagctgagcgccctgattgccacagagcctgtggacatcgagtag

SEQ ID NO: 33599 - DNA, 1326 bp, Artificial Sequence
  Description of Artificial Sequence: Synthetic coding sequence
atggatgatgatgactttggaggctttgaagctgctgagacctttgatggcggcagcggggagacccagaccaccagccctgccatcccctgggccgccttccctgctgtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatccccaaggcccagatccagcagagcacccacacccacctggacatcagcctcttccccctgggcctgacagatgagaagagcaatggcaccatcgccctggtggatgacagtgaagatcctggggccaacgtgagcaacatccagctgcagcagaagatcagcagcctggagatcaagctgaaggtgtctgaggaggagaagcagaggatcaagcaggatgtggagagcctgatggagaagcacaacgtgctggagaagggcttcctgaaggagaaggagcaggaggccatctccttccaggaccgctacaaggagctgcaggagaagcacaagcaggagctggaggacatgaggaaggccggccacgaggccctgagcatcatcgtggatgagtacaaggccctgctgcagagctctgtgaagcagcaggtggaggccatcgagaagcagtacatcagcgccatcgagaagcaggcccacaagtgtgaggagctgctgaatgcccagcaccagaggctgctggagatgctggacacagagaaggagctgctgaaggagaagatcaaggaggccctgatccagcagagccaggagcagaaggagatcctggagaagtgcctggaggaggagcggcagaggaacaaggaggccctggtgtctgctgccaagctggagaaggaggccgtgaaggatgctgtgctgaaggtggtggaggaggagaggaagaacctggagaaggcccacgccgaggagcgggagctgtggaagacagagcacgccaaggaccaggagaaggtgtcccaggagatccagaaggccatccaggagcagaggaagatcagccaggagaccgtgaaggccgccatcatcgaggagcagaagaggtctgagaaggctgtggaggaggccgtgaagaggaccagagatgagctgattgagtacatcaaggagcagaagaggctggaccaggtgatccggcagaggagcctgagcagcctggagctgttcctgagctgtgcccagaagcagctgagcgccctgattgccacagagcctgtggacatcgagtag

SEQ ID NO: 33600 - DNA, 1086 bp, Artificial Sequence
  Description of Artificial Sequence: Synthetic coding sequence
atggatgatgatgactttggaggctttgaagctgctgagacctttgatggcggcagcggggagacccagaccaccagccctgccatcccctgggccgccttccctgctgtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatccccaaggcccagatccagcagagcacccacacccacctggacatcagcctcttccccctgggcctgacagatgagaagagcaatggcaccatcgccctggtggatgacagtgaagatcctggggccaacgtgagcaacatccagctgcagcagaagatcagcagcctggagatcaagctgaaggtgtctgaggaggagaagcagaggatcaagcaggatgtggagagcctgatggagaagcacaacgtgctggagaagggcttcctgaaggagaaggagcaggaggccatctccttccaggaccgctacaaggagctgcaggagaagcacaagcaggagctggaggacatgaggaaggccggccacgaggccctgagcatcatcgtggatgagtacaaggccctgctgcagagctctgtgaagcagcaggtggaggccatcgagaagcagtacatcagcgccatcgagaagcaggcccacaagtgtgaggagctgctgaatgcccagcaccagaggctgctggagatgctggacacagagaaggagctgctgaaggagaagatcaaggaggccctgatccagcagagccaggagcagaaggagatcctggagaagtgcctggaggaggagcggcagaggaacaaggaggccctggtgtctgctgccaagctggagaaggaggccgtgaaggatgctgtgctgaaggtggtggaggaggagaggaagaacctggagaaggcccacgccgaggagcgggagctgtggaagacagagcacgccaaggaccaggagaaggtgtcccaggagatccagaaggccatccaggagtag

SEQ ID NO: 33601 - DNA, 258 bp, Artificial Sequence
  Description of Artificial Sequence: Synthetic coding sequence
atggatgatgatgactttggaggctttgaagctgctgagacctttgatggcggcagcggggagacccagaccaccagccctgccatcccctgggccgccttccctgctgtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatctag

SEQ ID NO: 33602 - DNA, 1218 bp, Artificial Sequence; identical to SEQ ID NO: 33598
  Description of Artificial Sequence: Synthetic coding sequence

SEQ ID NO: 33603 - DNA, 276 bp, Artificial Sequence
  Description of Artificial Sequence: Synthetic coding sequence
atggatgatgatgactttggaggctttgaagctgctgagacctttgatggcggcagcggggagacccagaccaccagccctgccatcccctgggccgccttccctgctgtgtctggagtgcacctgagccccagcagccctgagatcgtgctggaccgggaccacagcagcagcatcggctgcctgagcagtgatgccatcatcagcagccctgagaacacccacgccgccaacagcatcgtgtcccagaccatccccaaggcccagatccagtag

SEQ ID NO: 33604 - DNA, 1326 bp, Artificial Sequence; identical to SEQ ID NO: 33599
  Description of Artificial Sequence: Synthetic coding sequence

SEQ ID NO: 33605 - DNA, 357 bp, Artificial Sequence
  Description of Artificial Sequence: Synthetic coding sequence
atggccacccccagcctgcggggccgcctggccaggtttggaaaccccaggaagcctgtgctgaagcccaacaagcccctcatcctggccaacagagtgggggagaggagaagagagaagggggaggccacctgcatcacagagatgtctgtgatgatggcctgctggaagcagaatgagttcagagatgatgcctgcaggaaggagatccagggcttcctggactgtgccgcccgggcccaggaggccaggaagatgaggagcatccaggagaccctgggggagagcggcagcctgctgcccaacaagctgaacaagctgctgcagcgcttccccaacaagccctacctgtcctag

SEQ ID NO: 33606 - DNA, 294 bp, Artificial Sequence
  Description of Artificial Sequence: Synthetic coding sequence
atggccacccccagcctgcggggccgcctggccaggtttggaaaccccaggaagcctgtgctgaagcccaacaagcccctcatcctggccaacagagtgggggagaggagaagagagaagggggaggccacctgcatcacagagatgtctgtgatgatggcctgctggaagcagaatgagttcagagatgatgcctgcaggaaggagatccagggcttcctggactgtgccgcccgggcccaggtgacagatggctcctggggcgccttcagcggcaaggagtggggccgctag

SEQ ID NO: 33607 - DNA, 429 bp, Artificial Sequence
  Description of Artificial Sequence: Synthetic coding sequence
atgccccggggcagccgctctgctgccagcaggcctgccagcaggcctgctgcccccagcgcccaccccccagcccaccccccacccagcgctgctgccccagccccagcccccagcggccagcccggcctgatggcccagatggccaccacagctgctggggtggccgtgggcagcgctgtgggccacgtgatgggcagcgccctgaccggggccttcagcggcggcagcagcgagcccagccagcctgctgtgcagcaggcccccaccccagctgccccccagcccctgcagatgggcccctgtgcctatgagatccggcagttcctggactgcagcaccacccagagcgacctgagcctgtgtgagggcttcagcgaggccctgaagcagtgcaagtactaccacggcctgagcagcctgccctag

SEQ ID NO: 33608 - DNA, 456 bp, Artificial Sequence
  Description of Artificial Sequence: Synthetic coding sequence
atgccccggggcagccgcagcaggaccagcaggatggcccccccagccagccgggccccccagatgagagctgcccccaggcctgcccctgtggcccagcccccagctgctgcccctccttctgctgtgggcagcagcgctgctgccccccggcagcccggcctgatggcccagatggccaccacagctgctggggtggccgtgggcagcgctgtgggccacaccctgggccacgccatcactggaggcttcagcggcggcagcaatgctgagcccgcccggccagacatcacctaccaggagccccagggcacccagcctgcccagcagcagcagccctgcctgtatgagatcaagcagttcctggagtgtgcccagaaccagggcgacatcaagctgtgtgagggcttcaatgaggtgctgaagcagtgccgcctggccaacggcctggcctag

SEQ ID NO: 33609 - DNA, 468 bp, Artificial Sequence
  Description of Artificial Sequence: Synthetic coding sequence
atgcctgtgtcctacagctctgtgaccacccgctactaccaccgggccggggctgaggagggcaaggaccgcatcatctttgtgaccaaggaggaccacgagacccccagcagcgctgagctggtggctgatgaccccaatgacccctatgaggagcacggcctcatcctgcccaatggaaacatcaactggaactgcccctgcctgggcggcatggccagcggcccctgtggggagcagttcaagagcgccttcagctgcttccactacagcacagaggagatcaagggcagtgactgtgtggaccagttccgggccatgcaggagtgcatgcagaagtacccagacctgtacccccaggaggatgaagatgaggaggaggagcgggagaagaagccagctgagcaggccgaggagacagcccccatcgaggccacagccaccaaggaggaggagggcagcagctag

SEQ ID NO: 33610 - DNA, 429 bp, Artificial Sequence
  Description of Artificial Sequence: Synthetic coding sequence
atgagctactgccggcaggagggcaaggaccgcatcatctttgtgaccaaggaggaccacgagacccccagcagcgctgagctggtggctgatgaccccaatgacccctatgaggagcacggcctcatcctgcccaacggcaacatcaactggaactgcccctgcctgggcggcatggccagcggcccctgtggggagcagttcaagagcgccttcagctgcttccactacagcacagaggagatcaagggcagtgactgtgtggaccagttccgggccatgcaggagtgcatgcagaagtacccagacctgtacccccaggaggatgaagatgaggaggaggagcgggagaagaagccagctgagcaggccgaggagacagcccccatcgaggccacagccaccaaggaggaggagggcagcagctag

SEQ ID NO: 33611 - DNA, 1449 bp, Artificial Sequence
  Description of Artificial Sequence: Synthetic coding sequence
atggccagcttctctgctgagaccaacagcacagacctgctgagccagccctggaatgaacctcctgtgatcctgtccatggtgatcctgagcctgaccttcctgctgggcctgcctggaaatggcctggtgctgtgggtggccggcctgaagatgcagaggacagtgaacaccatctggttcctgcacctgaccctggccgacctgctgtgctgcctgagcctgcccttcagcctggcccacctggccctgcagggccagtggccctacggccgcttcctgtgcaagctgatccccagcatcatcgtgctgaacatgtttgcctctgtgttcctgctgacagccatcagcctggaccgctgcctggtggtgttcaagcccatctggtgccagaaccacagaaatgtgggcatggcctgcagcatctgtggctgcatctgggtggtggcctttgtgatgtgcatccctgtgtttgtgtaccgggagatcttcaccacagacaaccacaacagatgtggctacaagtttggcctgagcagcagcctggactacccagacttctacggggaccccctggagaacagaagcctggagaacatcgtgcagcccccaggagagatgaatgaccggctggaccccagcagcttccagaccaatgaccacccctggacagtgcccaccgtcttccagccccagaccttccagaggcccagcgctgacagcctgccccggggcagcgcccggctgaccagccagaacctgtacagcaatgtgttcaagccagcagatgtggtgagccccaagatccccagcggcttccccatcgaggaccacgagaccagccccctggacaacagtgatgccttcctgagcacccacctgaagctgttccccagcgccagcagcaacagcttctatgagagcgagctgccccagggcttccaggactactacaacctgggccagttcacagatgatgaccaggtgcccacccccctggtggccatcaccatcacccggctggtggtgggcttcctgctgcccagcgtcatcatgattgcctgctacagcttcatcgtgttcaggatgcagaggggccgctttgccaagagccagagcaagaccttccgggtggccgtggtggtggtggccgtgttcctggtgtgctggaccccctaccacatcttcggcgtgctgagcctgctgacagatcctgagacccccctgggcaagaccctgatgtcctgggaccacgtgtgcatcgccctggccagcgccaacagctgcttcaaccccttcctgtatgccctgctgggcaaggacttcaggaagaaggcccggcagagcatccagggcatcctggaggccgccttcagcgaggagctgaccaggagcacccactgccccagcaacaacgtcatcagcgagaggaacagcaccaccgtgtag

SEQ ID NO: 33612 - DNA, 441 bp, Artificial Sequence
  Description of Artificial Sequence: Synthetic coding sequence
atggccagcttctctgctgagaccaacagcacagacctgctgagccagccctggaatgaacctcctgtgatcctgtccatggtgatcctgagcctgaccttcctgctgggcctgcctggaaatggcctggtgctgtgggtggccggcctgaagatgcagaggacagtgaacaccatctggttcctgcacctgaccctggccgacctgctgtgctgcctgagcctgcccttcagcctggcccacctggccctgcagggccagtggccctacggccgcttcctgtgcaagctgatccccagcatcatcgtgctgaacatgtttgcctctgtgttcctgctgacagccatcagcctggaccgctgcctggtggtgttcaagcccatctggtgccagaaccacagaaatgtgggcatggcctgcagcatctgtggctgcatctag

SEQ ID NO: 33613 - DNA, 1053 bp, Artificial Sequence
  Description of Artificial Sequence: Synthetic coding sequence
atggacagcttcaactacaccaccccagactatggccactatgatgacaaggacaccctggacctgaacacccctgtggacaagaccagcaacaccctgcgggtgcctgacatcctggccctggtgatctttgctgtggtgttcctggtgggcgtgctgggcaatgccctggtggtgtgggtgacagcctttgaggccaagaggaccatcaatgccatctggttcctgaacctggccgtggccgacttcctgagctgcctggccctgcccatcctcttcaccagcatcgtgcagcaccaccactggccctttggaggagctgcctgcagcatcctgcccagcctcatcctgctgaacatgtatgccagcatcctgctgctggccaccatctctgctgaccgcttcctgctggtgttcaagcccatctggtgccagaacttccggggggccggcctggcctggatcgcctgtgctgtggcctggggcctggccctgctgctgaccatccccagcttcctgtacagagtggtgcgggaggagtacttcccccccaaggtgctgtgtggggtggactacagccatgacaagagaagagaaagagctgtggccatcgtgcggctggtgctgggcttcctgtggcccctgctgaccctgaccatctgctacaccttcatcctgctgcggacctggagccggcgggccaccaggagcaccaagaccctgaaggtggtggtggccgtggtggccagcttcttcatcttctggctgccctaccaggtgacaggcatcatgatgtccttcctggagcccagcagccccaccttcctgctgctgaagaagctggacagcctgtgtgtgtcctttgcctacatcaactgctgcatcaaccccatcatctacgtggtggccggccagggcttccagggccgcctgaggaagagcctgcccagcctgctgagaaatgtgctgacagaggagagcgtggtgcgggagagcaagagcttcaccaggagcacagtggacaccatggcccagaagacccaggccgtgtag

SEQ ID NO: 33614 - DNA, 477 bp, Artificial Sequence
  Description of Artificial Sequence: Synthetic coding sequence
atggccttcatggtgaagaccatggtgggcggccagctgaagaacctgaccggcagcctgggcggcggggaggacaagggagatggagacaagtctgctgctgaggcccagggcatgagccgggaggagtatgaggagtaccagaagcagctggtggaggagaagatggagagagatgcccagttcacccagaggaaggccgagcgggccaccctgcggagccacttccgggacaagtaccgcctgcccaagaatgaaacagatgagagccagatccagatggctggaggagatgtggagctgccccgggagctggccaagatgattgaggaggacacagaggaggaggaggagaaggcctctgtgctgggccagctggccagcctgcccggcctgaacctgggcagcctgaaggacaaggcccaggccaccctgggggacctgaagcagagcgctgagaagtgccacgtgatgtag

SEQ ID NO: 33615 - DNA, 2142 bp, Artificial Sequence
  Description of Artificial Sequence: Synthetic coding sequence
atggagcctgtggagacctggaccccaggcaaggtggccacctggctgcggggcctggatgacagcctgcaggactacccctttgaggactggcagctgcccgggaagaacctgctgcagctgtgcccccagagcctggaggccctggccgtgcgcagcctgggccaccaggagctgatcctgggcggcgtggagcagctgcaggccctgagcagccggctgcagacagagaacctgcagagcctgacagagggcctgctgggcgccacccatgacttccagagcatcgtgcagggctgcctgggggactgtgccaagacccccattgatgtgctgtgtgccgctgtggagctgctgcacgaggctgatgccctgctcttctggctgagccgctacctgttcagccacctgaatgacttcagcgcctgccaggagatccgggacctgctggaggagctgagccaggtgctgcatgaagatggccctgctgctgagaaggagggcaccgtgctgcgcatctgcagccacgtggccggcatctgccacaacatcctggtgtgctgccccaaggagctgctggagcagaaggctgtgctggagcaggtgcagctggacagccccctgggcctggagatccacaccaccagcaactgccagcactttgtgtcccaggtggacacccaggtgcccacagacagccggctgcagatccagcctggagatgaggtggtgcagatcaatgagcaggtggtggtgggctggcccaggaagaacatggtgcgggagctgctgcgggagcccgccggcctgagcctggtgctgaagaagatccccatccctgagaccccaccccagaccccaccccaggtgctggacagcccccaccagaggagccccagcctgagcctggcccccctgagcccccgggcccccagtgaagatgtgtttgcctttgacctgagcagcaaccccagccctggccccagccctgcctggacagattctgccagcctgggccctgagcccctgcccatccccccagagcccccagccatcctgcctgctggggtggccggcaccccaggcctgcctgagagcccagacaagagccctgtgggcaggaagaagagcaagggcctggccacccggctgagcagaagaagagtgtcctgccgggagctgggccgcccagactgtgatggctggctgctgctgaggaaggcccctgggggcttcatgggcccccgctggaggcggcgctggtttgtgctgaagggccacaccctgtactggtaccggcagccccaggatgagaaggccgagggcctcatcaacgtgagcaactacagcctggagagcggccatgaccagaagaagaagtatgtgttccagctgacccatgatgtgtacaagcccttcatctttgctgctgacaccctgacagacctgtccatgtgggtgcgccacctgatcacctgcatcagcaagtaccagagccctggccgggcccccccaccccgggaggaggactgctacagcgagacagaagctgaggaccctgatgatgaggccggcagccacagcgccagccccagccctgcccaggccggcagccccctgcatggagacaccagccctgctgccacccccacccagaggagccccaggaccagctttggcagcctgacagacagcagcgaggaggccctggagggcatggtgcggggcctgcggcagggcggcgtgtccctgctgggccagccccagcccctgacccaggagcagtggaggagcagcttcatgagaagaaacagagacccccagctgaatgaaagagtgcaccgggtgcgggccctgcagagcaccctgaaggccaagctgcaggagctgcaggtgctggaggaggtgctgggggaccctgagctgactggagagaagttccggcagtggaaggagcagaaccgggagctgtacagcgagggcctgggcgcctggggcgtggcccaggccgagggcagcagccacatcctgaccagtgacagcacagagcagagcccccacagcctgcccagcgaccctgaggagcacagccacctgtgccccctgaccagcgagagcagcctgcggcccccagacctgtag

SEQ ID NO: 33616 - DNA, 2163 bp, Artificial Sequence
  Description of Artificial Sequence: Synthetic coding sequence
atggagcctgtggagacctggaccccaggcaaggtggccacctggctgcggggcctggatgacagcctgcaggactacccctttgaggactggcagctgcccgggaagaacctgctgcagctgtgcccccagagcctggaggccctggccgtgcgcagcctgggccaccaggagctgatcctgggcggcgtggagcagctgcaggccctgagcagccggctgcagacagagaacctgcagagcctgacagagggcctgctgggcgccacccatgacttccagagcatcgtgcagggctgcctgggggactgtgccaagacccccattgatgtgctgtgtgccgctgtggagctgctgcacgaggctgatgccctgctcttctggctgagccgctacctgttcagccacctgaatgacttcagcgcctgccaggagatccgggacctgctggaggagctgagccaggtgctgcatgaagatggccctgctgctgagaaggagggcaccgtgctgcgcatctgcagccacgtggccggcatctgccacaacatcctggtgtgctgccccaaggagctgctggagcagaaggctgtgctggagcaggtgcagctggacagccccctgggcctggagatccacaccaccagcaactgccagcactttgtgtcccaggtggacacccaggtgcccacagacagccggctgcagatccagcctggagatgaggtggtgcagatcaatgagcaggtggtggtgcgggaggagcgggacatggtgggctggcccaggaagaacatggtgcgggagctgctgcgggagcctgctggcctgagcctggtgctgaagaagatccccatccctgagaccccaccccagaccccaccccaggtgctggacagcccccaccagaggagccccagcctgagcctggcccccctgagcccccgggcccccagtgaagatgtgtttgcctttgacctgagcagcaaccccagccctggccccagccctgcctggacagacagcgccagcctgggccctgagcccctgcccatccccccagagcccccagccatcctgcctgctggggtggccggcaccccaggcctgcctgagagcccagacaagagccctgtgggcaggaagaagagcaagggcctggccacccggctgagcagaagaagagtgtcctgccgggagctgggccgcccagactgtgatggctggctgctgctgaggaaggcccctgggggcttcatgggcccccgctggaggcggcgctggtttgtgctgaagggccacaccctgtactggtaccggcagccccaggatgagaaggccgagggcctcatcaacgtgagcaactacagcctggagagcggccatgaccagaagaagaagtatgtgttccagctgacccatgatgtgtacaagcccttcatctttgctgctgacaccctgacagacctgtccatgtgggtgcgccacctgatcacctgcatcagcaagtaccagagccctggccgggcccccccaccccgggaggaggactgctacagcgagacagaagcagaagatcctgatgatgaagctggcagccacagcgccagccccagccctgcccaggccggcagccccctgcacggggacaccagccctgctgccacccccacccagaggagccccaggaccagctttggcagcctgacagacagcagcgaggaggccctggagggcatggtgcggggcctgcggcagggcggcgtgtccctgctgggccagccccagcccctgacccaggagcagtggaggagcagcttcatgagaagaaacagagacccccagctgaatgaaagagtgcaccgggtgcgggccctgcagagcaccctgaaggccaagctgcaggagctgcaggtgctggaggaggtgctgggggaccctgagctgaccggggagaagttccggcagtggaaggagcagaaccgggagctgtacagcgagggcctgggcgcctggggcgtggcccaggccgagggcagcagccacatcctgaccagtgacagcacagagcagagcccccacagcctgcccagcgaccctgaggagcacagccacctgtgccccctgaccagcgagagcagcctgcggcccccagacctgtag

SEQ ID NO: 33617 - DNA, 936 bp, Artificial Sequence
  Description of Artificial Sequence: Synthetic coding sequence
atggagcctgtggagacctggaccccaggcaaggtggccacctggctgcggggcctggatgacagcctgcaggactacccctttgaggactggcagctgcccgggaagaacctgctgcagctgtgcccccagagcctggaggccctggccgtgcgcagcctgggccaccaggagctgatcctgggcggcgtggagcagctgcaggccctgagcagccggctgcagacagagaacctgcagagcctgacagagggcctgctgggcgccacccatgacttccagagcatcgtgcagggctgcctgggggactgtgccaagacccccattgatgtgctgtgtgccgctgtggagctgctgcacgaggctgatgccctgctcttctggctgagccgctacctgttcagccacctgaatgacttcagcgcctgccaggagatccgggacctgctggaggagctgagccaggtgctgcacgaggacctgcagccccggggctgggacctgccccagcaccctggcctgctgccccagggcgccgccggcacagagggccgggcccgggccggggctgctggccagagcatcggccccaggaacagccaccaccacccccacacctgcctgcagaccccacccaacagacacctgcccctgctgcggccccccagcagcctgcagaccccaccccaggtgcctgccccagctgcccccctgcccctgctgccccccaacctgctgagtgacccctgcctgcactgctttgtgcccggctgcagcccagatgcccccagcggccctggcctgcctgcccctgaggagcccatcaccgtgtctggccccaccgtgtcccaggtgacaggctctgtgcaggtgtgcctgggcggggagaccgtgggcagcagccaccccccctgccccccccagggccccatctag

SEQ ID NO: 33618 - DNA, 4155 bp, Artificial Sequence
  Description of Artificial Sequence: Synthetic coding sequence
atgatgcacctgcggctcttctgcatcctgctggccgctgtgtctggagctgagggctggggctactacggctgtgatgaggagctggtgggccccctgtatgcccggagcctgggcgccagcagctactacagcctgctgacagcccccaggtttgcccggctgcacggcatcagcggctggagccccagaattggagaccccaacccctggctgcagattgacctgatgaagaagcaccgcatccgggctgtggccacccagggcagcttcaacagctgggactgggtgacccgctacatgctgctgtatggagacagagtggacagctggacccccttctaccagaggggccacaacagcaccttctttggaaatgtgaatgaatctgctgtggtgagacatgacctgcacttccacttcaccgcccgctacatccgcatcgtgcccctggcctggaacccccggggcaagattggcctgcggctgggcctgtatggctgcccctacaaggctgacatcctgtactttgatggagatgatgccatctcctaccgcttcccccggggcgtgagccgcagcctgtgggatgtgtttgccttctccttcaagacagaggagaaggatggcctgctgctgcatgctgagggcgcccagggcgactatgtgaccctggagctggagggcgcccacctgctgctgcacatgagcctgggcagcagccccatccagcccaggcctggccacaccaccgtgtctgctgggggcgtgctgaatgaccagcactggcactacgtgcgggtggacagatttggaagagatgtgaacttcaccctggatggctacgtgcagcgcttcatcctgaatggagactttgagcggctgaacctggacacagagatgtttattggaggcctggtgggcgccgccaggaagaacctggcctaccgccacaacttccggggctgcattgaaaatgtcatcttcaacagagtgaacattgctgacctggccgtgcggcggcacagccgcatcacctttgagggcaaggtggccttccgctgcctggaccctgtgccccaccccatcaactttggaggcccccacaactttgtgcaggtgcccggcttcccccggcggggccgcctggccgtgtccttccgcttccgcacctgggacctgaccggcctgctgctcttcagccggctgggagatggcctgggccacgtggagctgaccctgtctgagggccaggtgaatgtgtccatcgcccagagcggcaggaagaagctgcagtttgctgctggctaccgcctgaatgatggcttctggcatgaggtgaactttgtggcccaggagaaccacgccgtcatcagcattgatgatgtggagggcgctgaggtgcgggtgtcctaccccctgctgatcagaacaggcaccagctacttcttcggcggctgccccaagccagccagccgctgggactgccacagcaaccagacagccttccacggctgcatggagctgctgaaggtggatggccagctggtgaacctgaccctggtggagggccgccgcctgggcttctatgcagaggtgctgtttgacacctgtggcatcacagaccgctgcagccccaacatgtgtgaacatgatggccgctgctaccagagctgggatgacttcatctgctactgtgagctgaccggctacaagggggagacctgccacacccccctgtacaaggagagctgtgaggcctaccgcctgagcggcaagaccagcggcaacttcaccatcgaccctgatggcagcggccccctgaagccctttgtggtgtactgtgacatcagagaaaatagagcctggacagtggtgagacatgaccggctgtggaccaccagggtgacaggcagctccatggagcggcccttcctgggcgccatccagtactggaatgcctcctgggaggaggtgtctgccctggccaatgccagccagcactgtgagcagtggattgagttcagctgctacaacagccggctgctgaacacagctgggggctacccctacagcttctggattggaagaaatgaggagcagcacttctactggggcggcagccagcccggcatccagagatgtgcctgtggcctggacaggagctgtgtggaccctgccctgtactgcaactgtgatgctgaccagccccagtggaggacagacaagggcctgctgacctttgtggaccacctgcctgtgacccaggtggtgattggagacaccaacagaagcaccagcgaggcccagttcttcctgcggcccctgcgctgctatggagacaggaacagctggaacaccatctccttccacactggagctgccctgcgcttcccccccatccgggccaaccacagcctggatgtgtccttctacttccgcaccagcgcccccagcggggtcttcctggagaacatgggcggcccctactgccagtggaggcggccctacgtgcgggtggagctgaacaccagcagagatgtggtgtttgcctttgatgtgggcaatggagatgagaacctgactgtgcacagtgatgactttgagttcaatgatgatgagtggcacctggtgcgggcagagatcaacgtgaagcaggcccggctgcgggtggaccaccggccctgggtgctgcggcccatgcccctgcagacctacatctggatggagtatgaccagcccctgtatgtgggcagcgctgagctgaagaggcggccctttgtgggctgcctgcgggccatgaggctgaatggagtgaccctgaacctggagggccgggccaatgccagcgagggcaccagccccaactgcaccggccactgtgcccacccccggctgccctgcttccacggcggccgctgtgtggagcgctacagctactacacctgtgactgtgacctgacagcctttgatggcccctactgcaaccacgacattggaggcttctttgagcccggcacctggatgagatacaacctgcagagcgccctgcggtctgctgcccgggagttcagccacatgctgagcaggcctgtgcccggctatgagcccggctacatccctggctatgacaccccaggctacgtgcccggctaccacggccctggctaccgcctgcctgactaccccaggcctggccggcctgtgcccggctaccggggccctgtgtacaacgtgactggagaggaggtgtccttctccttcagcaccagcagcgccccagctgtgctgctgtatgtgagcagctttgtgcgggactacatggctgtgctgatcaaggatgatggcaccctgcagctgcgctaccagctgggcaccagcccctacgtgtaccagctgaccaccaggcctgtgacagatggccagccccacagcatcaacatcaccagggtgtacagaaacctcttcatccaggtggactacttccccctgacagagcagaagttcagcctgctggtggacagccagctggacagccccaaggccctgtacctgggccgggtgatggagactggagtcatcgaccctgagatccagcgctacaacaccccaggcttcagcggctgcctgtctggagtgcgcttcaacaacgtggcccccctgaagacccacttccgcaccccccggcccatgacagctgagctggccgaggccctgcgggtgcagggcgagctgtctgagagcaactgtggggccatgccccggctggtgtctgaggtgcccccagagctggacccctggtacctgcccccagacttcccctactaccatgatgagggctgggtggccatcctgctgggcttcctggtggccttcctgctgctgggcctggtgggcatgctggtgctcttctacctgcagaaccaccgctacaagggcagctaccacaccaatgagcccaaggccgcccacgagtaccaccctggcagcaagccacccctgcccaccagcggccctgcccaggtgcccacccccacagctgcccccaaccaggccccagccagcgccccagccccagcccccaccccagccccagcccctggcccccgggaccagaacctgccccagatcctggaggagagccgctctgagtag

SEQ ID NO: 33619 - DNA, 1143 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgacagccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtacaccctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagcaacctggacctgaactttgagatcagctttggaggcatcctgagccctggccgcagccgggccttcaccaggaagagcttccacggctgcctggagaacctgtactacaatggagtggatgtgacagagctggccaagaagcacaagccccagatcctgatgatggagctggcccacggcctgcaggaccagaacctgaagatcagcctgactgtgtgccaccagaccacccagtag

SEQ ID NO: 33620 - DNA, 2241 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgacagccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtacaccctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagcaacctggacctgaactttgagatcagctttggaggcatcctgagccctggccgcagccgggccttcaccaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcagaggggcagcggcagctttgtgctcttcctgaaggatggcaagctgaagctgagcctcttccaggccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctgggcaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagctgacagcgcctggacagtggtgagacatggaggcccagatgctgtgaccctgcggggggcccccagcggccaccccctgtctgctgtgtcctttgcctatgctgctggagctggccagctgcgggctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggccagaatgagtggtag

SEQ ID NO: 33621 - DNA, 609 bp, Artificial Sequence
  Description of Artificial Sequence: Synthetic coding sequence
atgacctaccacttccaggagcactacaccctgtctgagaacagcagcagcctggtgagcagcctgtacagagatgtgaccctgacccgggagatgatcaccctgtccttccgcaccaccaggagccccagcctgctgctgtatgtgtcctccttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcgccaagaagcaggtgatcctgagcagcggcacagagttcaatgctgtgaagagcctcatcctgggcaaggtgctgggccgcagcggccctgtggatgaaggagagcccctggtgaatgctgacagaagagacagcgctgtgatgggcggcgtgattgctgtggtgatcttcatcctgctgtgcatcacagccatcgccatccgcatctaccagcagaggaagctgaggaaagaaaatgaaagcaaggtgtccaagaaggaggagtgctag

SEQ ID NO: 33622 - DNA, 3531 bp, Artificial Sequence
  Description of Artificial Sequence: Synthetic coding sequence
tgaggaagagagctggagaccggccagggccggcagagctctgtgggcgccgcccagggcactggagtgcgggccggcgtgcgggccggcaccacccagagcggcagaagaagagcccgggtgtctggccgcctggccgaggtgtccatggcctctgtggcctgggccgtgctgaaggtgctgctgctgctgcccacccagacctggagccctgtgggcgccggcaaccccccagactgtgacagccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtacagaagagaggagagcatctggggcttccctggcaacaccaatgctgacagcgtggtgcactaccgcctgcagcccccatttgaggcccgcttcctgcgcttcctgcccctggcctggaacccccggggcagaattggcatgagaattgaggtgtatggctgtgcctacaagtctgaggtggtgtactttgatggccagagcgccctgctgtacaccctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagcaacctggacctgaactttgagatcagctttggaggcatcctgagccctggccgcagccgggccttcaccaggaagagcttccacggctgcctggagaacctgtactacaacggggtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcagaggggcagcggcagctttgtgctcttcctgaaggatggcaagctgaagctgagcctcttccaggccggccagagccccagaaatgtgacagctggagctggcctgaatgatggccagtggcacagcgtgtccttcagcgccaagtggagccacatgaatgtggtggtggatgatgacacagctgtgcagcccctggtggccgtgctgattgacagcggggacacctactactttggaggctgcctgggcaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgaacatggaggagagtgcagccagagctgggacaccttcagctgtgactgcctgggcaccggctacaccggggagacctgccacagcagcctgtatgagcagagctgtgaggcccacaagcaccggggcaaccccagcggcctgtactacattgatgctgatggcagcggccccctgggccccttcctggtgtactgcaacatgacagctgacagcgcctggacagtggtgcgccacggcggcccagatgctgtgaccctgcggggggcccccagcggccaccccctgtctgctgtgtcctttgcctatgctgctggggccggccagctgcgggctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggccagaatgagtggaccagtgacaccatcgtgctgagccagaaggagcacctgcctgtgacccagatcgtgatgacagacaccggccagccccacagcgaggccgactacaccctgggccccctgctgtgccgcggggacaagagcttctggaacagcgccagcttcaacacagagaccagctacctgcacttccctgccttccatggagagctgacagcagatgtgtgcttcttcttcaagaccaccgtgagcagcggggtcttcatggagaacctgggcatcacagacttcatcagaattgagctgcgggcccccacagaggtgaccttctcctttgatgtgggcaatggcccctgtgaggtgacagtgcagagccccacccccttcaatgacaaccagtggcaccacgtgcgggcagagagaaatgtgaagggggccagcctgcaggtggaccagctgccccagaagatgcagcctgccccagcagatggccacgtgcggctgcagctgaacagccagctgttcatcggcggcacagccacccggcagaggggcttcctgggctgcatccgcagcctgcagctgaatggagtggccctggacctggaggagcgggccaccgtgaccccaggagtggagcccggctgtgccggccactgcagcacctacggccacctgtgcagaaatggaggccgctgccgggagaagaggcggggcgtgacctgtgactgtgccttcagcgcctatgatggccccttctgcagcaatgagatcagcgcctactttgccaccggcagctccatgacctaccacttccaggagcactacaccctgtctgagaacagcagcagcctggtgagcagcctgtacagagatgtgaccctgacccgggagatgatcaccctgtccttccgcaccaccaggagccccagcctgctgctgtatgtgtcctccttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgatcccccagatgcagaagagcaactag

SEQ ID NO: 33623 - DNA, 3867 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgacagccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtacaccctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagcaacctggacctgaactttgagatcagctttggaggcatcctgagccctggccgcagccgggccttcaccaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcagaggggcagcggcagctttgtgctcttcctgaaggatggcaagctgaagctgagcctcttccaggccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctgggcaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagctgacagcgcctggacagtggtgagacatggaggcccagatgctgtgaccctgcggggggcccccagcggccaccccctgtctgctgtgtcctttgcctatgctgctggagctggccagctgcgggctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggccagaatgagtggaccagtgacaccatcgtgctgagccagaaggagcacctgcctgtgacccagatcgtgatgacagacaccggccagccccacagcgaggccgactacaccctgggccccctgctgtgccgcggggacaagagcttctggaacagcgccagcttcaacacagagaccagctacctgcacttccctgccttccacggggagctgacagcagatgtgtgcttcttcttcaagaccaccgtgtcctctggagtcttcatggagaacctgggcatcacagacttcatccgcatcgagctgcgggcccccacagaggtgaccttctcctttgatgtgggcaatggcccctgtgaggtgacagtgcagagccccacccccttcaatgacaaccagtggcaccacgtgcgggcagagagaaatgtgaagggggccagcctgcaggtggaccagctgccccagaagatgcagcctgccccagcagatggccacgtgcggctgcagctgaacagccagctgttcatcggcggcacagccacccggcagaggggcttcctgggctgcatccgcagcctgcagctgaatggagtggccctggacctggaggagcgggccaccgtgaccccaggagtggagcccggctgtgccggccactgcagcacctacggccacctgtgcagaaatggaggccgctgccgggagaagagaagaggagtgacctgtgactgtgccttcagcgcctatgatggccccttctgcagcaatgagatcagcgcctactttgccaccggcagctccatgacctaccacttccaggagcactacaccctgtctgagaacagcagcagcctggtgagcagcctgtacagagatgtgaccctgacccgggagatgatcaccctgtccttccgcaccaccaggagccccagcctgctgctgtatgtgagcagcttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcgccaagaagcaggtgatcctgagcagcggcacagagttcaatgctgtgaagagcctcatcctgggcaaggtgctggaggccgccggggctgaccctgacaccaggagagctgccaccagcggcttcaccggctgcctgtctgctgtgcgcttcggccgggccgcccccctgaaggccgccctgcggcccagcggccccagccgggtgacagtgcggggccacgtggcccccatggcccgctgtgccgccggggccgccagcggcagccctgcccgggagctggccccccggctggccggcggggccggccgcagcggccctgtggatgaaggagagcccctggtgaatgctgacagaagagacagcgctgtgatgggcggcgtgattgctgtggtgatcttcatcctgctgtgcatcacagccatcgccatccgcatctaccagcagaggaagctgaggaaagaaaatgaaagcaaggtgtccaagaaggaggagtgctag

SEQ ID NO: 33624 - DNA, 1803 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgacagccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtacaccctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagcaacctggacctgaactttgagatcagctttggaggcatcctgagccctggccgcagccgggccttcaccaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcagaggggcagcggcagctttgtgctcttcctgaaggatggcaagctgaagctgagcctcttccaggccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggagccctgtatgagcagagctgtgaggcccacaagcaccggggcaaccccagcggcctgtactacattgatgctgatggcagcggccccctgggccccttcctggtgtactgcaacatgacagacagcgcctggacagtggtgagacatggaggcccagatgctgtgaccctgcggggggcccccagcggccaccccctgtctgctgtgtcctttgcctatgctgctggagctggccagctgcgggctgctgtgaacctggccgagcgctgtgagcagaggctggccctgcgctgtggcacagcccggcggccagacagccggggctag

SEQ ID NO: 33625 - DNA, 3921 bp, Artificial Sequence
  Description of Artificial Sequence: Synthetic coding sequence
atggacagcctgccccggctgacctctgtgctgaccctgctcttcagcggcctgtggcacctgggcctgacagccaccaactacaactgtgatgaccccctggccagcctgctgagccccatggccttcagcagcagcagtgacctgaccggcacccacagccctgcccagctgaactggagggtgggcaccggcggctggagccctgctgacagcaatgcccagcagtggctgcagatggacctgggcaacagagtggagatcacagctgtggccacccagggccgctatggcagcagtgactgggtgaccagctacagcctgatgttcagtgacacaggaagaaactggaagcagtacaagcaggaggacagcatctggacctttgctggcaacatgaatgctgacagcgtggtgcaccacaagctgctgcacagcgtgcgggccaggtttgtgcgctttgtgcccctggagtggaaccccagcggcaagattggcatgagggtggaggtgtatggctgcagctacaagagtgatgtggccgactttgatggccgcagcagcctgctgtaccgcttcaaccagaagctgatgagcaccctgaaggatgtgatcagcctgaagttcaagtccatgcagggagatggagtgctcttccacggggagggccagagaggagaccacatcaccctggagctgcagaagggccgcctggccctgcacctgaacctgggggacagcaaggcccggctgagcagcagcctgcccagcgccaccctgggcagcctgctggatgaccagcactggcacagcgtgctgattgaaagagtgggcaagcaggtgaacttcaccgtggacaagcacacccagcacttccgcaccaagggggagacagatgccctggacattgattatgagctgagctttggaggcatccctgtgcctgggaagccaggcaccttcctgaagaagaacttccacggctgcattgaaaatctctactacaacggggtgaacatcatcgacctggccaagaggaggaagcaccagatctacacaggaaatgtgaccttcagctgcagcgagccccagatcgtgcccatcacctttgtgaacagcagcggcagctacctgctgctgcccggcaccccccagattgatggcctgtctgtgtccttccagttccgcacctggaacaaggatggcctgctgctgagcacagagctgtctgagggcagcggcaccctgctgctgagcctggagggcggcatcctgcggctggtgatccagaagatgacagagcgggtggccgagatcctgaccggcagcaacctgaatgatggcctgtggcacagcgtgtccatcaatgcccggaggaaccgcatcaccctgaccctggatgatgaggccgcccccccagccccagacagcacctgggtgcagatctacagcggcaacagctactactttggaggctgcccagacaacctgacagacagccagtgcctgaaccccatcaaggccttccagggctgcatgaggctcatcttcatcgacaaccagcccaaggacctgatctctgtgcagcagggcagcctgggcaacttcagtgacctgcacatcgacctgtgcagcatcaaggaccgctgcctgcccaactactgtgaacatggaggcagctgcagccagagctggaccaccttctactgcaactgcagcgacaccagctacaccggggccacctgccacaacagcatctatgagcagagctgtgaggtgtaccgccaccagggcaacacagctggcttcttctacatcgacagtgatggcagcggccccctgggccccctgcaggtgtactgcaacatcacagaggacaagatctggacctctgtgcagcacaacaacacagagctgaccagggtgcggggggccaaccctgagaagccctatgccatggccctggactatggaggctccatggagcagctggaggccgtgattgatggcagcgagcactgtgagcaggaggtggcctaccactgcagaagaagccggctgctgaacaccccagatggcacccccttcacctggtggattggccgcagcaatgaaagacacccctactggggcggcagccccccaggagtgcagcagtgtgaatgtggcctggatgagagctgcctggacatccagcacttctgcaactgtgatgctgacaaggatgagtggaccaatgacaccggcttcctgtccttcaaggaccacctgcctgtgacccagatcgtcatcacagacacagacaggagcaacagcgaggccgcctggagaattggccccctgcgctgctacggggaccggcgcttctggaatgctgtgtccttctacacagaggccagctacctgcacttccccaccttccacgccgagttctctgctgacatctccttcttcttcaagaccacagccctgtctggagtcttcctggagaacctgggcatcaaggacttcatccggctggagatcagcagccccagcgagatcacctttgccattgatgtgggcaatggacctgtggagctggtggtgcagagccccagcctgctgaatgacaaccagtggcactacgtgcgggcagagaggaacctgaaggagaccagcctgcaggtggacaacctgcccaggagcacccgggagaccagcgaggagggccacttccggctgcagctgaacagccagctgtttgtgggcggcaccagcagccggcagaagggcttcctgggctgcatccgcagcctgcacctgaatggccagaagatggacctggaggagcgggccaaggtgaccagcggcgtgcggcccggctgccccggccactgcagcagctatggcagcatctgccacaatggaggaaaatgtgtggagaagcacaacggctacctgtgtgactgcaccaacagcccctatgagggccccttctgcaagaaggaggtgtctgctgtgtttgaggccggcacctctgtgacctacatgttccaggagccctaccctgtgaccaagaacatcagcctgagcagcagcgccatctacacagattctgcccccagcaaggagaacatcgccctgagctttgtgaccacccaggcccccagcctgctgctcttcatcaacagcagcagccaggactttgtggtggtgctgctgtgcaagaatggcagcctgcaggtgcgctaccacctgaacaaggaggagacccacgtgttcaccattgatgctgacaactttgccaacagaaggatgcaccacctgaagatcaaccgggagggccgggagctgaccatccagatggaccagcagctgcggctgagctacaacttcagccctgaggtggagttccgggtcatccgcagcctgaccctgggcaaggtgacagagaacctgggcctggacagcgaggtggccaaggccaatgccatgggctttgctggctgcatgagctctgtgcagtacaaccacatcgcccccctgaaggccgccctgcggcatgccaccgtggcccctgtgacagtgcacggcaccctgacagagagcagctgtggcttcatggtggacagtgatgtgaatgctgtgaccaccgtgcacagcagcagtgacccctttgggaagacagatgagcgggagcccctgaccaatgctgtgcggagtgacagcgctgtgattggaggagtgattgctgtggtgatcttcatcatcttctgcatcatcggcatcatgacccgcttcctgtaccagcacaagcagagccacaggaccagccagatgaaggagaaggagtacccagagaacctggacagcagcttcagaaatgaaattgacctgcagaacacagtgtctgagtgcaagcgggagtacttcatctag

SEQ ID NO: 33626 - DNA, 3129 bp, Artificial Sequence
  Description of Artificial Sequence: Synthetic coding sequence
atgaagcagagccctgccctggcccctgaggagcgctgccggcgggccggcagccccaagcctgtgctgcgggcagatgacaacaacatgggaaatggctgcagccagaagctggccacagccaacctgctgcgcttcctgctgctggtgctgatcccctgcatctgtgccctggtgctgctgctggtgatcctgctgtcctatgtgggcaccctgcagaaggtgtacttcaagagcaatggcagcgagcccctggtgacagatggagagatccagggcagtgatgtgatcctgaccaacaccatctacaaccagagcacagtggtgtccacagcccacccagaccagcacgtgcctgcctggaccacagatgccagcctgcccggggaccagagccacaggaacaccagcgcctgcatgaacatcacccacagccagtgccagatgctgccctaccacgccaccctgacccccctgctgtctgtggtgaggaacatggagatggagaagttcctgaagttcttcacctacctgcaccggctgagctgctaccagcacatcatgctgtttggctgcaccctggccttccctgagtgcatcattgatggagatgacagccacggcctgctgccctgccgctccttctgtgaggccgccaaggagggctgtgagagcgtgctgggcatggtgaactacagctggccagacttcctgcgctgcagccagttcaggaaccagacagagagcagcaatgtgagccgcatctgcttcagcccccagcaggagaatggcaagcagctgctgtgtggcagaggagagaacttcctgtgtgccagcggcatctgcatccctgggaagctgcagtgcaatggctacaatgactgtgatgactggagcgatgaggcccactgcaactgcagcgagaacctcttccactgccacacaggcaagtgcctgaactacagcctggtgtgtgatggctatgatgactgtggggacctgagtgatgagcagaactgtgactgcaaccccaccacagagcaccgctgtggagatggccgctgcatcgccatggagtgggtgtgtgatggagaccatgactgtgtggacaagagtgatgaggtgaactgcagctgccacagccagggcctggtggagtgcagaaatggccagtgcatccccagcaccttccagtgtgatggagatgaggactgcaaggatggcagtgatgaggagaactgcagcgtcatccagaccagctgccaggagggggaccagcgctgcctgtacaacccctgcctggacagctgtggcggcagcagcctgtgtgaccccaacaacagcctgaacaactgcagccagtgtgagcccatcaccctggagctgtgcatgaacctgccctacaacagcaccagctaccccaactacttcggccacaggacccagaaggaggccagcatctcctgggagagcagcctcttccctgccctggtgcagaccaactgctacaagtacctgatgttcttcagctgcaccatcctggtgcccaagtgtgatgtgaacacaggagagcacatccccccctgccgggccctgtgtgagcacagcaaggagcgctgtgagagcgtgctgggcatcgtgggcctgcagtggccagaggacacagactgcagccagtttcctgaagaaaattctgacaaccagacctgcctgatgccagatgaatatgtggaggagtgcagccccagccacttcaagtgccgcagcggccagtgtgtgctggccagcagaagatgtgatggccaggccgactgtgatgatgacagtgatgaggagaactgtggctgcaaggagcgggacctgtgggagtgccccagcaacaagcagtgcctgaagcacacagtcatctgtgatggcttcccagactgcccagactacatggatgagaagaactgcagcttctgccaggatgatgagctggagtgtgccaaccacgcctgtgtgtcccgggacctgtggtgtgatggagaggccgactgcagcgacagcagtgatgagtgggactgtgtgaccctgagcatcaacgtgaacagcagcagcttcctgatggtgcacagagctgccacagagcaccacgtgtgtgctgatggctggcaggagatcctgagccagctggcctgcaagcagatgggcctgggggagcccagcgtgaccaagctgatccaggagcaggagaaggagccccgctggctgaccctgcacagcaactgggagagcctgaatggcaccaccctgcacgagctgctggtgaatggccagagctgtgagagccgcagcaagatcagcctgctgtgcaccaagcaggactgtggccggcggcctgctgccaggatgaacaagaggatcctgggcggccgcaccagccggcccggccgctggccctggcagtgcagcctgcagagcgagcccagcggccacatctgtggctgtgtgctgattgccaagaagtgggtgctgactgtggcccactgctttgagggcagagaaaatgctgctgtgtggaaggtggtgctgggcatcaacaacctggaccaccccagcgtcttcatgcagaccaggtttgtgaagaccatcatcctgcacccccgctacagcagagctgtggtggactatgacatcagcatcgtggagctgtctgaggacatcagcgagaccggctacgtgcggcctgtgtgcctgcccaaccctgagcagtggctggagccagacacctactgctacatcaccggctggggccacatgggcaacaagatgcccttcaagctgcaggagggggaggtgcgcatcatcagcctggagcactgccagagctactttgacatgaagaccatcaccaccaggatgatctgtgccggctatgaaagtggcaccgtggacagctgcatgggagacagcggcggccccctggtgtgtgagaagccaggcggccgctggaccctgtttggcctgacctcctggggctctgtgtgcttcagcaaggtgctgggccctggggtgtacagcaatgtgtcctactttgtggagtggatcaagaggcagatctacatccagaccttcctgctgaactag

SEQ ID NO: 33627 - DNA, 2928 bp, Artificial Sequence
  Description of Artificial Sequence: Synthetic coding sequence
atgaagcagagccctgccctggcccctgaggagcgctgccggcgggccggcagccccaagcctgtgctgcgggcagatgacaacaacatgggaaatggctgcagccagaagctggccacagccaacctgctgcgcttcctgctgctggtgctgatcccctgcatctgtgccctggtgctgctgctggtgatcctgctgtcctatgtgggcgcctgcatgaacatcacccacagccagtgccagatgctgccctaccacgccaccctgacccccctgctgtctgtggtgaggaacatggagatggagaagttcctgaagttcttcacctacctgcaccggctgagctgctaccagcacatcatgctgtttggctgcaccctggccttccctgagtgcatcattgatggagatgacagccacggcctgctgccctgccgctccttctgtgaggccgccaaggagggctgtgagagcgtgctgggcatggtgaactacagctggccagacttcctgcgctgcagccagttcaggaaccagacagagagcagcaatgtgagccgcatctgcttcagcccccagcaggagaatggcaagcagctgctgtgtggccgcggggagaacttcctgtgtgccagcggcatctgcatccctgggaagctgcagtgcaatggctacaatgactgtgatgactggagcgatgaggcccactgcaactgcagtgaaaatctcttccactgccacacaggcaagtgcctgaactacagcctggtgtgtgatggctatgatgactgtggggacctgagtgatgagcagaactgtgactgcaaccccaccacagagcaccgctgtggagatggccgctgcatcgccatggagtgggtgtgtgatggagaccatgactgtgtggacaagagtgatgaggtgaactgcagctgccacagccagggcctggtggagtgcagaaatggccagtgcatccccagcaccttccagtgtgatggagatgaggactgcaaggatggcagtgatgaggagaactgcagcgtcatccagaccagctgccaggagggggaccagcgctgcctgtacaacccctgcctggacagctgtggcggcagcagcctgtgtgaccccaacaacagcctgaacaactgcagccagtgtgagcccatcaccctggagctgtgcatgaacctgccctacaacagcaccagctaccccaactacttcggccacaggacccagaaggaggccagcatctcctgggagagcagcctcttccctgccctggtgcagaccaactgctacaagtacctgatgttcttcagctgcaccatcctggtgcccaagtgtgatgtgaacacaggagagcacatccccccctgccgggccctgtgtgagcacagcaaggagcgctgtgagagcgtgctgggcatcgtgggcctgcagtggccagaggacacagactgcagccagtttcctgaggagaacagcgacaaccagacctgcctgatgccagatgaatatgtggaggagtgcagccccagccacttcaagtgccgcagcggccagtgtgtgctggccagccgccgctgtgatggccaggccgactgtgatgatgacagtgatgaggagaactgtggctgcaaggagcgggacctgtgggagtgccccagcaacaagcagtgcctgaagcacacagtcatctgtgatggcttcccagactgcccagactacatggatgagaagaactgcagcttctgccaggatgatgagctggagtgtgccaaccacgcctgtgtgtcccgggacctgtggtgtgatggagaggccgactgcagcgacagcagtgatgagtgggactgtgtgaccctgagcatcaacgtgaacagcagcagcttcctgatggtgcaccgggccgccacagagcaccacgtgtgtgctgatggctggcaggagatcctgagccagctggcctgcaagcagatgggcctgggggagcccagcgtgaccaagctgatccaggagcaggagaaggagccccgctggctgaccctgcacagcaactgggagagcctgaatggcaccaccctgcacgagctgctggtgaatggccagagctgtgagagccgcagcaagatcagcctgctgtgcaccaagcaggactgtggcagaagacctgctgccaggatgaacaagaggatcctgggcggccgcaccagcaggcctggccgctggccctggcagtgcagcctgcagagcgagcccagcggccacatctgtggctgtgtgctgattgccaagaagtgggtgctgactgtggcccactgctttgagggccgggagaatgctgctgtgtggaaggtggtgctgggcatcaacaacctggaccaccccagcgtcttcatgcagaccaggtttgtgaagaccatcatcctgcacccccgctacagcagagctgtggtggactatgacatcagcatcgtggagctgtctgaggacatcagcgagaccggctacgtgcggcctgtgtgcctgcccaaccctgagcagtggctggagccagacacctactgctacatcaccggctggggccacatgggcaacaagatgcccttcaagctgcaggagggggaggtgcgcatcatcagcctggagcactgccagagctactttgacatgaagaccatcaccaccaggatgatctgtgccggctatgagagcggcaccgtggacagctgcatgggagacagcggcggccccctggtgtgtgagaagccaggcggccgctggaccctgtttggcctgacctcctggggctctgtgtgcttcagcaaggtgctgggccctggggtgtacagcaatgtgtcctactttgtggagtggatcaagaggcagatctacatccagaccttcctgctgaactag

SEQ ID NO: 33628 - DNA, 3018 bp, Artificial Sequence
  Description of Artificial Sequence: Synthetic coding sequence
atgaagcagagccctgccctggcccctgaggagcgctgccggcgggccggcagccccaagcctgtgctgcgggcagatgacaacaacatgggaaatggctgcagccagaagctggccacagccaacctgctgcgcttcctgctgctggtgctgatcccctgcatctgtgccctggtgctgctgctggtgatcctgctgtcctatgtgggcaccctgcagaaggtgtacttcaagagcaatggcagcgagcccctggtgacagatggagagatccagggcagtgatgtgatcctgaccaacaccatctacaaccagagcacagtggtgtccacagcccacccagaccagcacgtgcctgcctggaccacagatgccagcctgcccggggaccagagccacaggaacaccagcgcctgcatgaacatcacccacagccagtgccagatgctgccctaccacgccaccctgacccccctgctgtctgtggtgaggaacatggagatggagaagttcctgaagttcttcacctacctgcaccggctgagctgctaccagcacatcatgctgtttggctgcaccctggccttccctgagtgcatcattgatggagatgacagccacggcctgctgccctgccgctccttctgtgaggccgccaaggagggctgtgagagcgtgctgggcatggtgaactacagctggccagacttcctgcgctgcagccagttcaggaaccagacagagagcagcaatgtgagccgcatctgcttcagcccccagcaggagaatggcaagcagctgctgtgtggcagaggagagaacttcctgtgtgccagcggcatctgcatccctgggaagctgcagtgcaatggctacaatgactgtgatgactggagcgatgaggcccactgcaactgcagcgagaacctcttccactgccacacaggcaagtgcctgaactacagcctggtgtgtgatggctatgatgactgtggggacctgagtgatgagcagaactgtgcctgccacagccagggcctggtggagtgcagaaatggccagtgcatccccagcaccttccagtgtgatggagatgaggactgcaaggatggcagtgatgaggagaactgcagcgtcatccagaccagctgccaggagggggaccagcgctgcctgtacaacccctgcctggacagctgtggcggcagcagcctgtgtgaccccaacaacagcctgaacaactgcagccagtgtgagcccatcaccctggagctgtgcatgaacctgccctacaacagcaccagctaccccaactacttcggccacaggacccagaaggaggccagcatctcctgggagagcagcctcttccctgccctggtgcagaccaactgctacaagtacctgatgttcttcagctgcaccatcctggtgcccaagtgtgatgtgaacacaggagagcacatccccccctgccgggccctgtgtgagcacagcaaggagcgctgtgagagcgtgctgggcatcgtgggcctgcagtggccagaggacacagactgcagccagtttcctgaggagaacagcgacaaccagacctgcctgatgccagatgaatatgtggaggagtgcagccccagccacttcaagtgccgcagcggccagtgtgtgctggccagccgccgctgtgatggccaggccgactgtgatgatgacagtgatgaggagaactgtggctgcaaggagcgggacctgtgggagtgccccagcaacaagcagtgcctgaagcacacagtcatctgtgatggcttcccagactgcccagactacatggatgagaagaactgcagcttctgccaggatgatgagctggagtgtgccaaccacgcctgtgtgtcccgggacctgtggtgtgatggagaggccgactgcagcgacagcagtgatgagtgggactgtgtgaccctgagcatcaacgtgaacagcagcagcttcctgatggtgcaccgggccgccacagagcaccacgtgtgtgctgatggctggcaggagatcctgagccagctggcctgcaagcagatgggcctgggggagcccagcgtgaccaagctgatccaggagcaggagaaggagccccgctggctgaccctgcacagcaactgggagagcctgaatggcaccaccctgcacgagctgctggtgaatggccagagctgtgagagccgcagcaagatcagcctgctgtgcaccaagcaggactgtggcagaagacctgctgccaggatgaacaagaggatcctgggcggccgcaccagcaggcctggccgctggccctggcagtgcagcctgcagagcgagcccagcggccacatctgtggctgtgtgctgattgccaagaagtgggtgctgactgtggcccactgctttgagggccgggagaatgctgctgtgtggaaggtggtgctgggcatcaacaacctggaccaccccagcgtcttcatgcagaccaggtttgtgaagaccatcatcctgcacccccgctacagcagagctgtggtggactatgacatcagcatcgtggagctgtctgaggacatcagcgagaccggctacgtgcggcctgtgtgcctgcccaaccctgagcagtggctggagccagacacctactgctacatcaccggctggggccacatgggcaacaagatgcccttcaagctgcaggagggggaggtgcgcatcatcagcctggagcactgccagagctactttgacatgaagaccatcaccaccaggatgatctgtgccggctatgagagcggcaccgtggacagctgcatgggagacagcggcggccccctggtgtgtgagaagccaggcggccgctggaccctgtttggcctgacctcctggggctctgtgtgcttcagcaaggtgctgggccctggggtgtacagcaatgtgtcctactttgtggagtggatcaagaggcagatctacatccagaccttcctgctgaactag

SEQ ID NO: 33629 - DNA, 555 bp, Artificial Sequence
  Description of Artificial Sequence: Synthetic coding sequence
atgaagccagatgagacccccatgtttgaccccagcctgctgaaggaggtggactggagccagaacacagccaccttcagccctgccatcagccccacccaccctggagagggcctggtgctgcggcccctgtgcacagctgacctgaacagaggcttcttcaaggtgctgggccagctgacagaaacaggagtggtgtccccagagcagttcatgaagagctttgagcacatgaagaagagcggggactactacgtgacagtggtggaggatgtgaccctgggccagatcgtggccacagccaccctcatcatcgagcacaagttcatccacagctgtgccaagaggggccgggtggaggatgtggtggtgtctgatgaatgtcggggcaagcagctgggcaagctgctgctgagcaccctgaccctgctgagcaagaagctgaactgctacaagatcaccctggagtgcctgccccagaatgtgggcttctacaagaagtttggctacacagtgtctgaggagaactacatgtgccgccgcttcctgaagtag

SEQ ID NO: 33630 - DNA, 291 bp, Artificial Sequence
  Description of Artificial Sequence: Synthetic coding sequence
atggccttcacctttgctgccttctgctacatgctggccctgctgctgacagctgccctgatcttctttgccatctggcacatcatcgcctttgatgagctgaagacagactacaagaaccccatcgaccagtgcaacaccctgaaccccctggtgctgcctgagtacctgattcatgccttcttctgtgtgatgttcctgtgtgccgctgagtggctgaccctgggcctgaacatgcccctgctggcctaccacatctggagcatgatctacgtgctggtgagcagctag

SEQ ID NO: 33631 - DNA, 483 bp, Artificial Sequence
  Description of Artificial Sequence: Synthetic coding sequence
atggccttcacctttgctgccttctgctacatgctgaccctggtgctgtgtgccagcctcatcttctttgtgatctggcacatcatcgcctttgatgagctgaggacagacttcaagaaccccatcgaccagggcaacccagcccgggcccgggagcggctgaagaacatcgagcgcatctgctgcctgctgaggaagctggtggtgcctgagtacagcatccacggcctcttctgcctgatgttcctgtgtgccgctgagtgggtgaccctgggcctgaacatccccctgctcttctaccacctgtggagatacttccacaggcctgcagatggcagcgaggtgatgtatgatgctgtgtccatcatgaatgctgacatcctgaactactgccagaaggagagctggtgcaagctggccttctacctgctgtccttcttctactacctgtacagcatggtgtacaccctggtgtccttctag

SEQ ID NO: 33632 - DNA, 483 bp, Artificial Sequence
  Description of Artificial Sequence: Synthetic coding sequence
atggccttcacctttgctgccttctgctacatgctgagcctggtgctgtgtgccgccctgatcttctttgccatctggcacatcatcgcctttgatgagctgaggacagacttcaagagccccatcgaccagtgcaaccctgtgcacgcccgggagcggctgagaaatattgagcgcatctgcttcctgctgaggaagctggtgctgcctgagtacagcatccacagcctcttctgcatcatgttcctgtgtgcccaggagtggctgaccctgggcctgaatgtgcccctgctcttctaccacttctggagatacttccactgcccagctgacagcagcgagctggcctatgacccccctgtggtgatgaatgctgacaccctgagctactgccagaaggaggcctggtgcaagctggccttctacctgctgtccttcttctactacctgtactgcatgatctacaccctggtgagcagctag

SEQ ID NO: 33633 - DNA, 414 bp, Artificial Sequence
  Description of Artificial Sequence: Synthetic coding sequence
atggaggccgtggtgtttgtgttcagcctgctggactgctgtgccctgatcttcctgtctgtgtacttcatcatcaccctgagtgacctggagtgtgactacatcaatgcccggagctgctgcagcaagctgaacaagtgggtgattcctgagctgattggccacaccatcgtgacagtgctgctgctgatgagcctgcactggttcatcttcctgctgaacctgcctgtggccacctggaacatctaccgctacatcatggtgcccagcggcaacatgggcgtgtttgaccccacagagatccacaacagaggccagctgaagagccacatgaaggaggccatgatcaagctgggcttccacctgctgtgcttcttcatgtacctgtacagcggcagcaactgcccctgctag

SEQ ID NO: 33634 - DNA, 279 bp, Artificial Sequence
  Description of Artificial Sequence: Synthetic coding sequence
atggaggccgtggtgtttgtgttcagcctgctggactgctgtgccctgatcttcctgtctgtgtacttcatcatcaccctgagtgacctggagtgtgactacatcaatgcccggagctgctgcagcaagctgaacaagtgggtgattcctgagctgattggccacaccatcgtgacagtgctgctgctgatgagcctgcactggttcatcttcctgctgaacctgcctgtggccacctggaacatctacaggatgatcctggccctgatcaatgactag

SEQ ID NO: 33635 - DNA, 273 bp, Artificial Sequence
  Description of Artificial Sequence: Synthetic coding sequence
atggaggccgtggtgtttgtgttcagcctgctggactgctgtgccctgatcttcctgtctgtgtacttcatcatcaccctgagtgacctggagtgtgactacatcaatgcccggagctgctgcagcaagctgaacaagtgggtgattcctgagctgattggccacaccatcgtgacagtgctgctgctgatgagcctgcactggttcatcttcctgctgaacctgcctgtggccacctggaacatctaccggggcagcaactgcccctgctag

SEQ ID NO: 33636 - DNA, 420 bp, Artificial Sequence
  Description of Artificial Sequence: Synthetic coding sequence
atggaggccgtggtgtttgtgttcagcctgctggactgctgtgccctgatcttcctgtctgtgtacttcatcatcaccctgagtgacctggagtgtgactacatcaatgcccggagctgctgcagcaagctgaacaagtgggtgattcctgagctgattggccacaccatcgtgacagtgctgctgctgatgagcctgcactggttcatcttcctgctgaacctgcctgtggccacctggaacatctaccgctacatcatggtgcccagcggcaacatgggcgtgtttgaccccacagagatccacaacagaggccagctgaagagccacatgaaggaggccatgatcaagctgggcttccacctgctgtgcttcttcatgtacctgtacagcatgatcctggccctgatcaatgactag

SEQ ID NO: 33637 - DNA, 246 bp, Artificial Sequence
  Description of Artificial Sequence: Synthetic coding sequence
atggatggcggccagcccatccccagcagcctggtgcccctgggcaatgaatctgctgacagctccatgagcctggagcagaagatgacctttgtgtttgtgatcctgctcttcatcttcctgggcatcctgattgtgcgctgcttccgcatcctgctggacccctaccgctccatgcccaccagcacctgggcagatggcctggagggcctggagaagggccagtttgaccacgccctggcctag

SEQ ID NO: 33638 - DNA, 246 bp, Artificial Sequence; identical to SEQ ID NO: 33637
  Description of Artificial Sequence: Synthetic coding sequence

SEQ ID NO: 33639 - DNA, 114 bp, Artificial Sequence
  Description of Artificial Sequence: Synthetic coding sequence
gtgtacacagactacatctacttcaacagcttcctggagagcttccagggcttctttgtgtctgtgttctactgcttcctgaacagcgaggtgcgcagcgccatcaggaagtag

SEQ ID NO: 33640 - DNA, 723 bp, Artificial Sequence
  Description of Artificial Sequence: Synthetic coding sequence
atgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 33641 - DNA, 1206 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 33642 - DNA, 1128 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagtgacaatggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 33643 - DNA, 378 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggaggagcccggcacccaggcccagcccggccgggcccacagaggaggcacctag

SEQ ID NO: 33644 - DNA, 1248 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 33645 - DNA, 858 bp, Artificial Sequence
  Description of Artificial Sequence: Synthetic coding sequence
atggtgtctgccaccatcccccagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtaccgggccagcctgtgcctgtgcagcacagtgagcagcatcgtgcgctctgtgctgcccagcggccggggcggcactggaggccgcaccagcaccaggtctgtgcctgagtggcctgtgccctgccccagccccccaccccagcctgtgtctgccttcaccgccagcagcagcccccagcagagcgagctggccggccacggggccgcccccaagcagctgtggctgggcggctag

SEQ ID NO: 33646 - DNA, 1335 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggcccggctgcacccactggggagaccaggctgatggagccctggaggtgggcgccccctggagcggggcccccttccaggtgagaagaagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 33647 - DNA, 321 bp, Artificial Sequence
  Description of Artificial Sequence: Synthetic coding sequence
atggccctggaccctgctgaccagcacctgcggcacgtggagaaggatgtgctgatccccaagatcatgagggagaaggccaaggagcgctgcagcgagcaggtgcaggacttcaccaagtgctgcaagaacagcggcgtgctgatggtggtgaagtgcaggaaggagaacagcgccctgaaggagtgcctgacagcctactacaatgaccctgccttctatgaggagtgcaagatggagtacctgaaggagcgggaggagttcaggaagacaggcatccccaccaagaagaggctgcagaagctgcccacctccatgtag

SEQ ID NO: 33648 - DNA, 321 bp, Artificial Sequence
  Description of Artificial Sequence: Synthetic coding sequence
atgtttgccccagctgtgatgagggccttcaggaagaacaagaccctgggctacggcgtgcccatgctgctgctgattgtgggcggcagctttggcctgcgggagttcagccagatccgctatgatgctgtgaagagcaagatggaccctgagctggagaagaagctgaaggagaacaagatcagcctggagagtgaatatgagaagatcaaggacagcaagtttgatgactggaagaacatccggggcccccggccctgggaggaccctgacctgctgcagggcaggaaccctgagagcctgaagaccaagaccacctag

SEQ ID NO: 33649 - DNA, 1002 bp, Artificial Sequence
  Description of Artificial Sequence: Synthetic coding sequence
atgctgtgccgcctgggcggccgctggctgcggcccctgcctgccctgcagctgtgggcccgggacctgcccctggcccctgtgcccaccagcggggccaagaggcccaccctgcctgtgtgggccgtggcccctgtgtctgctgtgcacgccaacggctggtatgaggccctggccgccagcagccctgtgcgggtggccgaggaggtgctgctgggcgtgcacgccgccaccggcctgccctggtggggcagcatcctgctgagcacagtggccctgcggggagctgtgaccctgcccctggccgcctaccagcactacatcctggccaaggtggagaacctgcagcctgagatcaagaccatcgcccggcacctgaaccaggaggtggccgtgcgggccaaccagctgggctggagcaagagagatgcccggctgacctacctgaagaacatgagaagactcatcagcgagctgtatgtgcgggacaactgccaccccttcaaggccaccgtgctggtgtggatccagctgcccatgtggatcttcatgagctttgccctgaggaacctgagcactggagctgcccacagcgagggcttctctgtgcaggagcagctggccactggaggcatcctgtggttcccagacctgacagccccagacagcacctggatcctgcccatctctgtgggcgtcatcaacctgctgattgtggagatctgtgccctgcagaagattggcatgagccgcttccagacctacatcacctactttgtgcgggccatgtctgtgctgatgatccccatcgccgccaccgtgcccagcagcatcgtgctgtactggctgtgcagcagctttgtgggcctgagccagaacctgctgctgcggagccctggcttccggcagctgtgccgcatccccagcaccaagagtgacagcgagaccccctacaaggacatctttgctgccttcaacaccaagttcatcagcaggaagtag

SEQ ID NO: 33650 - DNA, 1005 bp, Artificial Sequence
  Description of Artificial Sequence: Synthetic coding sequence
atgctgtgccgcctgggcggccgctggctgcggcccctgcctgccctgcagctgtgggcccgggacctgcccctggcccctgtgcccaccagcggggccaagaggcccaccctgcctgtgtgggccgtggcccctgtgtctgctgtgcacgccaacggctggtatgaggccctggccgccagcagccctgtgcgggtggccgaggaggtgctgctgggcgtgcacgccgccaccggcctgccctggtggggcagcatcctgctgagcacagtggccctgcggggagctgtgaccctgcccctggccgcctaccagcactacatcctggccaaggtggagaacctgcagcctgagatcaagaccatcgcccggcacctgaaccaggaggtggccgtgcgggccaaccagctgggctggagcaagagagatgcccggctgacctacctgaagaacatgagaagactcatcagcgagctgtatgtgcgggacaactgccaccccttcaaggccaccgtgctggtgtggatccagctgcccatgtggatcttcatgagctttgccctgaggaacctgagcactggagctgcccacagcgaggccggcttctctgtgcaggagcagctggccaccggcggcatcctgtggttcccagacctgacagccccagacagcacctggatcctgcccatctctgtgggcgtcatcaacctgctgattgtggagatctgtgccctgcagaagattggcatgagccgcttccagacctacatcacctactttgtgcgggccatgtctgtgctgatgatccccatcgccgccaccgtgcccagcagcatcgtgctgtactggctgtgcagcagctttgtgggcctgagccagaacctgctgctgcggagccctggcttccggcagctgtgccgcatccccagcaccaagagtgacagcgagaccccctacaaggacatctttgctgccttcaacaccaagttcatcagcaggaagtag

SEQ ID NO: 33651 - DNA, 2334 bp, Artificial Sequence
  Description of Artificial Sequence: Synthetic coding sequence
atggaggagcccggggccaccccccagccctacctgggcctggtgctggaggagctgcggcgggtggtggccgccctgcctgagagcatgaggccagatgagaacccctacggcttccccagcgagctggtggtgtgtgccgccgtcatcggcttctttgtggtgctgctcttcctgtggaggagcttccgctctgtgcgcagccggctgtatgtgggccgggagcagaagctgggcgccaccctgagcggcctcatcgaggagaagtgcaagctgctggagaagttcagcctcatccagaaggagtatgagggctatgaggtggagagcagcctggaggatgccagctttgagaaggctgctgctgaggaggcccggagcctggaggccacctgtgagaagctgaacagaagcaacagcgagctggaggatgagatcctgtgcctggagaaggacctgaaggaggagaagagcaagcacagccagcaggatgagctgatggctgacatcagcaagagcatccagagcctggaggatgagagcaagagcctgaagagccagattgctgaggccaagatcatctgcaagaccttcaagatgtctgaggagcggcgggccatcgccatcaaggatgccctgaatgaaaacagccagctgcagaccagccacaagcagctgttccagcaggaggccgaggtgtggaagggggaggtgtctgagctgaacaagcagaagatcacctttgaggacagcaaggtgcatgctgagcaggtgctgaatgacaaggagaaccacatcaagaccctgaccggccacctgcccatgatgaaggaccaggccgctgtgctggaggaggacaccacagatgatgacaacctggagctggaggtgaacagccagtgggagaatggagccaacctggatgaccccctgaagggggccctgaagaagctgattcatgctgccaagctgaatgtgtccctgaagagcctggagggggagaggaaccacatcatcatccagctgtctgaggtggacaagaccaaggaggagctgacagagcacatcaagaacctgcagacccagcaggccagcctgcagagcgagaacatctactttgaaagtgagaaccagaagctgcagcagaagctgaagatcatgacagagttctaccaggagaatgagatgaagctgtacaggaagctgactgtggaggagaactaccgcatcgaggaggaggagaagctgagccgggtggaggagaagatcagccgggccacagagggcctggagacctacaggaagctggccaaggacctggaggaggagctggagaggacagtgcacttctaccagaagcaggtgatctcctatgagaagaggggccatgacaactggctggccgccaggacagctgagaggaacctgagtgacctgaggaaagaaaatgcccacaacaagcagaagctgacagaaacagagctgaagtttgagctgctggagaaggaccccaatgccctggatgtgagcaacacagccttcggccgggagcacagcccctgcagccccagccccctgggccggcccagcagcgagacccgggccttccccagcccccagaccctgctggaggaccccctgcggctgagccctgtgctgcccggcggcggcggccggggccccagcagccctggcaaccccctggaccaccagatcaccaatgaaagaggagagcccagctatgaccggctgattgacccccaccgggcccccagcgacaccggcagcctgagcagccctgtggagcaggacaggaggatgatgttccccccacctggccagagctacccagacagcaccctgcccccccagcgggaggaccgcttctacagcaacagcgagcggctgagcggccctgctgagcccaggagcttcaagatgaccagcctggacaagatggaccgctccatgcccagcgagatggagagcagcagaaatgatgccaaggatgacctgggcaacctgaatgtgcctgacagcagcctgcctgcagaaaatgaggccactggacctggcctcatccccccacccctggcccccatcagcggccccctcttccctgtggacacccggggccccttcatgaggcggggcccccccttccccccacctcctcctggcaccatgtttggagccagccggggctacttccccccccgggacttccctggcccccctcatgccccctttgccatgaggaacatctacccaccccggggcctgcccccctacctgcaccccaggcctggcttctaccccaaccccaccttctag

SEQ ID NO: 33652 - DNA, 2334 bp, Artificial Sequence
  Description of Artificial Sequence: Synthetic coding sequence
atggaggagcccggggccaccccccagccctacctgggcctggtgctggaggagctgcggcgggtggtggccgccctgcctgagagcatgaggccagatgagaacccctacggcttccccagcgagctggtggtgtgtgccgccgtcatcggcttctttgtggtgctgctcttcctgtggaggagcttccgctctgtgcgcagccggctgtatgtgggccgggagcagaagctgggcgccaccctgagcggcctcatcgaggagaagtgcaagctgctggagaagttcagcctcatccagaaggagtatgagggctatgaggtggagagcagcctggaggatgccagctttgagaaggctgctgctgaggaggcccggagcctggaggccacctgtgagaagctgaacagaagcaacagcgagctggaggatgagatcctgtgcctggagaaggacctgaaggaggagaagagcaagcacagccagcaggatgagctgatggctgacatcagcaagagcatccagagcctggaggatgagagcaagagcctgaagagccagattgctgaggccaagatcatctgcaagaccttcaagatgtctgaggagcggcgggccatcgccatcaaggatgccctgaatgaaaacagccagctgcagaccagccacaagcagctgttccagcaggaggccgaggtgtggaagggccaggtgtctgagctgaacaagcagaagatcacctttgaggacagcaaggtgcatgctgagcaggtgctgaatgacaaggagaaccacatcaagaccctgaccggccacctgcccatgatgaaggaccaggccgctgtgctggaggaggacaccacagatgatgacaacctggagctggaggtgaacagccagtgggagaatggagccaacctggatgaccccctgaagggggccctgaagaagctgattcatgctgccaagctgaatgtgtccctgaagagcctggagggggagaggaaccacatcatcatccagctgtctgaggtggacaagaccaaggaggagctgacagagcacatcaagaacctgcagacccagcaggccagcctgcagagcgagaacatctactttgaaagtgagaaccagaagctgcagcagaagctgaagatcatgacagagttctaccaggagaatgagatgaagctgtacaggaagctgactgtggaggagaactaccgcatcgaggaggaggagaagctgagccgggtggaggagaagatcagccgggccacagagggcctggagacctacaggaagctggccaaggacctggaggaggagctggagaggacagtgcacttctaccagaagcaggtgatctcctatgagaagaggggccatgacaactggctggccgccaggacagctgagaggaacctgagtgacctgaggaaagaaaatgcccacaacaagcagaagctgacagaaacagagctgaagtttgagctgctggagaaggaccccaatgccctggatgtgagcaacacagccttcggccgggagcacagcccctgcagccccagccccctgggccggcccagcagcgagacccgggccttccccagcccccagaccctgctggaggaccccctgcggctgagccctgtgctgcccggcggcggcggccggggccccagcagccctggcaaccccctggaccaccagatcaccaatgaaagaggagagcccagctatgaccggctgattgacccccaccgggcccccagcgacaccggcagcctgagcagccctgtggagcaggacaggaggatgatgttccccccacctggccagagctacccagacagcaccctgcccccccagcgggaggaccgcttctacagcaacagcgagcggctgagcggccctgctgagcccaggagcttcaagatgaccagcctggacaagatggaccgctccatgcccagcgagatggagagcagcagaaatgatgccaaggatgacctgggcaacctgaatgtgcctgacagcagcctgcctgcagaaaatgaggccactggacctggcttcatccccccacccctggcccctgtgcggggccccctcttccctgtggacacccggggccccttcatgaggcggggcccccccttccccccacctcctcctggcaccatgtttggagccagccggggctacttccccccccgggacttccctggcccccctcatgccccctttgccatgaggaacatctacccaccccggggcctgcccccctacctgcaccccaggcctggcttctaccccaaccccaccttctag

SEQ ID NO: 33653 - DNA, 2334 bp, Artificial Sequence
  Description of Artificial Sequence: Synthetic coding sequence
atggaggagcccggggccaccccccagccctacctgggcctggtgctggaggagctgggccgggtggtggccgccctgcctgagagcatgaggccagatgagaacccctacggcttccccagcgagctggtggtgtgtgccgccgtcatcggcttctttgtggtgctgctcttcctgtggaggagcttccgctctgtgcgcagccggctgtatgtgggccgggagcagaagctgggcgccaccctgagcggcctcatcgaggagaagtgcaagctgctggagaagttcagcctcatccagaaggagtatgagggctatgaggtggagagcagcctggaggatgccagctttgagaaggctgctgctgaggaggcccggagcctggaggccacctgtgagaagctgagccgcagcaacagcgagctggaggatgagatcctgtgcctggagaaggacctgaaggaggagaagagcaagcacagccagcaggatgagctgatggctgacatcagcaagagcatccagagcctggaggatgagagcaagagcctgaagagccagattgctgaggccaagatcatctgcaagaccttcaagatgtctgaggagcggcgggccatcgccatcaaggatgccctgaatgaaaacagccagctgcagaccagccacaagcagctgttccagcaggaggccgaggtgtggaagggccaggtgtctgagctgaacaagcagaagatcacctttgaggacagcaaggtgcatgctgagcaggtgctgaatgacaaggagaaccacatcaagaccctgaccggccacctgcccatgatgaaggaccaggccgctgtgctggaggaggacaccacagatgatgacaacctggagctgaaggtgaacagccagtgggagaatggagccaacctggatgacccccccaagggggccctgaagaagctgattcatgctgccaagctgaatgtgtccctgaagagcctggagggggagaggaaccacatcatcatccagctgtctgaggtggacaagaccaaggaggagctgacagagcacatcaagaacctgcagacccagcaggccagcctgcagagcgagaacatctactttgaaagtgagaaccagaagctgcagcagaagctgaagatcatgacagagttctaccaggagaatgagatgaagctgtacaggaagctgactgtggaggagaactaccgcatcgaggaggaggagaagctgagccgggtggaggagaagatcagccacgccacagaggagctggagacctacaggaagctggccaaggacctggaggaggagctggagaggacagtgcacttctaccagaagcaggtgatctcctatgagaagaggggccatgacaactggctggccgccaggacagctgagaggaacctgagtgacctgaggaaagaaaatgcccacaacaagcagaagctgacagagcgggagctgaagtttgagctgctggagaaggaccccaatgccctggatgtgagcaacacagccttcggccgggagcacagcccctgcagccccagccccctgggccggcccagcagcgagacccgggccttccccagcccccagaccctgctggaggaccccctgcggctgagccctgtgctgcccggcggcggcggccggggccccagcagccctggcaaccccctggaccaccagatcaccaatgaaagaggagagcccagctatgaccggctgattgacccccaccgggcccccagcgacaccggcagcctgagcagccctgtggagcaggacaggaggatgatgttccccccacctggccagagctacccagacagcaccctgcccccccagcgggaggaccgcttctacagcaacagcgagcggctgagcggccctgctgagcccaggagcttcaagatgaccagcctggacaagatggaccgctccatgcccagcgagatggagagcagcagaaatgatgccaaggatgacctgggcaacctgaatgtgcctgacagcagcctgcctgcagaaaatgaggccactggacctggcctcatccccccacccctggcccccatcagcggccccctcttccctgtggacacccggggccccttcatgaggcggggcccccccttccccccacctcctcctggcaccatgtttggagccagccggggctacttccccccccgggacttccctggcccccctcatgccccctttgccatgaggaacatctacccaccccggggcctgcccccctacctgcaccccaggcctggcttctaccccaaccccaccttctag

SEQ ID NO: 33654 - DNA, 735 bp, Artificial Sequence
  Description of Artificial Sequence: Synthetic coding sequence
atgatgaggacccagtgcctgctgggcctgcggacctttgtggcctttgctgccaagctgtggagcttcttcatctacctgctgcggcggcagatccgcaccgtcatccagtaccagacagtgcgctatgacatcctgcccctgagccctgtgtccaggaaccggctggcccaggtgaagaggaagatcctggtgctggacctggatgagaccctcatccacagccaccatgatggagtgctgcggcccaccgtgcggcccggcaccccaccagacttcatcctgaaggtggtgattgacaagcaccctgtgcgcttctttgtgcacaagaggcctcatgtggacttcttcctggaggtggtgtcccagtggtatgagctggtggtgttcaccgcctccatggagatctacggcagcgctgtggccgacaagctggacaacagccgcagcatcctgaagaggcgctactaccggcagcactgcaccctggagctgggcagctacatcaaggacctgtctgtggtgcacagcgacctgagcagcatcgtcatcctggacaacagccctggggcctaccgcagccacccagacaatgccatccccatcaagtcctggttcagtgaccccagcgacacagccctgctgaacctgctgcccatgctggatgccctgcgcttcaccgcagatgtgcgctctgtgctgagcaggaacctgcaccagcaccggctgtggtag

SEQ ID NO: 33655 - DNA, 735 bp, Artificial Sequence; identical to SEQ ID NO: 33654
  Description of Artificial Sequence: Synthetic coding sequence

SEQ ID NO: 33656 - DNA, 690 bp, Artificial Sequence
  Description of Artificial Sequence: Synthetic coding sequence
atgcaggatgaagatggctacatcaccctgaacatcaagaccaggaagccagccctgatctctgtgggcagcgccagcagctcctggtggagggtgatggccctgatcctgctgatcctgtgtgtgggcatggtggtgggcctggtggccctgggcatctggagcgtgatgcagaggaactacctgcagggagaaaatgaaaatagaacaggcaccctgcagcagctggccaagcgcttctgccagtatgtggtgaagcagagcgagctgaagggcaccttcaagggccacaagtgcagcccctgtgacaccaactggagatactatggagacagctgctacggcttcttccgccacaacctgacctgggaggagagcaagcagtactgcacagacatgaatgccaccctgctgaagattgacaacagaaatattgtggagtacatcaaggcccggacccacctgatccgctgggtgggcctgagccggcagaagagcaatgaggtgtggaagtgggaggatggcagcgtcatcagcgagaacatgtttgagttcctggaggatggcaagggcaacatgaactgtgcctacttccacaacgggaagatgcaccccaccttctgtgagaacaagcactacctgatgtgtgagaggaaggccggcatgaccaaggtggaccagctgccctag

SEQ ID NO: 33657 - DNA, 591 bp, Artificial Sequence
  Description of Artificial Sequence: Synthetic coding sequence
atgcaggatgaagatggctacatcaccctgaacatcaagaccaggaagccagccctgatctctgctgtgatgcagaggaactacctgcagggagaaaatgaaaatagaacaggcaccctgcagcagctggccaagcgcttctgccagtatgtggtgaagcagagcgagctgaagggcaccttcaagggccacaagtgcagcccctgtgacaccaactggagatactacggggacagctgctacggcttcttccgccacaacctgacctgggaggagagcaagcagtactgcacagacatgaatgccaccctgctgaagattgacaacagaaacatcgtggagtacatcaaggcccggacccacctgatccgctgggtgggcctgagccggcagaagagcaatgaggtgtggaagtgggaggatggcagcgtcatcagcgagaacatgtttgagttcctggaggatggaaaaggaaacatgaactgtgcctacttccacaacgggaagatgcaccccaccttctgtgagaacaagcactacctgatgtgtgagaggaaggccggcatgaccaaggtggaccagctgccctag

SEQ ID NO: 33658 - DNA, 417 bp, Artificial Sequence
  Description of Artificial Sequence: Synthetic coding sequence
cacaagtgcagcccctgtgacaccaactggagatactatggagacagctgctacggcttcttccgccacaacctgacctgggaggagagcaagcagtactgcacagacatgaatgccaccctgctgaagattgacagcaaggaggagaagctgttcctgaccagcttccgcatcctgaccatcgtgttcatctgggtgggcctgagccggcagaagagcaatgaggtgtggaagtgggaggatggcagcgtcatcagtgacagcctcttcagccagagcaacttccagaatggaaaaggaaacatgaactgtgcctacttccacaacgggaagatgcaccccaccttctgtgagaacaagcactacctgatgtgtgagaggaaggccggcatgaccaaggtggaccagctgccctag

SEQ ID NO: 33659 - DNA, 591 bp, Artificial Sequence; identical to SEQ ID NO: 33657
  Description of Artificial Sequence: Synthetic coding sequence

SEQ ID NO: 33660 - DNA, 831 bp, Artificial Sequence
  Description of Artificial Sequence: Synthetic coding sequence
atgtctgaggaggtgacctacgccaccctgaccttccaggacagcgctggggccaggaacaacagagatggcaacaacctgaggaagaggggccacccagcccccagccccatctggaggcatgctgccctgggcctggtgaccctgtgcctgatgctgctgattggcctggtgaccctgggcatgatgttcctgcagatcagcaatgacatcaacagcgacagcgagaagctgagccagctgcagaagaccatccagcagcagcaggacaacctgagccagcagctgggcaacagcaacaacctgtccatggaggaggagttcctgaagagccagatcagctctgtgctgaagaggcaggagcagatggccatcaagctgtgccaggagctgatcatccacaccagtgaccaccgctgcaacccctgccccaagatgtggcagtggtaccagaacagctgctactacttcaccaccaatgaggagaagacctgggccaacagcaggaaggactgcatcgacaagaacagcaccctggtgaagattgacagcctggaggagaaggacttcctgatgagccagcccctgctgatgttctccttcttctggctgggcctgtcctgggacagcagcggccgctcctggttctgggaggatggctctgtgcccagccccagcctcttcagcaccaaggagctggaccagatcaatggcagcaagggctgtgcctacttccagaagggcaacatctacatcagccgctgcagcgctgagatcttctggatctgtgagaagacagctgcccctgtgaagacagaggacctggactag

SEQ ID NO: 33661 - DNA, 699 bp, Artificial Sequence
  Description of Artificial Sequence: Synthetic coding sequence
atgtctgaggaggtgacctacgccaccctgaccttccaggacagcgctggggccaggaacaacagagatggcaacaacctgaggaagaggggccacccagcccccagccccatctggaggcatgctgccctgggcctggtgaccctgtgcctgatgctgctgattggcctggtgaccctgggcatgatgttcctgcagatcagcaatgacatcaacagcgacagcgagaagctgagccagctgcagaagaccatccagcagcagcaggacaacctgagccagcagctgggcaacagcaacaacctgtccatggaggaggagttcctgaagagccagatcagctctgtgctgaagaggcaggagcagatggccatcaagctgtgccaggagctgatcatccacaccagtgaccaccgctgcaacccctgccccaagatgtggcagtggtaccagaacagctgctactacttcaccaccaatgaggagaagacctgggccaacagcaggaaggactgcatcgacaagaacagcaccctggtgaagattgacagcctggaggagaaggacttcctgatgagccagcccctgctgatgttctccttcttctggctgggcctgtcctgggacagcagcggccgctcctggttctgggaggatggctctgtgcccagccccagcctgtatgtgagcaactactag

SEQ ID NO: 33662 - DNA, 1473 bp, Artificial Sequence
  Description of Artificial Sequence: Synthetic coding sequence
atgaggcctgcctttgccctgtgcctgctgtggcaggccctgtggccaggccctgggggcggggagcaccccacagctgacagagctggctgcagcgccagcggggcctgctacagcctgcaccacgccaccatgaagaggcaggccgctgaggaggcctgcatcctgcggggcggggccctgagcacagtgcgggccggggctgagctgcgggctgtgctggccctgctgcgggccggccctggccctgggggcggcagcaaggacctgctcttctgggtggccctggagaggagaagaagccactgcaccctggagaatgagcccctgcggggcttctcctggctgagcagtgaccccggcggcctggagagtgacaccctgcagtgggtggaggagccccagaggagctgcacagcccggcgctgtgctgtgctgcaggccactggaggagtggagcctgctggctggaaggagatgcgctgccacctgcgggccaacggctacctgtgcaagtaccagtttgaggtgctgtgcccagcccccaggcctggggccgccagcaacctgagctaccgggcccccttccagctgcacagcgctgccctggacttcagccccccaggcacagaggtgtctgccctgtgccggggccagctgcccatctctgtgacctgcatcgcagatgaaattggagcccgctgggacaagctgtctggagatgtgctgtgcccctgccccggccgctacctgcgggccgggaaatgtgccgagctgcccaactgcctggatgacctgggcggctttgcctgtgaatgtgccactggatttgagctgggcaaggatggccgcagctgtgtgaccagcggggagggccagcccaccctgggcggcactggagtgcccacccggcggcccccagccacagccaccagccctgtgccccagaggacctggcccatccgggtggatgagaagctgggggagacccccctggtgcctgagcaggacaacagcgtgaccagcatccctgagatcccccgctggggcagccagagcaccatgagcaccctgcagatgagcctgcaggccgagagcaaggccaccatcaccccatctggcagcgtcatcagcaagttcaacagcaccaccagcagcgccaccccccaggcctttgacagcagcagcgctgtggtgttcatctttgtgtccacagctgtggtggtgctggtgatcctgaccatgacagtgctgggcctggtgaagctgtgcttccacgagagccccagcagccagcccaggaaggagagcatgggccccccaggcctggagagtgaccctgagcctgctgccctgggcagcagcagcgcccactgcaccaacaacggggtgaaggtgggggactgtgacctgcgggacagagctgagggcgccctgctggccgagagccccctgggcagcagtgatgcctag

SEQ ID NO: 33663 - DNA, 633 bp, Artificial Sequence
  Description of Artificial Sequence: Synthetic coding sequence
ggcaccaacagccgggccatgtgctgcgtgcccccaggccgctacctgcgggccgggaaatgtgccgagctgcccaactgcctggatgacctgggcggctttgcctgtgaatgtgccaccggctttgagctgggcaaggatggccgcagctgtgtgaccagcggggagggccagcccaccctgggcggcaccggggtgcccacccggcggcccccagccacagccaccagccctgtgccccagaggacctggcccatccgggtggatgagaagctgggggagacccccctggtgcctgagcaggacaacagcgtgaccagcatccctgagatcccccgctggggcagccagagcaccatgagcaccctgcagatgagcctgcaggccgagagcaaggccaccatcacccccagcggcagcgtcatcagcaagttcaacagcaccaccagcagcgccaccccccaggcctttgacagcagcagcgctgtggtgttcatctttgtgtccacagctgtggtggtgctggtgatcctgaccatgacagtgctgggcctggtgaagctgtgcttccacgagagccccagcagccagcccaggaaggagagcatgggccccccaggcctggagagctag

SEQ ID NO: 33664 - DNA, 870 bp, Artificial Sequence
  Description of Artificial Sequence: Synthetic coding sequence
atgcacaacctgtacagcatcaccggctacccagaccccccaggcaccatggaggaggaggaggaggatgatgattatgagaacagcaccccaccctacaaggacctgccccccaagccaggcaccatggaggaggaggaggaggatgatgattatgagaacagcaccccaccctacaaggacctgccccccaagccagccctgaccctgtccttcagcagccctggcagcagcgccccacccaggcctccccgggccgccaaggagacagagaagccacccctgccctgcaagcccaggaacatgacaggcctggacctggccgctgtgacctgccccccaccccagctggccgtgaacctggagcccagccccctgcagcccagcctggccgccacccctgtgccctggctgaaccagaggtctgggggccctggctgctgccagaagcgctggatggtgtacctgtgcctgctggtggtgaccagcctcttcctgggctgcctgggcctgactgtgaccctcatcaagtaccaggagctgatggaggagctgaggatgctgtccttccagcagatgacctggaggaccaacatgacaggcatggccggcctggccggcctgaagcatgacatcgcccgggtgcgggctgacaccaaccagagcctggtggagctgtggggcctgctggactgccgccgcatcacctgcccagagggctggctgccctttgagggcaagtgctactacttcagccccagcaccaagtcctgggatgaggccaggatgttctgccaggagaactacagccacctggtgatcatcaacagctttgctgagcacctgctgggcgcccggggcacccagtag

SEQ ID NO: 33665 - DNA, 1137 bp, Artificial Sequence
  Description of Artificial Sequence: Synthetic coding sequence
atgcacaacctgtacagcatcaccggctacccagaccccccaggcaccatggaggaggaggaggaggatgatgattatgagaacagcaccccaccctacaaggacctgccccccaagccaggcaccatggaggaggaggaggaggatgatgattatgagaacagcaccccaccctacaaggacctgccccccaagccaggcaccatggaggaggaggaggaggatgatgattatgagaacagcaccccaccctacaaggacctgccccccaagccaggcagcagcgccccaccccggccccccagggctgccaaggagacagagaagccacccctgccctgcaagcccaggaacatgacaggcctggacctggccgctgtgacctgccccccaccccagctggccgtgaacctggagcccagccccctgcagcccagcctggccgccacccctgtgccctggctgaaccagaggtctgggggccctggctgctgccagaagcgctggatggtgtacctgtgcctgctggtggtgaccagcctcttcctgggctgcctgggcctgactgtgaccctcatcaagtaccaggagctgatggaggagctgaggatgctgtccttccagcagatgacctggaggaccaacatgacaggcatggccggcctggccggcctgaagcatgacatcgcccgggtgcgggctgacaccaaccagagcctggtggagctgtggggcctgctggactgccgccgcatcacctgcccagagggctggctgccctttgagggcaagtgctactacttcagccccagcaccaagtcctgggatgaggccaggatgttctgccaggagaactacagccacctggtgatcatcaacagctttgctgagcacaactttgtggccaaggcccacggcagcccccgggtgtactggctgggcctgaatgaccgggcccaggagggggactggcgctggctggatggcagccctgtgaccctgtccttctgggagcctgaggagcccaacaacatccatgatgaggactgtgccaccatgaacaagggcggcacctggaatgacctgagctgctacaagaccacctactggatctgtgagaggaagtgcagctgctag

SEQ ID NO: 33666 - DNA, 921 bp, Artificial Sequence
  Description of Artificial Sequence: Synthetic coding sequence
atgcacaacctgtacagcatcaccggctacccagaccccccaggcaccatggaggaggaggaggaggatgatgattatgagaacagcaccccaccctacaaggacctgccccccaagccaggcaccatggaggaggaggaggaggatgatgattatgagaacagcaccccaccctacaaggacctgccccccaagccaggcaccatggaggaggaggaggaggatgatgattatgagaacagcaccccaccctacaaggacctgccccccaagccaggcagcagcgccccaccccggccccccagggctgccaaggagacagagaagccacccctgccctgcaagcccaggaacatgacaggcctggacctggccgctgtgacctgccccccaccccagctggccgtgaacctggagcccagccccctgcagcccagcctggccgccacccctgtgccctggctgaaccagaggtctgggggccctggctgctgccagaagcgctggatggtgtacctgtgcctgctggtggtgaccagcctcttcctgggctgcctgggcctgactgtgaccctcatcaagtaccaggagctgatggaggagctgaggatgctgtccttccagcagatgacctggaggaccaacatgacaggcatggccggcctggccggcctgaagcatgacatcgcccgggtgcgggctgacaccaaccagagcctggtggagctgtggggcctgctggactgccgccgcatcacctgcccagagggctggctgccctttgagggcaagtgctactacttcagccccagcaccaagtcctgggatgaggccaggatgttctgccaggagaactacagccacctggtgatcatcaacagctttgctgagcacctgctgggcgcccggggcacccagtag

SEQ ID NO: 33667 - DNA, 1770 bp, Artificial Sequence
  Description of Artificial Sequence: Synthetic coding sequence
atggatggagaggccgtgcgcttctgcacagacaaccagtgtgtgtccctgcacccccaggaggtggacagcgtggccatggccccagctgcccccaagatcccccggctggtgcaggccaccccagccttcatggctgtgaccctggtgttcagcctggtgaccctgtttgtggtggtgcagcagcagaccaggcctgtgcccaagcctgtgcaggccgtcatcctgggggacaacatcaccggccacctgccctttgagcccaacaaccaccaccacttcggccgggaggccgagatgagggagctgatccagaccttcaagggccacatggagaacagcagcgcctgggtggtggagatccagatgctgaagtgccgggtggacaacgtgaacagccagctgcaggtgctgggggaccacctgggcaacaccaatgctgacatccagatggtgaagggcgtgctgaaggatgccaccaccctgagcctgcagacccagatgctgcggagcagcctggagggcaccaatgctgagatccagaggctgaaggaggacctggagaaggcagatgccctgaccttccagaccctgaacttcctgaagagcagcctggagaacaccagcattgagctgcacgtgctgagccggggcctggagaatgccaacagcgagatccagatgctgaatgccagcctggagacagccaacacccaggcccagctggccaacagcagcctgaagaatgccaatgctgagatctacgtgctgcggggccacctggacagcgtgaatgacctgcggacccagaaccaggtgctgaggaacagcctggagggcgccaatgctgagatccagggcctgaaggagaacctgcagaacaccaatgccctgaacagccagacccaggccttcatcaagagcagctttgacaacaccagcgctgagatccagttcctgcggggccacctggagagagctggagatgagatccacgtgctgaagagggacctgaagatggtgacagcccagacccagaaggccaacggccgcctggaccagacagacacccagatccaggtgttcaagtctgagatggagaatgtgaacaccctgaatgcccagatccaggtgctgaatggccacatgaagaatgccagccgggagatccagaccctgaagcagggcatgaagaatgccagcgccctgaccagccagacccagatgctggacagcaacctgcagaaggccagcgctgagatccagaggctgcggggggacctggagaacaccaaggccctgaccatggagatccagcaggagcagagccggctgaagaccctgcacgtggtgatcaccagccaggagcagctgcagaggacccagagccagctgctgcagatggtgctgcagggctggaagttcaacggcggcagcctgtactacttcagctctgtgaagaagtcctggcatgaagctgagcagttctgtgtgtcccagggcgcccacctggcctctgtggccagcaaggaggagcaggccttcctggtggagttcaccagcaaggtgtactactggattggcctgacagaccggggcacagagggctcctggcgctggacagatggcacccccttcaatgctgcccagaacaaggcccctggcagcaagggcagctgccccctgaggaagtacatcatcgtgaacagcggcatgggcgcctgcagcttcatcgacaccccaccctgcccctggatcctgagcaactag

SEQ ID NO: 33668 - DNA, 882 bp, Artificial Sequence
  Description of Artificial Sequence: Synthetic coding sequence
atggacaccacccgctacagcaagtggggcggcagcagcgaggaggtgcctgggggcccctggggccgctgggtgcactggagcagaagacccctcttcctggccctggccgtgctggtgaccaccgtgctgtgggccgtcatcctgagcatcctgctgagcaaggccagcacagaaagagctgccctgctggatggccatgacctgctgcggaccaatgccagcaagcagacagctgccctgggcgccctgaaggaggaggtgggggactgccacagctgctgcagcggcacccaggcccagctgcagaccaccagggctgagctgggggaggcccaggccaagctgatggagcaggagagcgccctgcgggagctgcgggagcgggtgacccagggcctggccgaggccggccggggccgggaggatgtgaggacagagctgttccgggccctggaggccgtgcggctgcagaacaacagctgtgagccctgccccacctcctggctgagctttgagggcagctgctacttcttctctgtgcccaagaccacctgggccgccgcccaggaccactgtgctgatgccagcgcccacctggtgattgtgggcggcctggatgagcagggcttcctgaccaggaacacccggggccggggctactggctgggcctgcgggctgtgcgccacctgggcaaggtgcagggctaccagtgggtggatggagtgtccctgtccttcagccactggaaccagggcgagcccaatgatgcctggggccgggagaactgtgtgatgatgctgcacacaggcctgtggaatgatgccccctgtgacagcgagaaggatggctggatctgtgagaagaggcacaactgctag

SEQ ID NO: 33669 - DNA, 759 bp, Artificial Sequence
  Description of Artificial Sequence: Synthetic coding sequence
atggagcaggagagcgccctgcgggagctgcgggagcgggtgacccagggcctggccgaggccggccggggccgggaggatgtgaggacagagctgttccgggccctggaggccgtgcggctgcagaacaacagctgtgagccctgccccacctcctggctgagctttgagggcagctgctacttcttctctgtgcccaagaccacctgggccgccgcccaggaccactgtgctgatgccagcgcccacctggtgattgtgggcggcctggatgagcagggcttcctgaccaggaacacccggggccggggctactggctgggcctgcgggctgtgcgccacctgggcaaggtgcagggctaccagtgggtggatggagtgtccctgtccttcagccactggaaccagggcgagcccaatgatgcctggggccgggagaactgtgtgatgatgctgcacacaggcctgtggaatgatgccccctgtgacagcgagaaggatggctggatctgtgagaaggcccagctgctgaccccaccttctgccctggagccccggcccctgcagcacgtggtgtcctggggcctgctgaccagcctggcccctggagctgactgccagagggtcttcagcagcagcagcacagctgctgagagccagaagcacctggcccagcacagccctgtgcagcccagcgcctgggccctgggccccccctgccggccccaccccaacagcacccatgctgaccccacctag

SEQ ID NO: 33670 - DNA, 726 bp, Artificial Sequence
  Description of Artificial Sequence: Synthetic coding sequence
atgcatgaggaggagatctacaccagcctgcagtgggacagccctgccccagacacctaccagaagtgcctgagcagcaacaagtgcagcggggcctgctgcctggtgatggtgatcagctgtgtgttctgcatgggcctgctgacagccagcatcttcctgggcgtgaagctgctgcaggtgtccaccatcgccatgcagcagcaggagaagctgatccagcaggagcgggccctgctgaacttcacagagtggaagaggagctgtgccctgcagatgaagtactgccaggccttcatgcagaacagcctgagcagcgcccacaacagcagcccctgccccaacaactggatccagaaccgggagagctgctactacgtgtctgagatctggagcatctggcacaccagccaggagaactgcctgaaggagggcagcaccctgctgcagatcgagagcaaggaggagatggacttcatcaccggcagcctgaggaagatcaagggcagctatgactactgggtgggcctgagccaggacggccacagcggccgctggctgtggcaggacggcagcagccccagccctggcctgctgcctgctgagaggagccagagcgccaaccaggtgtgtggctacgtgaagagcaacagcctgctgagcagcaactgcagcacctggaagtacttcatctgtgagaagtatgccctgcggagctctgtgtag

SEQ ID NO: 33671 - DNA, 504 bp, Artificial Sequence
  Description of Artificial Sequence: Synthetic coding sequence
atggtgagcaacttcttccacgtgatccaggtgtttgagaagagcgccaccctcatcagcaagacagagcacatcggctttgtgatctacagctggaggaagagcaccacccacctgggcagcaggaggaagtttgccatcagcatctacctgtctgaggtgtccctgcagaagtatgactgccccttcagcggcaccagctttgtggtgttcagcctcttcctgatctgtgccatggctggagatgtggtgtatgctgacatcaagacagtgaggaccagccccctggagctggccttccccctgcagaggtctgtgtccttcaacttcagcacagtgcacaagagctgcccagccaaggactggaaggtgcacaagggcaagtgctactggattgctgagaccaagaagtcctggaacaagagccagaatgactgtgccatcaacaacagctacctgatggtgatccaggacatcacagccatggtgcgcttcaacatctag

SEQ ID NO: 33672 - DNA, 108 bp, Artificial Sequence
  Description of Artificial Sequence: Synthetic coding sequence
caggacatcacagccatgctgatcaccttcctgctgtacctgcagatggccttcctgcagtgtgtgtacatcagtgatgtgtctgtgtaccccaacttcttcctgtag

SEQ ID NO: 33673 - DNA, 726 bp, Artificial Sequence
  Description of Artificial Sequence: Synthetic coding sequence
atgggccacaacagcacagtggagatcatctacatcacagaagatgatgtgatccagagccagaatgccctgggcaagtacaacacctccatggccctgtttgagagcaacagctttgagaagaccatcctggagagcccctactacgtggacctgaaccagaccctgtttgtgcaggtgtccctgcacaccagtgaccccaacctggtggtgttcctggacacctgccgggccagccccaccagtgactttgccagccccacctatgacctgatcaagagcggctgcagcagagatgagacctgcaaggtgtaccccctgtttggccactacggccgcttccagttcaatgccttcaagttcctgcgctccatgagctctgtgtacctgcagtgcaaggtgctgatctgtgacagcagtgaccaccagagccgctgcaaccagggctgtgtgagccgcagcaagagggacatcagcagctacaagtggaagacagacagcatcatcggccccatccggctgaagagggacagaagtgccagcggcaacagcggcttccagcacgagacccacgccgaggagacccccaaccagcccttcaacagcgtgcacctgttctccttcatggtgctggccctgaatgtggtgacagtggccaccatcaccgtgcgccactttgtgaaccagagagctgactacaagtaccagaagctgcagaactactag

SEQ ID NO: 33674 - DNA, 981 bp, Artificial Sequence
  Description of Artificial Sequence: Synthetic coding sequence
atgagggtcatcatcagcaagagctacctggaggccttcaacagcaatggaaacaacctgcagctgaaggaccccacctgccggcccaagctgagcaatgtggtggagttctctgtgcccctgaatggctgcggcaccatcaggaaggtggaggaccagagcatcacctacaccaacatcatcaccttcagcgccagcagcaccagcgaggtgatcacccggcagaagcagctgcagatcatcgtgaagtgtgagatgggccacaacagcacagtggagatcatctacatcacagaagatgatgtgatccagagccagaatgccctgggcaagtacaacacctccatggccctgtttgagagcaacagctttgagaagaccatcctggagagcccctactacgtggacctgaaccagaccctgtttgtgcaggtgtccctgcacaccagtgaccccaacctggtggtgttcctggacacctgccgggccagccccaccagtgactttgccagccccacctatgacctgatcaagagcggctgcagcagagatgagacctgcaaggtgtaccccctgtttggccactacggccgcttccagttcaatgccttcaagttcctgcgctccatgagctctgtgtacctgcagtgcaaggtgctgatctgtgacagcagtgaccaccagagccgctgcaaccagggctgtgtgagccgcagcaagagggacatcagcagctacaagtggaagacagacagcatcatcggccccatccggctgaagagggacagaagtgccagcggcaacagcggcttccagcacgagacccatgctgaggagacccccaaccagcccttcaacagcgtgcacctgttctccttcatggtgctggccctgaatgtggtgacagtggccaccatcaccgtgcgccactttgtgaaccagagagctgactacaagtaccagaagctgcagaactactag

SEQ ID NO: 33675 - DNA, 981 bp, Artificial Sequence; identical to SEQ ID NO: 33674
  Description of Artificial Sequence: Synthetic coding sequence

SEQ ID NO: 33676 - DNA, 981 bp, Artificial Sequence; identical to SEQ ID NO: 33674
  Description of Artificial Sequence: Synthetic coding sequence

SEQ ID NO: 33677 - DNA, 1824 bp, Artificial Sequence
  Description of Artificial Sequence: Synthetic coding sequence
atggagctggtgcggcggctgatgcccctgaccctgctgatcctgagctgcctggccgagctgaccatggccgaggccgagggcaatgccagctgcaccgtgtccctgggcggggccaacatggccgagacccacaaggccatgatcctgcagctgaaccccagcgagaactgcacctggaccatcgagaggcctgagaacaagagcatccgcatcatcttctcctatgtgcagctggaccctgatggcagctgtgagagcgagaacatcaaggtgtttgatggcaccagcagcaatggccccctgctgggccaggtgtgcagcaagaatgactatgtgcctgtgtttgagagcagcagcagcaccctgaccttccagatcgtgacagattctgcccgcatccagaggacagtgtttgtgttctactacttcttcagccccaacatcagcatccccaactgtggcggctacctggacaccctggagggcagcttcaccagccccaactaccccaagccccaccctgagctggcctactgtgtgtggcacatccaggtggagaaggactacaagatcaagctgaacttcaaggagatcttcctggagattgacaagcagtgcaagtttgacttcctggccatctatgatggccccagcaccaacagcggcctgattggccaggtgtgtggccgggtgacccccacctttgagagcagcagcaacagcctgactgtggtgctgagcacagattatgccaacagctaccggggcttcagcgccagctacaccagcatctatgcagagaacatcaacaccaccagcctgacctgcagcagtgacaggatgagggtcatcatcagcaagagctacctggaggccttcaacagcaatggaaacaacctgcagctgaaggaccccacctgccggcccaagctgagcaatgtggtggagttctctgtgcccctgaatggctgcggcaccatcaggaaggtggaggaccagagcatcacctacaccaacatcatcaccttcagcgccagcagcaccagcgaggtgatcacccggcagaagcagctgcagatcatcgtgaagtgtgagatgggccacaacagcacagtggagatcatctacatcacagaagatgatgtgatccagagccagaatgccctgggcaagtacaacacctccatggccctgtttgagagcaacagctttgagaagaccatcctggagagcccctactacgtggacctgaaccagaccctgtttgtgcaggtgtccctgcacaccagtgaccccaacctggtggtgttcctggacacctgccgggccagccccaccagtgactttgccagccccacctatgacctgatcaagagcggctgcagcagagatgagacctgcaaggtgtaccccctgtttggccactacggccgcttccagttcaatgccttcaagttcctgcgctccatgagctctgtgtacctgcagtgcaaggtgctgatctgtgacagcagtgaccaccagagccgctgcaaccagggctgtgtgagccgcagcaagagggacatcagcagctacaagtggaagacagacagcatcatcggccccatccggctgaagagggacagaagtgccagcggcaacagcggcttccagcacgagacccacgccgaggagacccccaaccagcccttcaacagcgtgcacctgttctccttcatggtgctggccctgaatgtggtgacagtggccaccatcaccgtgcgccactttgtgaaccagagagctgactacaagtaccagaagctgcagaactactag

SEQ ID NO: 33678 - DNA, 2238 bp, Artificial Sequence
  Description of Artificial Sequence: Synthetic coding sequence
atgaggccagacagccacccctacggcttcccctgggagctggtgatccgggctgctgtggccggcttctttgctgtgctcttcctgtggaggagcttccgctctgtgaccagccggctgtatgtgagaagagagaagaagtttgctgtggccctgagcggcctcatcgaggagaagtgcaagctgctggagaagttcagcctggtgcagaaggagtatgagggctatgaggtggagagcagcctgaagaatgccagctttgagaaggaggccacagaggcccagagcctggaggccacctgtgagaagctgaaccgcttcaacagcgagctggtgcatgagatcctgtgcctggagaaggagctgaaggaggagaagagcaagcacagcgagcagaatgagctgatggctgacatcagcaagaggatccagagcctggaggatgagagcaagagcctgaagagccaggtggccgaggccaagatgaccttcaagcgcttccaggccaatgaggagcggctggagattgagatccaggatgcctggaaggagaacagcgagctgcaggagagccagaagcagctgctgcaggaggccgaggtgtggaaggagcaggtgtctgagctgatcaagcagaagaggacctttgaggacagcaaggtgcatgctgagcaggtgctgaatgacaaggagaaccacatcaagaccctgacagagcggctgctgaagatgaaggatggagtggccatgctggaggaggatgtgacagatgatgacaacctggagctggagatgaacagcgagagtgaagatggagcctacctggacaacccccccaagggggccctgaagaagctgattcatgctgccaagctgaatgccagcctgaagaccctggagggggagaggaaccagatctacatccagctgtctgaggtggacaagaccaaggaggagctgacagagcacatcaagaacctgcagacagagcaggccagcctgcagagcgagaacacccactttgaaagtgagaaccagaagctgcagcagaagctgaaggtgatgacagagctgtaccaggagaatgagatgaagctgtacaggaagctgattgtggaggagaagtgccgcctggagaaggaggagaagctgagcaaggtggatgagatgatcagccacgccacagaggagctggagacctacaggaagagggccaaggacctgaaggagtttgagaagaccatccacttctaccagaagaagatcatcctgcacgagaagaaggcccatgacaactggagcgctgcctggacagctgagaggaacctgaatgacctgaggaaagaaaatgcccacaaccggcagaagctgacagaaattgagttcaagatcaagctgctggagaaggacccctacggcctggatgtgcccaacacagccttcggccggcagcacagcccctacggccccagccccctgggctggcccagcagcgagacccgggccagcctgtacccacccaccctgctggagggccccctgcggctgagccccctgctgccccggggcggcggccggggcagccggggccctggcaaccccccagaccaccagatcaccaaggagcggggggagagcagctgtgaccggctgacagacccccaccgggcccccagtgatgctggccccctggccccaccctgggagcaggactacaggatgatgtttcctcctcctggccagagctacccagacagcgccctgcccccccagaggcaggaccgcttctacagcaactgtgcccggctgagcggccctgctgagctgcgctccttcaacatgcccagcctggacaagatggatggctccatgcccagcgagatggagagcagcagaaatgacaccaaggacaacctgggcaacctgaaggtgcctgacagcagcctgcctgcagaaaatgaggccaccggccctggctttgtgcccccacccctggcccccatccggggcctgctcttccctgtggacacccggggccccttcatcagaagaggcccccccttccccccacctcctcctggcaccgtgtttggagccagcccagactacttcagccccagagatgtgcccggccccccccgggccccctttgccatgagaaatgtgtacctgccccggggcttcctgccctacagaccacccaggcctgccttcttccccccagcccccaccttctag

SEQ ID NO: 33679 - DNA, 225 bp, Artificial Sequence
  Description of Artificial Sequence: Synthetic coding sequence
atgtttgtgatcatcagcctgcacaactgtgtggtgatcagctttgtgctcttcctgtttggaggcaacaacttcatccagaacttctacctgccccagaactacatcgaccagttcctgctgaccagcttccccaccttcacctctgtgggcgtgctgattgtgctggtgctgtgcagcgccttcctgctgctgtggcagggcgagggcgtgaacctgaggtag

SEQ ID NO: 33680 - DNA, 4518 bp, Artificial Sequence
  Description of Artificial Sequence: Synthetic coding sequence
atgctgtgtgtggccggggcccggctgaagcgggagctggatgccacagccaccgtgctggccaaccggcaggatgaaagtgagcagagcaggaagaggctgattgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcagcgcccggaggaagggcaaggaccagcctgagagcagaagacctggcagcctgcctgcccccccacccagccagctgcccaggaaccctggagagcaggccagcaacaccaacggcacccaccagttctccccagctggcctgagccaggacttcttcagcagcagcctggccagccccagcctgcccctggccagcacaggcaagtttgccctgaacagcctgctgcagaggcagctgatgcagagcttctacagcaaggccatgcaggaggccggcagcacctccatgatcttcagcacaggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagcgggagaaccctggccagagcctgaacagactcttccaggaggtgcccaagagaagaaatggcagcgagggcaacatcaccacccgcatccgggccagcgagactggaagtgatgaggccatcaagagcatcctggagcaggccaagcgggagctgcaggtgcagaagacagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgagcagctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagaccggcggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgaccggggccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgtcctctgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagaggaggcacagctctgtgtctgacagccagccctgtgagcccccatctgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatccggcgggagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccacccagcggcaccccaggcccagatgatgccagagatgatgaccatgaaggaggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33681 - DNA, 2037 bp, Artificial Sequence
  Description of Artificial Sequence: Synthetic coding sequence
atggccgccaacgtgggctccatgttccagtactggaagagatttgacctgcagcagctgcagcgggagctggatgccacagccaccgtgctggccaaccggcaggatgagagcgagcagagcaggaagaggctcatcgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacatcgagacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaagctgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggccgagaaccggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaatggagctgctgctggggacctgtggcagtag

SEQ ID NO: 33682 - DNA, 4551 bp, Artificial Sequence
  Description of Artificial Sequence: Synthetic coding sequence
atggccgccaacgtgggctccatgttccagtactggaagagatttgacctgcagcagctgcagcgggagctggatgccacagccaccgtgctggccaaccggcaggatgagagcgagcagagcaggaagaggctcatcgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacatcgagacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcagcgcccggaggaagggcaaggaccagcctgagagccggcggcccggcagcctgcctgcccccccacccagccagctgcccagaaatcctggagagcaggccagcaacaccaacggcacccaccagttcagccctgctggcctgagccaggacttcttcagcagcagcctggccagccccagcctgcccctggccagcacaggcaagtttgccctgaacagcctgctgcagaggcagctgatgcagagcttctacagcaaggccatgcaggaggccggcagcacctccatgatcttcagcacaggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagagagaaaatcctggccagagcctgaacagactcttccaggaggtgcccaagagaagaaatggaagtgagggcaacatcaccacccgcatccgggccagcgagaccggcagtgatgaggccatcaagagcatcctggagcaggccaagcgggagctgcaggtgcagaagacagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgtcctcctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagactggaggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgactggagccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgagcagcgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagagaagacacagctctgtgtctgacagccagccctgtgagccccccagcgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatcagaagagagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccaccttctggcaccccaggcccagatgatgccagagatgatgaccacgagggcggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33683 - DNA, 1920 bp, Artificial Sequence
  Description of Artificial Sequence: Synthetic coding sequence
atggccgccaacgtgggctccatgttccagtactggaagagatttgacctgcagcagctgcaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaggccgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggctgaaaatcggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaacggggctgctgctggggacctgtggcagtag

SEQ ID NO: 33684 - DNA, 1899 bp, Artificial Sequence
  Description of Artificial Sequence: Synthetic coding sequence
atggccgccaacgtgggctccatgttccagtactggaagagatttgacctgcagcagctgcagcgggagctggatgccacagccaccgtgctggccaaccggcaggatgagagcgagcagagcaggaagaggctcatcgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaagctgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggccgagaaccggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaatggagctgctgctggggacctgtggcagtag

SEQ ID NO: 33685 - DNA, 2031 bp, Artificial Sequence
  Description of Artificial Sequence: Synthetic coding sequence
atggccgccaacgtgggctccatgttccagtactggaagagatttgacctgcagcagctgcagcgggagctggatgccacagccaccgtgctggccaaccggcaggatgagagcgagcagagcaggaagaggctcatcgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacatcgagacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaagctgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggccgagaaccggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaatggagctgctgctggggacctgtggcagtag

SEQ ID NO: 33686 - DNA, 4212 bp, Artificial Sequence
  Description of Artificial Sequence: Synthetic coding sequence
atgctgtgtgtggccggggcccggctgaagcgggagctggatgccacagccaccgtgctggccaaccggcaggatgaaagtgagcagagcaggaagaggctgattgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagcgggagaaccctggccagagcctgaacagactcttccaggaggtgcccaagagaagaaatggcagcgagggcaacatcaccacccgcatccgggccagcgagactggaagtgatgaggccatcaagagcatcctggagcaggccaagcgggagctgcaggtgcagaagacagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgagcagctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagaccggcggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgaccggggccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgtcctctgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagaggaggcacagctctgtgtctgacagccagccctgtgagcccccatctgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatccggcgggagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccacccagcggcaccccaggcccagatgatgccagagatgatgaccatgaaggaggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33687 - DNA, 1989 bp, Artificial Sequence
  Description of Artificial Sequence: Synthetic coding sequence
atggccgccaacgtgggctccatgttccagtactggaagagatttgacctgcagcagctgcagcgggagctggatgccacagccaccgtgctggccaaccggcaggatgagagcgagcagagcaggaagaggctcatcgagcagagccgggagttcaagaagaacaccccagaaattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacatcgagacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaagctgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggccgagaaccggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaatggagctgctgctggggacctgtggcagtag

SEQ ID NO: 33688 - DNA, 4452 bp, Artificial Sequence
  Description of Artificial Sequence: Synthetic coding sequence
atgctgtgtgtggccggggcccggctgaagcgggagctggatgccacagccaccgtgctggccaaccggcaggatgaaagtgagcagagcaggaagaggctgattgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcagcgcccggaggaagggcaaggaccagcctgagagcagaagacctggcagcctgcctgcccccccacccagccagctgcccaggaaccctggagagcaggccagcaacaccaacggcacccaccagttctccccagctggcctgagccaggacttcttcagcagcagcctggccagccccagcctgcccctggccagcacaggcaagtttgccctgaacagcctgctgcagaggcagctgatgcagagcttctacagcaaggccatgcaggaggccggcagcacctccatgatcttcagcacaggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagaggggcaacatcaccacccgcatccgggccagcgagactggaagtgatgaggccatcaagagcatcctggagcaggccaagcgggagctgcaggtgcagaagacagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgagcagctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagaccggcggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgaccggggccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgtcctctgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagaggaggcacagctctgtgtctgacagccagccctgtgagcccccatctgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatccggcgggagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccacccagcggcaccccaggcccagatgatgccagagatgatgaccatgaaggaggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33689 - DNA, 4350 bp, Artificial Sequence
  Description of Artificial Sequence: Synthetic coding sequence
atgctgtgtgtggccggggcccggctgaagcgggagctggatgccacagccaccgtgctggccaaccggcaggatgaaagtgagcagagcaggaagaggctgattgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcagcgcccggaggaagggcaaggaccagcctgagagcagaagacctggcagcctgcctgcccccccacccagccagctgcccaggaaccctggagagcaggccagcaacaccaacggcacccaccagttctccccagctggcctgagccaggacttcttcagcagcagcctggccagccccagcctgcccctggccagcacaggcaagtttgccctgaacagcctgctgcagaggcagctgatgcagagcttctacagcaaggccatgcaggaggccggcagcacctccatgatcttcagcacaggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagagagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgagcagctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagaccggcggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgaccggggccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgtcctctgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagaggaggcacagctctgtgtctgacagccagccctgtgagcccccatctgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatccggcgggagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccacccagcggcaccccaggcccagatgatgccagagatgatgaccatgaaggaggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33690 - DNA, 4044 bp, Artificial Sequence
  Description of Artificial Sequence: Synthetic coding sequence
atgctgtgtgtggccggggcccggctgaagcgggagctggatgccacagccaccgtgctggccaaccggcaggatgaaagtgagcagagcaggaagaggctgattgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggcccctacagcaccaacagcatcagcagccagagccccctgcagcagagcccagatgtgaatggcatggcccccagccccagccagagcgagagcgctggctctgtgtctgagggggaggagatggacacagctgagatcgcccggcaggtgaaggagcagctgatcaagcacaacatcggccagaggatcttcggccactacgtgctgggcctgagccagggctctgtgtctgagatcctggcccggcccaagccctggaacaagctgactgtgcggggcaaggagcccttccacaagatgaagcagttcctgagtgatgagcagaacatcctggccctgcggagcatccagggccggcagagagctgagcccgcccagcccagcagcgccagcggcagcggcaacagtgatgatgccatccgcagcatcctgcagcaggcccggcgggagatggaggcccagcaggccgccctggaccctgccctgaagcaggcccccctgagccagagcgacatcaccatcctgacccccaagctgctgagcaccagccccatgcccaccgtgagcagctacccacccctggccatcagcctgaagaagcccagcgctgcccctgaggccggggccagcgccctgcccaaccccccagccctgaagaaggaggcccaggatgcccctggcctggacccccagggcgctgctgactgtgcccagggcgtgctgcggcaggtgaagaatgaggtgggccgcagcggggcctggaaggaccactggtggagcgctgtgcagcctgagaggagaaatgctgccagcagcgaggaggccaaggccgaggagaccggcggcggcaaggagaagggcagcggcggcagcggcggcggcagccagcccagggctgagaggagccagctgcagggccccagcagcagcgagtactggaaggagtggcccagcgctgagagcccctacagccagagcagcgagctgagcctgaccggggccagccgctctgagaccccccagaacagccccctgcccagcagccccatcgtgcccatgagcaagcccaccaagcccagcgtgccccccctgaccccagagcagtatgaggtgtacatgtaccaggaggtggacaccatcgagctgacccggcaggtgaaggagaagctggccaagaatggcatctgccagaggatctttggagagaaggtgctgggcctgagccagggctctgtgtctgacatgctgagccggcccaagccctggagcaagctgacccagaagggccgggagcccttcatccgcatgcagctgtggctgaatggagagctgggccagggcgtgctgcctgtgcagggccagcagcagggccctgtgctgcacagcgtgaccagcctgcaggaccccctgcagcagggctgtgtgtcctctgagagcacccccaagaccagcgccagctgcagccctgcccctgagagccccatgagcagcagcgagagcgtgaagagcctgacagagctggtgcagcagccctgcccccccatcgaggccagcaaggacagcaagcccccagagcccagcgaccccccagccagtgacagccagcccaccacccccctgcccctgagcggccacagcgccctgagcatccaggagctggtggccatgagccctgagctggacacctacggcatcaccaagagggtgaaggaggtgctgacagacaacaacctgggccagaggctgtttggagagaccatcctgggcctgacccagggctctgtgtctgacctgctggcccggcccaagccctggcacaagctgagcctgaagggccgggagccctttgtgaggatgcagctgtggctgaatgaccccaacaacgtggagaagctgatggacatgaagaggatggagaagaaggcctacatgaagaggaggcacagctctgtgtctgacagccagccctgtgagcccccatctgtgggcacagagtacagccagggcgccagcccccagccccagcaccagctgaagaagccccgggtggtgctggcccctgaggagaaggaggccctgaagagggcctaccagcagaagccctaccccagccccaagaccatcgaggacctggccacccagctgaacctgaagaccagcaccgtcatcaactggttccacaactaccgcagccgcatccggcgggagctgttcatcgaggagatccaggccggcagccagggccaggccggggccagtgacagccccagcgcccggagcggccgggccgcccccagcagcgagggggacagctgtgatggagtggaggccacagagggccctggcagcgctgacacagaggagcccaagagccagggcgaggccgagcgggaggaggtgcccaggcctgctgagcagacagagcccccacccagcggcaccccaggcccagatgatgccagagatgatgaccatgaaggaggccctgtggagggccctggccccctgcccagccctgccagcgccacagccacagctgccccagctgccccagaagatgctgccaccagcgctgctgctgcccctggagagggccctgctgcccccagcagcgcccccccacccagcaacagcagcagcagcagcgccccccggcggcccagcagcctgcagagcctgtttggcctgcctgaggccgccggggcccgggacagccgggacaaccccctgaggaagaagaaggccgccaacctgaacagcatcatccaccggctggagaaggccgccagccgggaggagcccatcgagtgggagttctag

SEQ ID NO: 33691 - DNA, 1902 bp, Artificial Sequence
  Description of Artificial Sequence: Synthetic coding sequence
atgaagatcagcgcctggctgatgtgtgcccggggcaaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacattgaaacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgcgggagaacagcgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaggccgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggctgaaaatcggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaacggggctgctgctggggacctgtggcagtag

SEQ ID NO: 33692 - DNA, 2079 bp, Artificial Sequence
  Description of Artificial Sequence: Synthetic coding sequence
atgtctgctggcactggaaaaggaggcccccagacccctgtggagagccccacagccagcagcaagctgccccaggcccactggctgtgcagccctggcatcaagcgggagctggatgccacagccaccgtgctggccaaccggcaggatgagagcgagcagagcaggaagaggctcatcgagcagagccgggagttcaagaagaacaccccagaggacctgaggaagcaggtggcccccctgctgaagagcttccagggcgagattgatgccctgagcaagaggagcaaggaggccgaggccgccttcctgaatgtgtacaagaggctgattgatgtgcctgaccctgtgcctgccctggacctgggccagcagctgcagctgaaggtgcagaggctgcatgacatcgagacagagaaccagaagctgcgggagaccctggaggagtacaacaaggagtttgctgaggtgaagaaccaggaggtgaccatcaaggccctgaaggagaagatccgggagtatgagcagaccctgaagaaccaggccgagaccatcgccctggagaaggagcagaagctgcagaatgactttgctgagaaggagaggaagctgcaggagacccagatgagcaccaccagcaagctggaggaggccgagcacaaggtgcagagcctgcagacagccctggagaagaccaggacagagctgtttgacctgaagaccaagtatgatgaggagaccacagccaaggcagatgaaattgagatgatcatgacagacctggagcgggccaaccagagagctgaggtggcccagcgggaggccgagaccctgcgggagcagctgagcagcgccaaccacagcctgcagctggccagccagatccagaaggccccagatgtggagcaggccatcgaggtgctgaccaggagcagcctggaggtggagctggccgccaaggagcgggagatcgcccagctggtggaggatgtgcagaggctgcaggccagcctgaccaagctgagagaaaattctgccagccagatcagccagctggagcagcagctgagcgccaagaacagcaccctgaagcagctggaggagaagctgaagggccaggccgactatgaggaggtgaagaaggagctgaacatcctgaagtccatggagtttgcccccagcgagggcgccggcacccaggatgctgccaagcccctggaggtgctgctgctggagaagaacagaagcctgcagagtgaaaatgctgccctgcgcatcagcaacagcgacctgagcggccgctgtgccgagctgcaggtgcgcatcacagaagctgtggccacagccacagagcagcgggagctgattgcccggctggagcaggacctgagcatcatccagagcatccagaggccagatgctgagggcgctgctgagcaccggctggagaagatccctgagcccatcaaggaggccacagccctcttctacggccctgctgccccagccagcggggccctgcctgagggccaggtggacagcctgctgagcatcatcagcagccagcgggagcgcttccgggccaggaaccaggagctggaggccgagaaccggctggcccagcacaccctgcaggccctgcagagcgagctggacagcctgcgggctgacaacatcaagctgtttgagaagatcaagttcctgcagagctacccaggccggggcagcggcagtgatgacacagagctgcgctacagcagccagtatgaggagcggctggaccccttcagcagcttcagcaagcgggagcggcagaggaagtacctgagcctgagcccctgggacaaggccaccctgtccatgggccgcctggtgctgagcaacaagatggcccggaccatcggcttcttctacaccctcttcctgcactgcctggtgttcctggtgctgtacaagctggcctggagcgagagcatggagcgggactgtgccaccttctgtgccaagaagtttgctgaccacctgcacaagttccatgaaaatgacaatggagctgctgctggggacctgtggcagtag

SEQ ID NO: 33693 - DNA, 1719 bp, Artificial Sequence
  Description of Artificial Sequence: Synthetic coding sequence
atggaccgggccggggctgacatgtgggccagcaccttcaccctggccatggccgagaggaagccccaggatgtgtgggtgctgctgcctgagcacagcctggtgcccggctgcctggatggcggcggcgtgcagtacctgctggtgggcctgagccggctgcagtgtggccactgccccggcacctgggacagcgcccacgtgcacgtgctcttccacctgtggtgggaccgggccagccaccggggcctggtgaagatgaggatctggggccagcgctgccgcctgtgcccagcccctggggactgccaggtgcggcccccaggagagcagcccttcctgagccggctggtgctgcacatcctgcaggactgctatggagatggccctggccctgcccggcacccccgggaggcctatgagggctgctgtgaggcctgtgagctgggcgtgtgcttcctgcagaaggccccagaccctgcctggagcgccaatgccaccaagggcaacttccctgccacagcctggggcggcactggaacagtgtcccggggcaagcccctgagcaccccaggagatgacctgggcaaaggaggagtggtgattgccatccccttcagcctggtgggcaccagcaatgaccaggtgcccatcgccgagggccctgcccccccagctggggccagcctgcctgtgacaggcagctgtgaggccctggtgattggccagggcagcatcttcctgagcggggacagcgtggccatgcctgggggcaagggcttccctgtggccatcggggaccccctcttccacggccctggcctgctgggcagcagcatccagacctttgagctgaagggcttcctgttcaagggccggggcagcctgtgcagccctgtgggcgtggcccagggctggggccccatcagcctgaacaacggcctggtgcctgtgggcaagcacacccccaccgtcttctactgtgtgggcctgagcgccagcggggagggcagcctgaccttccccagcagcctgaccagcatcttcaccaacaccctgtctgagcccacagatggccctgtggccaccaaggaggccagcatcaccttccccttcatcttcacagatgtgaaggatgctgtggccgaggtggccgagggcaatggcaaggagggcggcggccagggcctggtgcctgtgggccatgatgccctgcctgagaccaatgctgggggcctgcccagccaggtgaagggcagcctggccctgcccttcccagcagatgtgcagggcaaggatgccttcacagacatcacagagggcaaggagaaggagggcggcctggtgacagctggccatgatgcccccctggaggccaatgctgagggccccatcaccgtgtctgagggctgcatcaccatcccctttgctgtgtttgatgtgatcaagaggaaaggaggcggccacgtggcctacggcccccagggcaatggctgcttcagccagggctactaccagaagaggcagctgcggagccgcttccacaaggcccgctgtggctgccggcgggaggaggatgagaggcctggccgggcctgccggcggccccacgccgagccctatgaggacttctggatctgggtgtccatgacagtgtgtgtgttctggctgatgtgcatgtgccgcctgaaccctggcatctacccccagcaggtgtag

SEQ ID NO: 33694 - DNA, 1728 bp, Artificial Sequence
  Description of Artificial Sequence: Synthetic coding sequence
atgagccaggacaccaaggtgaagaccacagagagcagccccccagcccccagcaaggccaggaagctgctgcctgtgctggaccccagcggggactactactactggtggctgaacaccatggtgtttcctgtgatgtacaacctgatcatcctggtgtgccgggcctgcttcccagacctgcagcacggctacctggtggcctggctggtgctggactacaccagtgacctgctgtacctgctggacatggtggtgcgcttccacacaggcttcctggagcagggcatcctggtggtggacaagggccgcatcagcagccgctacgtgaggacctggagcttcttcctggacctggccagcctgatgcccacagatgtggtgtatgtgcggctgggcccccacacccccaccctgcggctgaaccgcttcctgcgggccccccggctgtttgaggcctttgacagaacagagaccaggacagcctacccaaatgccttcagaattgccaagctgatgctgtacatctttgtggtgatccactggaacagctgcctgtactttgccctgagccgctacctgggcttcggcagagatgcctgggtgtacccagaccctgcccagcccggctttgagcggctgcggcggcagtacctgtacagcttctacttcagcaccctcatcctgaccaccgtgggggacaccccacctccagcccgggaggaggagtacctgttcatggtgggggacttcctgctggccgtgatgggctttgccaccatcatgggctccatgagcagcgtcatctacaacatgaacacagcagatgctgccttctacccagaccacgccctggtgaagaagtacatgaagctgcagcacgtgaacaggaagctggagaggagggtcatcgactggtaccagcacctgcagatcaacaagaagatgaccaatgaggtggccatcctgcagcacctgcctgagcggctgcgggcagaggtggccgtgtctgtgcacctgagcaccctgagccgggtgcagatcttccagaactgtgaggccagcctgctggaggagctggtgctgaagctgcagccccagacctacagccctggagaatatgtgtgcaggaagggggacatcggccaggagatgtacatcatccgggagggccagctggccgtggtggctgatgatggcatcacccagtatgctgtgctgggcgccggcctgtactttggagagatcagcatcatcaacatcaagggcaacatgagcggcaacagaagaacagccaacatcaagagcctgggctacagcgacctcttctgcctgagcaaggaggacctgcgggaggtgctgtctgagtacccccaggcccagaccatcatggaggagaagggccgggagatcctgctgaagatgaacaagctggatgtgaatgctgaggccgctgagatcgccctgcaggaggccacagagagccggctgcggggcctggaccagcagctggatgacctgcagaccaagtttgcccggctgctggccgagctggagagcagcgccctgaagatcgcctacagaattgagcggctggagtggcagacccgggagtggcccatgcctgaggacctggccgaggctgatgatgaaggagagcctgaggagggcaccagcaaggatgaggagggccgggccagccaggagggccccccaggccctgagtag

SEQ ID NO: 33695 - DNA, 1164 bp, Artificial Sequence
  Description of Artificial Sequence: Synthetic coding sequence
atgatggatgagccctggtgggagggccgggtggccagtgatgtgcactgcaccctgcgggagaaggagctgaagctgcccaccttccgggcccacagccccctgctgaagagccgccgcttctttgtggacatcctgaccctgctgagcagccactgccagctgtgcccagctgcccggcacctggccgtgtacctgctggaccacttcatggaccgctacaacgtgaccaccagcaagcagctgtacacagtggccgtgtcctgcctgctgctggccagcaagtttgaagatcgggaggaccacgtgcccaagctggagcagatcaacagcacccgcatcctgagcagccagaacttcaccctgaccaagaaggagctgctgagcacagagctgctgctgctggaggccttctcctggaacctgtgcctgcccaccccagcccacttcctggactactacctgctggcctctgtgtcccagaaggaccaccactgccacacctggcccaccacctgccccaggaagaccaaggaatgtctgaaggagtatgcccactacttcctggaggtgaccctgcaggaccacatcttctacaagttccagcccagcgtggtggccgccgcctgtgtgggcgccagccgcatctgcctgcagctgagcccctactggacccgggacctgcagaggatcagcagctacagcctggagcacctgagcacctgcatcgagatcctgctggtggtgtatgacaacgtgctgaaggatgctgtggccgtgaagagccaggccctggccatggtgcccggcaccccacccacccccacccaggtgctcttccagcccccagcctacccagccctgggccagcctgccaccaccctggcccagttccagacccctgtgcaggacctgtgcctggcctacagagacagcctgcaggcccacaggagcggcagcctgctgagcggcagcacaggcagcagcctgcacaccccctaccagcccctgcagcccctggacatgtgccctgtgcctgtgcctgccagcctgtccatgcacatggccatcgctgctgagcccaggcactgcctggccaccacctacggcagcagctacttcagcggcagccacatgttccccaccggctgctttgacagatag

SEQ ID NO: 33696 - DNA, 1308 bp, Artificial Sequence
  Description of Artificial Sequence: Synthetic coding sequence
atgatggatgagccctggtgggagggccgggtggccagtgatgtgcactgcaccctgcgggagaaggagctgaagctgcccaccttccgggcccacagccccctgctgaagagccgccgcttctttgtggacatcctgaccctgctgagcagccactgccagctgtgcccagctgcccggcacctggccgtgtacctgctggaccacttcatggaccgctacaacgtgaccaccagcaagcagctgtacacagtggccgtgtcctgcctgctgctggccaacggggtgtccctgctgagcccccggctgaagtgcagcggcatgatcagcgcccactgcaacctgcacctgcccggcagcagcaacagccctgccagcgccccccaccccccacccaccccaccccaggtggccgagaccaccgggaagtttgaagatcgggaggaccacgtgcccaagctggagcagatcaacagcacccgcatcctgagcagccagaacttcaccctgaccaagaaggagctgctgagcacagagctgctgctgctggaggccttctcctggaacctgtgcctgcccaccccagcccacttcctggactactacctgctggcctctgtgtcccagaaggaccaccactgccacacctggcccaccacctgccccaggaagaccaaggaatgtctgaaggagtatgcccactacttcctggaggtgaccctgcaggaccacatcttctacaagttccagcccagcgtggtggccgccgcctgtgtgggcgccagccgcatctgcctgcagctgagcccctactggacccgggacctgcagaggatcagcagctacagcctggagcacctgagcacctgcatcgagatcctgctggtggtgtatgacaacgtgctgaaggatgctgtggccgtgaagagccaggccctggccatggtgcccggcaccccacccacccccacccaggtgctcttccagcccccagcctacccagccctgggccagcctgccaccaccctggcccagttccagacccctgtgcaggacctgtgcctggcctacagagacagcctgcaggcccacaggagcggcagcctgctgagcggcagcacaggcagcagcctgcacaccccctaccagcccctgcagcccctggacatgtgccctgtgcctgtgcctgccagcctgtccatgcacatggccatcgctgctgagcccaggcactgcctggccaccacctacggcagcagctacttcagcggcagccacatgttccccaccggctgctttgacagatag

SEQ ID NO: 33697 - DNA, 501 bp, Artificial Sequence
  Description of Artificial Sequence: Synthetic coding sequence
atgaggcacaccagcaagaggaagccccagtactatgaggccgagatggtgctgaagtactacaagcacctggaggagggctctgtgtccctgtgctgccccggctggagcgctgtggcccagagccggctgacagctgccagcaccttcggggcccaggtgatcctgctcttccagctgtctgagcagctgcggctgcaggagctgaagctgcccaccttccgggcccacagccccctgctgaagagccgccgcttctttgtggacatcctgaccctgctgagcagccactgccagctgtgcccagctgcccggcacctggccgtgtacctgctggaccacttcatggaccgctacaacgtgaccaccagcaagcagctgtacacagtggccgtgtcctgcctgctgctggccagcaggaacaagggcagcggcagccctgtgcccaccaggtctgcccagcagtgccggcagacctgggcccggggcagcccctggtag

SEQ ID NO: 33698 - DNA, 759 bp, Artificial Sequence
  Description of Artificial Sequence: Synthetic coding sequence
atgatggatgagccctggtgggagggccgggtggccagtgatgtgcactgcaccctgcgggagaaggagctgaagctgcccaccttccgggcccacagccccctgctgaagagccgccgcttctttgtggacatcctgaccctgctgagcagccactgccagctgtgcccagctgcccggcacctggccgtgtacctgctggaccacttcatggaccgctacaacgtgaccaccagcaagcagctgtacacagtggccgtgtcctgcctgctgctggccagcaagtttgaagatcgggaggaccacgtgcccaagctggagcagatcaacagcacccgcatcctgagcagccagaacttcaccctgaccaagaaggagctgctgagcacagagctgctgctgctggaggccttctcctggaacctgtgcctgcccaccccagcccacttcctggactactacctgctggcctctgtgtcccagaaggaccaccactgccacacctggcccaccacctgccccaggaagaccaaggaatgtctgaaggagtatgcccactacttcctggaggtgaccctgcaggaccacatcttctacaagttccagcccagcgtggtggccgccgcctgtgtgggcgccagccgcatctgcctgcagctgagcccctactggacccgggacctgcagaggatcagcagctacagcctggagcacctgagcacctgcatcgagatcctgctggtgcccctcttcagatag

SEQ ID NO: 33699 - DNA, 756 bp, Artificial Sequence
  Description of Artificial Sequence: Synthetic coding sequence
atggatgagccctggtgggagggccgggtggccagtgatgtgcactgcaccctgcgggagaaggagctgaagctgcccaccttccgggcccacagccccctgctgaagagccgccgcttctttgtggacatcctgaccctgctgagcagccactgccagctgtgcccagctgcccggcacctggccgtgtacctgctggaccacttcatggaccgctacaacgtgaccaccagcaagcagctgtacacagtggccgtgtcctgcctgctgctggccagcaagtttgaggacagagaagatcatgtgcccaagctggagcagatcaacagcacccgcatcctgagcagccagaacttcaccctgaccaagaaggagctgctgagcacagagctgctgctgctggaggccttctcctggaacctgtgcctgcccaccccagcccacttcctggactactacctgctggcctctgtgtcccagaaggaccaccactgccacacctggcccaccacctgccccaggaagaccaaggagtgcctgaaggagtatgcccactacttcctggaggtgaccctgcaggaccacatcttctacaagttccagcccagcgtggtggccgccgcctgtgtgggcgccagccgcatctgcctgcagctgagcccctactggacccgggacctgcagaggatcagcagctacagcctggagcacctgagcacctgcatcgagatcctgctggtgcccctcttcagatag

SEQ ID NO: 33700 - DNA, 1233 bp, Artificial Sequence
  Description of Artificial Sequence: Synthetic coding sequence
atggacctgaccggcctgctgctggatgaggagggcaccttcagcctggccggcttccaggacttcaccttcctgcccggccaccagaagctgagcgcccgcatcagaagaagactctactacggctgggactgggaggccgactgcagcctggaggagctgagcagccctgtggccgacattgctgtggagctgctgcagaaggccgcccccagccccatccggcggctgcagaagaagtatgtggcccacgtgtcccgggaggcctgcatcagcccctgtgccatgatgctggccctggtgtacatcgagcggctgcggcacagaaatccagactacctgcagcacgtgagcagcagtgacctcttcctgatctccatgatggtggccagcaagtacctgtatgatgaaggagaggaggaggaggtgttcaatgatgagtggggcgctgctggaggagtggccgtgcccaccctgaatgccctggagcggggcttcctgagcgccatggactggcacctgtacacagacccccgggagatctttgaggtgctgtcctggctggagagctgtgtggccgagcagcagggccgctggaggggctggtacacctacacagacctgtgtgtgctgctggagcagcccacctggcagctggccctgggcagcctgtgccagaggctggtgaagctgagctgcctgctggccgtggcctacgtgtcctctgtggccctggccgtggcctctgtggccgtcatccaccagagcctgggcctgagctgcatccccaccccaggccccccagacctgggcctgaccagccgctgcctgctggagccctgcatccccagcgtgccccagtgcctgcccagcctggccaacgtgagcagctgcctggagggctccatgggcctgcggagcctgtggggcagcctgctggccagcctgaccccaccacccctgcccccaccagaccccccagccccacccaccctgctgcacaactgccacctgtgccagaagctgcagagggacagccccacctgccacgcctgcctgcaccccaacagaacagtgcccacagccctgagcagcccctggtaccacacctacggcctggccccaccctggccctggagccctgtgctgctgagcctgccccagccccagcagtgcagcctcttctctgtgatggagctggcccggctgaagagctttgtgtttcctggatag

SEQ ID NO: 33701 - DNA, 1233 bp, Artificial Sequence; identical to SEQ ID NO: 33700
  Description of Artificial Sequence: Synthetic coding sequence

SEQ ID NO: 33702 - DNA, 927 bp, Artificial Sequence
  Description of Artificial Sequence: Synthetic coding sequence
atggacctgaccggcctgctgctggatgaggagggcaccttcagcctggccggcttccaggacttcaccttcctgcccggccaccagaagctgagcgcccgcatcagaagaagactctactacggctgggactgggaggccgactgcagcctggaggagctgagcagccctgtggccgacattgctgtggagctgctgcagaaggccgcccccagccccatccggcggctgcagaagaagtatgtggcccacgtgtcccgggaggcctgcatcagcccctgtgccatgatgctggccctggtgtacatcgagcggctgcggcacagaaatccagactacctgcagcacgtgagcagcagtgacctcttcctgatctccatgatggtggccagcaagtacctgtatgatgaaggagaggaggaggaggtgttcaatgatgagtggggcgctgctggaggagtggccgtgcccaccctgaatgccctggagcggggcttcctgagcgccatggactggcacctgtacacagacccccgggagatctttgaggtgctgtcctggctggagagctgtgtggccgagcagcagggccgctggaggggctggtacacctacacagacctgtgtgtgctgctggagcagcccacctggcagctggccctgggcagcctgtgccagaggctggtgaagctgagctgcctgctggccgtggcctacgtgtcctctgtggccctggccgtggcctctgtggccgtcatccaccagagcctgggcctgagctgcatccccaccccaggccccccagacctgggcctgaccagccgctgcctgctggagccctgcatccccagcgtgccccagtgcctgcccagcctggccaacgtgagcagctgcctggagggctccatgggcctgcggagcctgtag

SEQ ID NO: 33703 - DNA, 1356 bp, Artificial Sequence
  Description of Artificial Sequence: Synthetic coding sequence
atgcacggctacttcggctgcaatgctgctgctgagcccggctacagcgcctttgtgggcaccccccagatctgtgtgaccaagatgagcaccaggaactgccagggcatggattctgtcatcaagcccctggacaccatccctgaggacaagaaggtgcgggtgcagaggacccagagcacctttgacccctttgagaagccagccaaccaggtgaagagggtgcacagcgagaacaatgcctgcatcaacttcaagaccagcagcacaggcaaggagagccccaaggtgcggcggcacagcagccccagcagccccaccagccccaagtttgggaaggctgacagctatgagaagctggagaagctgggggagggcagctatgccaccgtgtacaagggcaagagcaaggtgaatggcaagctggtggccctgaaggtgatccggctgcaggaggaggagggcacccccttcaccgccatccgggaggccagcctgctgaagggcctgaagcacgccaacatcgtgctgctgcatgacatcatccacaccaaggagaccctgaccctggtgtttgaatatgtgcacacagacctgtgccagtacatggacaagcaccctgggggcctgcacccagacaacgtgaagctgttcctgttccagctgctgcggggcctgagctacatccaccagcgctacatcctgcaccgggacctgaagccccagaacctgctgatcagtgacacaggagagctgaagctggccgactttggcctggcccgggccaagtctgtgcccagccacacctacagcaatgaggtggtgaccctgtggtacagacctccagatgtgctgctgggcagcacagagtacagcacctgcctggacatgtggggcgtgggctgcatctttgtggagatgatccagggcgtggccgccttccctggcatgaaggacatccaggaccagctggagcgcatcttcctggtgctgggcaccccaaatgaagacacctggccaggagtgcacagcctgccccacttcaagccagagcgcttcaccctgtacagcagcaagaacctgcggcaggcctggaacaagctgtcctatgtgaaccacgccgaggacctggccagcaagctgctgcagtgcagccccaagaaccggctgagcgcccaggccgccctgagccatgagtacttcagtgacctgcccccccggctgtgggagctgacagacatgagcagcatcttcaccgtgcccaacgtgcggctgcagcctgaggccggggagagcatgagggccttcggcaagaacaacagctatggcaagagcctgagcaacagcaagcactag

SEQ ID NO: 33704 - DNA, 1410 bp, Artificial Sequence
  Description of Artificial Sequence: Synthetic coding sequence
atgtgtgacctgattgagccccagcctgctgagaagattggcaagatgaagaagctgcggaggaccctgtctgagagcttcagccgcatcgccctgaagaaggatgacaccacctttgatgagatctgtgtgaccaagatgagcaccaggaactgccagggcatggattctgtcatcaagcccctggacaccatccctgaggacaagaaggtgcgggtgcagaggacccagagcacctttgacccctttgagaagccagccaaccaggtgaagagggtgcacagcgagaacaatgcctgcatcaacttcaagaccagcagcacaggcaaggagagccccaaggtgcggcggcacagcagccccagcagccccaccagccccaagtttgggaaggctgacagctatgagaagctggagaagctgggggagggcagctatgccaccgtgtacaagggcaagagcaaggtgaatggcaagctggtggccctgaaggtgatccggctgcaggaggaggagggcacccccttcaccgccatccgggaggccagcctgctgaagggcctgaagcacgccaacatcgtgctgctgcatgacatcatccacaccaaggagaccctgaccctggtgtttgaatatgtgcacacagacctgtgccagtacatggacaagcaccctgggggcctgcacccagacaacgtgaagctgttcctgttccagctgctgcggggcctgagctacatccaccagcgctacatcctgcaccgggacctgaagccccagaacctgctgatcagtgacacaggagagctgaagctggccgactttggcctggcccgggccaagtctgtgcccagccacacctacagcaatgaggtggtgaccctgtggtacagacctccagatgtgctgctgggcagcacagagtacagcacctgcctggacatgtggggcgtgggctgcatctttgtggagatgatccagggcgtggccgccttccctggcatgaaggacatccaggaccagctggagcgcatcttcctggtgctgggcaccccaaatgaagacacctggccaggagtgcacagcctgccccacttcaagccagagcgcttcaccctgtacagcagcaagaacctgcggcaggcctggaacaagctgtcctatgtgaaccacgccgaggacctggccagcaagctgctgcagtgcagccccaagaaccggctgagcgcccaggccgccctgagccatgagtacttcagtgacctgcccccccggctgtgggagctgacagacatgagcagcatcttcaccgtgcccaacgtgcggctgcagcctgaggccggggagagcatgagggccttcggcaagaacaacagctatggcaagagcctgagcaacagcaagcactag

SEQ ID NO: 33705 - DNA, 1023 bp, Artificial Sequence
  Description of Artificial Sequence: Synthetic coding sequence
atgctggccctgaccctgcggcccccacccctggccaagagccacctgaagctgggcggcaccccagccccagcccgggtgaatggcaagctggtggccctgaaggtgatccggctgcaggaggaggagggcacccccttcaccgccatccgggaggccagcctgctgaagggcctgaagcacgccaacatcgtgctgctgcatgacatcatccacaccaaggagaccctgaccctggtgtttgaatatgtgcacacagacctgtgccagtacatggacaagcaccctgggggcctgcacccagacaacgtgaagctgttcctgttccagctgctgcggggcctgagctacatccaccagcgctacatcctgcaccgggacctgaagccccagaacctgctgatcagtgacaccggggagctgaagctggccgactttggcctggcccgggccaagtctgtgcccagccacacctacagcaatgaggtggtgaccctgtggtaccggcccccagatgtgctgctgggcagcacagagtacagcacctgcctggacatgtggggcgtgggctgcatctttgtggagatgatccagggcgtggccgccttccctggcatgaaggacatccaggaccagctggagcgcatcttcctggtgctgggcaccccaaatgaagacacctggccaggagtgcacagcctgccccacttcaagccagagcgcttcaccctgtacagcagcaagaacctgcggcaggcctggaacaagctgtcctatgtgaaccacgccgaggacctggccagcaagctgctgcagtgcagccccaagaaccggctgagcgcccaggccgccctgagccatgagtacttcagtgacctgcccccccggctgtgggagctgacagacatgagcagcatcttcaccgtgcccaacgtgcggctgcagcctgaggccggggagagcatgagggccttcggcaagaacaacagctatggcaagagcctgagcaacagcaagcactag

SEQ ID NO: 33706 - DNA, 1353 bp, Artificial Sequence
  Description of Artificial Sequence: Synthetic coding sequence
atggaccagtactgcatcctgggccgcatcggggagggcgcccatggaattgtgttcaaggccaagcacgtggagaccggggagatcgtggccctgaagaaggtggccctgcggcggctggaggatggcttccccaaccaggccctgcgggagatcaaggccctgcaggagatggaggacaaccagtatgtggtgcagctgaaggctgtgttcccccatggaggcggctttgtgctggcctttgagttcatgctgagtgacctggccgaggtggtgagacatgcccagaggcccctggcccaggcccaggtgaagagctacctgcagatgctgctgaagggcgtggccttctgccacgccaacaacatcgtgcaccgggacctgaagccagccaacctgctgatcagcgccagcggccagctgaagattgctgactttggcctggcccgggtcttctccccagatggcagccggctgtacacccaccaggtggccaccaggtctgtgggctgcatcatgggagagctgctgaatggcagccccctcttccctgggaagaatgacatcgagcagctgtgctacgtgctgcgcatcctgggcacccccaacccccaggtgtggccagagctgacagagctgcctgactacaacaagatctccttcaaggagcaggtgcccatgcccctggaggaggtgctgcctgatgtgagcccccaggccctggacctgctgggccagttcctgctgtacccaccccaccagagaattgctgccagcaaggccctgctgcaccagtacttcttcaccgcccccctgcctgcccaccccagcgagctgcccatcccccagaggctgggcggccctgcccccaaggcccaccctggccccccccacatccatgacttccacgtggaccggcccctggaggtggccgtggagcccagggctgacagcgccctgcaccctgggggcgtgcgctcctggccctggagccggctgcctgccccccaggaccacagcgtgcacctgttcctgtgccacctgcccggcttcaccctgcagggcctgcccatggccaccgtgggcccccaccacaccctgcccctgagcccctgtgagggctggagccggggccggggccacgtgcccagccaggagtatgagaacatccagagcagcagaggagacagctggcctgtgctgggggagccctacctgctgtgtgccacagatgtgcccatcagaacagtgtcctctgctgccagccagggcctgcacatgcagaatgatgatgcctgcctgggcgccgcccctgagtgctgcctgctggtgaaggagaagtgccgggagtag

SEQ ID NO: 33707 - DNA, 1041 bp, Artificial Sequence
  Description of Artificial Sequence: Synthetic coding sequence
atggaccagtactgcatcctgggccgcatcggggagggcgcccatggaattgtgttcaaggccaagcacgtggagaccggggagatcgtggccctgaagaaggtggccctgcggcggctggaggatggcttccccaaccaggccctgcgggagatcaaggccctgcaggagatggaggacaaccagtatgtggtgcagctgaaggctgtgttcccccatggaggcggctttgtgctggcctttgagttcatgctgagtgacctggccgaggtggtgagacatgcccagaggcccctggcccaggcccaggtgaagagctacctgcagatgctgctgaagggcgtggccttctgccacgccaacaacatcgtgcaccgggacctgaagccagccaacctgctgatcagcgccagcggccagctgaagattgctgactttggcctggcccgggtcttctccccagatggcagccggctgtacacccaccaggtggccacccgctggtaccgggcccctgagctgctgtatggagcccggcagtatgaccagggcgtggacctgtggagcgtgggctgcatcatgggagagctgctgaatggcagccccctcttccctgggaagaatgacatcgagcagctgtgctacgtgctgcgcatcctgggcacccccaacccccaggtgtggccagagctgacagagctgcctgactacaacaagatctccttcaaggagcaggtgcccatgcccctggaggaggtgctgcctgatgtgagcccccaggccctggacctgctgggccagttcctgctgtacccaccccaccagagaattgctgccagcaaggccctgctgcaccagtacttcttcaccgcccccctgcctgcccaccccagcgagctgcccatcccccagaggctgggcggccctgcccccaaggcccaccctggccccccccacatccatgacttccacgtggaccggcccctggaggagagcctgctgaaccctgagctgatccggcccttcatcctggagggctag

SEQ ID NO: 33708 - DNA, 1017 bp, Artificial Sequence
  Description of Artificial Sequence: Synthetic coding sequence
atggaccagtactgcatcctgggccgcatcggggagggcgcccatggaattgtgttcaaggccaagcacgtggagccccgggtgggctggcagtgcctgcccagcatcctgcagacaggagagatcgtggccctgaagaaggtggccctgcggcggctggaggatggcttccccaaccaggccctgcgggagatcaaggccctgcaggagatggaggacaaccagtatgtggtgcagctgaaggctgtgttcccccacggcggcggctttgtgctggcctttgagttcatgctgagtgacctggccgaggtggtgagacatgcccagaggcccctggcccaggcccaggtgaagagctacctgcagatgctgctgaagggcgtggccttctgccacgccaacaacatcgtgcaccgggacctgaagccagccaacctgctgatcagcgccagcggccagctgaagattgctgactttggcctggcccgggtcttctccccagatggcagccggctgtacacccaccaggtggccaccaggtctgtgggctgcatcatgggagagctgctgaatggcagccccctcttccctgggaagaatgacatcgagcagctgtgctacgtgctgcgcatcctgggcacccccaacccccaggtgtggccagagctgacagagctgcctgactacaacaagatctccttcaaggagcaggtgcccatgcccctggaggaggtgctgcctgatgtgagcccccaggccctggacctgctgggccagttcctgctgtacccaccccaccagagaattgctgccagcaaggccctgctgcaccagtacttcttcaccgcccccctgcctgcccaccccagcgagctgcccatcccccagaggctgggcggccctgcccccaaggcccaccctggccccccccacatccatgacttccacgtggaccggcccctggaggagagcctgctgaaccctgagctgatccggcccttcatcctggagggctag

SEQ ID NO: 33709 - DNA, 732 bp, Artificial Sequence
  Description of Artificial Sequence: Synthetic coding sequence
atggaccagtactgcatcctgggccgcatcggggagggcgcccatggaattgtgttcaaggccaagcacgtggagaccggggagatcgtggccctgaagaaggtggccctgcggcggctggaggatggcttccccaaccaggccctgcgggagatcaaggccctgcaggagatggaggacaaccagtatgtggtgcagctgaaggctgtgttcccccatggaggcggctttgtgctggcctttgagttcatgctgagtgacctggccgaggtggtgagacatgcccagaggcccctggcccaggcccaggtgaagagctacctgcagatgctgctgaagggcgtggccttctgccacgccaacaacatcgtgcaccgggacctgaagccagccaacctgctgatcagcgccagcggccagctgaagattgctgactttggcctggcccgggtcttctccccagatggcagccggctgtacacccaccaggtggccaccaggagcagcctgagctgcaggaccaccaccaggagccccctgcggagccgctgcccctgcccctggaggcgctgctgcctgaccagcctgcccaggcactggatctgctgggtgaacagcttcagcaccctgctgaccagcgccagccagctgccccggctgagcagcatcagcaccagcagccagctgccctgcctgcccatccacctgagctgccgcttcctgtctgtgtag

SEQ ID NO: 33710 - DNA, 978 bp, Artificial Sequence
  Description of Artificial Sequence: Synthetic coding sequence
atggaccagtactgcatcctgggccgcatcggggagggcgcccatggaattgtgttcaaggccaagcacgtggagaccggggagatcgtggccctgaagaaggtggccctgcggcggctggaggatggcttccccaaccaggccctgcgggagatcaaggccctgcaggagatggaggacaaccagtatgtggtgcagctgaaggctgtgttcccccatggaggcggctttgtgctggcctttgagttcatgctgagtgacctggccgaggtggtgagacatgcccagaggcccctggcccaggcccaggtgaagagctacctgcagatgctgctgaagggcgtggccttctgccacgccaacaacatcgtgcaccgggacctgaagccagccaacctgctgatcagcgccagcggccagctgaagattgctgactttggcctggcccgggtcttctccccagatggcagccggctgtacacccaccaggtggccaccaggtctgtgggctgcatcatgggagagctgctgaatggcagccccctcttccctgggaagaatgacatcgagcagctgtgctacgtgctgcgcatcctgggcacccccaacccccaggtgtggccagagctgacagagctgcctgactacaacaagatctccttcaaggagcaggtgcccatgcccctggaggaggtgctgcctgatgtgagcccccaggccctggacctgctgggccagttcctgctgtacccaccccaccagagaattgctgccagcaaggccctgctgcaccagtacttcttcaccgcccccctgcctgcccaccccagcgagctgcccatcccccagaggctgggcggccctgcccccaaggcccaccctggccccccccacatccatgacttccacgtggaccggcccctggaggagagcctgctgaaccctgagctgatccggcccttcatcctggagggctag

SEQ ID NO: 33711 - DNA, 465 bp, Artificial Sequence
  Description of Artificial Sequence: Synthetic coding sequence
atggatgccccccggctgcctgtgcggcctggggtgctgctgcccaagctggtgctgctgtttgtgtatgcagatgactgcctggcccagtgtgggaaggactgcaagagctactgctgtgatggcaccaccccctactgctgcagctactatgcctacatcggcaacatcctgtctggaacagccatcgccggcatcgtgtttggcatcgtgttcatcatgggcgtgattgctggcatcgccatctgcatctgcatgtgcatgaagaaccaccgggccaccagggtgggcatcctgcggaccacccacatcaacacagtgtcctcctacccaggccccccaccctacggccatgaccacgagatggagtactgtgccgacctgcccccaccctacagccccaccccccagggccctgcccagaggagccccccaccaccctacccaggaaatgccaggaagtag

SEQ ID NO: 33712 - DNA, 519 bp, Artificial Sequence
  Description of Artificial Sequence: Synthetic coding sequence
atgaagtgtgagcccggctggcccaggaccccagagtggccacccagcccccggctgtctgctgtgggccgggacaaggagacctgggcccccagcgctgcccggctgggcccccgggccccccagctgcggggcgtgccccagagcctggccagagatgcccctggccctggcagcctgggccgcctgccccggcagtggccaggcctgtgcagcacccggctgagcggggccctgctgagccccagcgaccggccccccagcagccccttcccccctgtgcccggcagcccctttgcccccagcctgcggcccccagcctggatggatgccccccggctgcctgtgcggcctggggtgctgctgcccaagctggtgctgctgtttgtgtatgcagatgactgcctggcccagtgtgggaaggactgcaagagctactgctgtgatggcaccaccccctactgctgcagctactatgcctacatcggcaacatcctgagctgctgctgccccaggtag

SEQ ID NO: 33713 - DNA, 675 bp, Artificial Sequence
  Description of Artificial Sequence: Synthetic coding sequence
atgagcatcctgctgcccaacatggccgagtttgacaccatcagcgagctggaggaggaggaggaggaggaggccgccaccagcagcagcagccccagcagcagcagctctgtgtctggcccagatgatgatgaggaggatgaggaggaggaggaggaggaggaggaggaggaggaggaggaggaggaggaggaggaggaggaggcccctcctccaccccgggtggtgtctgaggagcacctgcggcgctatgccccagaccctgtgctggtgcggggggccggccacatcaccgtgtttggcctgagcaacaagtttgacacagagttccccagcgtgctgaccgggaaggtggcccctgaggagttcaagaccagcatcggccgggtgaatgcctgcctgaagaaggccctgcctgtgaatgtgaagtggctgctgtgtggctgcctgtgctgctgctgcaccctgggctgcagcctgtggcctgtgatctgcctgaacaagaggaccaggaggagcatccagaagctgattgagtgggagaacaacagactctaccacaagctggccctgcactggaagctgaccaagaggaaatgtgagaccagcaacatgatggagtatgtgatcctgattgagttcctgcccaagtaccccatcttccggccagactag

SEQ ID NO: 33714 - DNA, 615 bp, Artificial Sequence
  Description of Artificial Sequence: Synthetic coding sequence
atgagcatcctgctgcccaacatggccgagtttgacaccatcagcgagctggaggaggaggaggaggaggaggccgccaccagcagcagcagccccagcagcagcagctctgtgtctggcccagatgatgatgaggaggatgaggaggaggaggaggaggaggaggaggaggaggaggaggaggaggaggaggaggaggaggaggcccctcctccaccccgggtggtgtctgaggagcacctgcggcgctatgccccagaccctgtgctggtgcggggggccggccacatcaccgtgtttggcctgagcaacaagtttgacacagagttccccagcgtgctgaccgggaaggtggcccctgaggagttcaagaccagcatcggccgggtgaatgcctgcctgaagaaggccctgcctgtgaatgtgaagtggctgctgtgtggctgcctgtgctgctgctgcaccctgggctgcagcctgtggcctgtgatctgcctgaacaagaggaccaggaggagcatccagaagctgattgagtgggagaacaacagactctaccacaaggtgatcctgattgagttcctgcccaagtaccccatcttccggccagactag

SEQ ID NO: 33715 - DNA, 1341 bp, Artificial Sequence
  Description of Artificial Sequence: Synthetic coding sequence
atgcatgagcccagcctgtgtgccaacgtggagtgccccccagcccacacctgcccctgtggggtgcctgcctgcagctgtgcccacgtggagtgccccccagcccacacctgccgctgtggggtgcctgcctgcagccacatgcccatgtggagcgcccggctgctgacccgggcccacgtggagtgccccccagcccacaccagggtgcacgtggagtgccccccagcccacgtgcccatgtggagcgcccacctgctgacctgtgctgatgtggagtgccacctgctgacccacgtgcccatgtggagcgcccggctgctgacctgcccctgtggggtgcctgcctgcagccacgtgcccatgaggtctgcccggctgctgacccgggcccatgctgagtgccccccagcccacacctgcccctgtggggtgcctgcctgcagccacgtgcccatgaggtctgcccggctgctgaccagggcagatgtggagtgccccccagcccacacctgcccctgtggggtgcctgcctgcagccacgtgcccacctggagcgcccggctcatcacccgggcccacgtggagtgcagccctgcccacacctgccgctgtggggtgcctgcctgcagccacgtgcccatgtggagcgtgcggctgctgaccagggcagatgctgaatgtcctccagcccacacctgccgctgtggggtgcctgcctgcagccacgtgcccatgtggagcgcccggctgctgacctgccgctgtggggtgcctgcctgcagccacgtgcccatgtggagcgcccggctgctgacctgccgctgtggggtgcctgcctgcagccacgtgcccatgtggagcgcccggctgctgacccgggcccacgtggagtgccccccagcccacacctgccggcggggcgtgcctgcctgcagccgggcccacatggagtgccccccagcccacacctgccactgcggcgtgcctgcctgcagccacacctgccgctgtggggtgcctgcctgcagccacgtgcccatgtggagcgcccggctgctgacccgggcccacgtggagtgccccccagcccacacccgggcccacgtggagtgccccccagcccacacctgcccctgtggggtgcctgcctgcagccacacctgcccctgtggggtgcctgcctgcagccacaaggccctggcctggtggttctgccgcttccctgtgctgcctgctgagagtgatgctgtgacagtgcacagcacccacggcggcttcctgatccgcttctacgtgaaggaccccttctacatcagcctgcacctggagatcacctag

SEQ ID NO: 33716 - DNA, 1167 bp, Artificial Sequence
  Description of Artificial Sequence: Synthetic coding sequence
gccaacgtggagtgccccccagcccacacctgcccctgtggggtgcctgcctgcagctgtgcccacgtggagtgccccccagcccacacctgccgctgtggggtgcctgcctgcagccacatgcccatgtggagcgcccggctgctgacccgggcccacgtggagtgccccccagcccacaccagggtgcacgtggagtgccccccagcccacgtgcccatgtggagcgcccacctgctgacctgtgctgatgtggagtgccacctgctgacccacgtgcccatgtggagcgcccggctgctgaccagggcagatgctgaatgtcctccagcccacacctgcccctgtggggtgcctgcctgcagccacgtgcccatgaggtctgcccggctgctgacccgggcccatgctgagtgccccccagcccacacctgccggcggggcgtgcctgcctgcagccacgtgcccatgtggagcgcccggctgctgaccagggcagatgctgaatgtcctccagcccacacctgccgctgtggggtgcctgcctgcagccacgtgcccatgtggagcgcccggctgctgacctgccgctgtggggtgcctgcctgcagccacgtgcccatgtggagcgcccggctgctgacctgccgctgtggggtgcctgcctgcagccacgtgcccatgtggagcgcccggctgctgacccgggcccacgtggagtgccccccagcccacacctgccggcggggcgtgcctgcctgcagccgggcccacatggagtgccccccagcccacacctgccactgcggcgtgcctgcctgcagccacacctgccgctgtggggtgcctgcctgcagccacgtgcccatgtggagcgcccggctgctgacccgggcccacgtggagtgccccccagcccacacccgggcccacgtggagtgccccccagcccacacctgcccctgtggggtgcctgcctgcagccacacctgcccctgtggggtgcctgcctgcagccacaaggccctggcctggtggttctgccgcttccctgtgctgcctgctgagagtgatgctgtgacagtgcacagcacccacggcggcttcctgatccgcttctacgtgaaggaccccttctacatcagcctgcacctggagatcacctag

SEQ ID NO: 33717 - DNA, 861 bp, Artificial Sequence
  Description of Artificial Sequence: Synthetic coding sequence
atggccatggagggctactggaggttcctggccctgctgggcagcgccctgctggtgggcttcctgagcgtcatctttgccctggtgtgggtgctgcactaccgggagggcctgggctgggatggcagcgccctggagttcaactggcaccctgtgctgatggtgacaggctttgtgttcatccagggcatcgccatcatcgtgtaccgcctgccctggacctggaagtgcagcaagctgctgatgaagagcatccatgctggcctgaatgctgtggccgccatcctggccatcatctctgtggtggccgtgtttgagaaccacaacgtgaacaacatcgccaacatgtacagcctgcacagctgggtgggcctgattgctgtgatctgctacctgctgcagctgctgagcggcttcagcgtcttcctgctgccctgggcccccctgagcctgcgggccttcctgatgcccatccacgtgtacagcggcatcgtcatctttggaacagtgattgccacagccctgatgggcctgacagagaagctgatcttcagcctgcgggaccctgcctacagcaccttccccccagagggcgtgtttgtgaacaccctgggcctgctgatcctggtgtttggagccctgatcttctggatcgtgacccggccccagtggaagaggcccaaggagcccaacagcaccatcctgcaccccaacggcggcacagagcagggcgcccggggctccatgcctgcctacagcggcaacaacatggacaagagtgacagcgagctgaacagcgaggtggccgccaggaagaggaacctggccctggatgaggccggccagaggagcaccatgtag

SEQ ID NO: 33718 - DNA, 474 bp, Artificial Sequence
  Description of Artificial Sequence: Synthetic coding sequence
atggccatggagggctactggaggttcctggccctgctgggcagcgccctgctggtgggcttcctgagcgtcatctttgccctggtgtgggtgctgcactaccgggagggcctgggctgggatggcagcgccctggagttcaactggcaccctgtgctgatggtgacaggctttgtgttcatccagggcatcgccagcttccgcttcttcagcctgagcgcctccatgggcagcgccttcagccccagcatcagccacgcccacacctgcctcttctggaactgccacctgtggaacagcgactgcaacagcacctacggcatcgaccgggagacagacttcttccctgagaggagctgcatccagtacatcccagcccggcgctgcttcagaaaatatgcctggcccagcgaccccggggtgcggggcccccacttcctggacagccaccagacagccatggagaccagctag

SEQ ID NO: 33719 - DNA, 687 bp, Artificial Sequence
  Description of Artificial Sequence: Synthetic coding sequence
atgctggatgaaggagaggccatcatcgtgtaccgcctgccctggacctggaagtgcagcaagctgctgatgaagagcatccatgctggcctgaatgctgtggccgccatcctggccatcatctctgtggtggccgtgtttgagaaccacaacgtgaacaacatcgccaacatgtacagcctgcacagctgggtgggcctgattgctgtgatctgctacctgctgcagctgctgagcggcttcagcgtcttcctgctgccctgggcccccctgagcctgcgggccttcctgatgcccatccacgtgtacagcggcatcgtcatctttggaacagtgattgccacagccctgatgggcctgacagagaagctgatcttcagcctgcgggaccctgcctacagcaccttccccccagagggcgtgtttgtgaacaccctgggcctgctgatcctggtgtttggagccctgatcttctggatcgtgacccggccccagtggaagaggcccaaggagcccaacagcaccatcctgcaccccaacggcggcacagagcagggcgcccggggctccatgcctgcctacagcggcaacaacatggacaagagtgacagcgagctgaacagcgaggtggccgccaggaagaggaacctggccctggatgaggccggccagaggagcaccatgtag

SEQ ID NO: 33720 - DNA, 729 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatggtggtgttctatggaggagccagcctggtgtaccgcctgccccagagctgggtgggccccaagctgccctggaagctgctgcacgccgccctgcacctgatggcctttgtgctgactgtggtgggcctggtggccgtgttcaccttccacaaccacggccgcacagccaacctgtacagcctgcacagctggctgggcatcaccaccgtcttcctgtttgcctgccagtggttcctgggctttgctgtgttcctgctgccctgggcctccatgtggctgcggagcctgctgaagcccatccacgtgttctttggagctgccatcctgagcctgagcatcgccagcgtcatcagcggcatcaatgagaagctgttcttcagcctgaagaacaccacccggccctaccacagcctgcccagcgaggccgtgtttgccaacagcacaggcatgctggtggtggccttcggcctgctggtgctgtacatcctgctggccagctcctggaagaggcctgagcccggcatcctgacagaccggcagcccctgctgcatgatggagagtag

SEQ ID NO: 33721 - DNA, 780 bp, Artificial Sequence
  Description of Artificial Sequence: Synthetic coding sequence
atgggcaagaacttcagtgacagcttcctgagcagagaatgtgtgatccgcatggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatggtggtgttctacggcggggccagcctggtgtaccgcctgccccagagctgggtgggccccaagctgccctggaagctgctgcatgctgccctgcacctgatggcctttgtgctgactgtggtgggcctggtggccgtgttcaccttccacaaccacggccgcacagccaacctgtacagcctgcacagctggctgggcatcaccaccgtcttcctgtttgcctgccagtggttcctgggctttgctgtgttcctgctgccctgggcctccatgtggctgcggagcctgctgaagcccatccacgtgttcttcggggccgccatcctgagcctgagcatcgccagcgtcatcagcggcatcaatgagaagctgttcttcagcctgaagaacaccacccggccctaccacagcctgcccagcgaggccgtgtttgccaacagcacaggcatgctggtggtggccttcggcctgctggtgctgtacatcctgctggccagctcctggaagaggcctgagcccggcatcctgacagaccggcagcccctgctgcatgatggagagtag

SEQ ID NO: 33722 - DNA, 729 bp, Artificial Sequence; identical to SEQ ID NO: 33720
  Description of Artificial Sequence: Synthetic coding sequence

SEQ ID NO: 33723 - DNA, 549 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatggtggtgttctatggaggagccagcctggtgtaccgcctgccccagagctgggtgggccccaagctgccctggaagctgctgcacgccgccctgcacctgatggcctttgtgctgactgtggtgggcctggtggccgtgttcaccttccacaaccacggccgcacagccaacctgtacagcctgcacagctggctgggcatcaccaccgtcttcctgtttgcctgccagtggttcctgggctttgctgtgttcctgctgccctgggcctccatgtggctgcggagcctgctgaagcccatccacgtgttctttggagctgccatcctgagcctgagcatcgccagcgtcatcagcggcatcaatgagaagctgttcttctcctag

SEQ ID NO: 33724 - DNA, 87 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgtag

SEQ ID NO: 33725 - DNA, 348 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatggtggtgttctatggaggagccagcctggtgtaccgcctgccccagagctgggtgggccccaagctgccctggaagctgctgcacgccgccctgcacctgatggcctttgtgctgactgtggtgggcctggtggccgtgttcaccttccacaaccacggccgcacagccaacctgtacagctag

SEQ ID NO: 33726 - DNA, 603 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatggtggtgttctatggaggagccagcctggtgtaccgcctgccccagagctgggtgggccccaagctgccctggaagctgctgcacgccgccctgcacctgatggcctttgtgctgactgtggtgggcctggtggccgtgttcaccttccacaaccacggccgcacagccaacctgtacagcctgcacagctggctgggcatcaccaccgtcttcctgtttgcctgccagtggttcctgggctttgctgtgttcctgctgccctgggcctccatgtggctgcggagcctgctgaagcccatccacgtgttctttggagctgccatcctgagcctgagcatcgccagcgtcatcagcggcatcaatgagaagctgttcttcagcctgaagaacaccacccggccctaccacagcctgcccagcgaggccgtgtttgcctag

SEQ ID NO: 33727 - DNA, 168 bp, Artificial Sequence
  Description of Artificial Sequence: Synthetic coding sequence
atggtgtctggccgcttctacctgagctgcctgctgctgggcagcctgggctccatgtgcatcctcttcaccatctactggatgcagtactggaggggcggctttgcctggaatggcagcatctacatgttcaactggcaccctgtgctgatggtggccggcatgtag

SEQ ID NO: 33728 - DNA, 918 bp, Artificial Sequence
  Description of Artificial Sequence: Synthetic coding sequence
atgggcatccagaccagccctgtgctgctggccagcctgggcgtgggcctggtgaccctgctgggcctggccgtgggcagctacctggtgagaagaagccggcggccccaggtgaccctgctggaccccaatgagaagtacctgctgcggctgctggacaagaccaccgtgagccacaacaccaagcgcttccgctttgccctgcccacagcccaccacaccctgggcctgcctgtgggcaagcacatctacctgagcaccagaattgatggcagcctggtgatccggccctacacccctgtgaccagtgatgaggaccagggctacgtggacctggtgatcaaggtgtacctgaagggcgtgcaccccaagtttcctgagggcggcaagatgagccagtacctggacagcctgaaggtgggagatgtggtggagttccggggccccagcggcctgctgacctacaccgggaagggccacttcaacatccagcccaacaagaagagccccccagagccccgggtggccaagaagctgggcatgattgctgggggcaccggcatcacccccatgctgcagctgatccgggccatcctgaaggtgcctgaggaccccacccagtgcttcctgctgtttgccaaccagacagagaaggacatcatcctgcgggaggacctggaggagctgcaggcccgctaccccaaccgcttcaagctgtggttcaccctggaccacccccccaaggactgggcctacagcaagggctttgtgacagctgacatgatccgggagcacctgcctgcccctggagatgatgtgctggtgctgctgtgtggccccccacccatggtgcagctggcctgccaccccaacctggacaagctgggctacagccagaagatgaggttcacctactag

SEQ ID NO: 33729 - DNA, 681 bp, Artificial Sequence
  Description of Artificial Sequence: Synthetic coding sequence
tgaacagcccaccacaccctgggcctgcctgtgggcaagcacatctacctgagcaccagaattgatggcagcctggtgatccggccctacacccctgtgaccagtgatgaggaccagggctacgtggacctggtgatcaaggtgtacctgaagggcgtgcaccccaagtttcctgagggcggcaagatgagccagtacctggacagcctgaaggtgggagatgtggtggagttccggggccccagcggcctgctgacctacaccgggaagggccacttcaacatccagcccaacaagaagagccccccagagccccgggtggccaagaagctgggcatgattgctgggggcaccggcatcacccccatgctgcagctgatccgggccatcctgaaggtgcctgaggaccccacccagtgcttcctgctgtttgccaaccagacagagaaggacatcatcctgcgggaggacctggaggagctgcaggcccgctaccccaaccgcttcaagctgtggttcaccctggaccacccccccaagggcatcctgcccatcagcggccaccccaccatccccagcagcagcaagagcaagccctgcccctttgtgaacagcggcttcatcgagatcaacctggccagccactgccagctgggcagcctgagcgcccagacccagtag

SEQ ID NO: 33730 - DNA, 402 bp, Artificial Sequence
  Description of Artificial Sequence: Synthetic coding sequence
atgcagcccctggaggtgggcctggtgcctgccccagctggggagccccggctgacccgctggctgcggcggggcagcggcatcctggcccacctggtggccctgggcttcaccatcttcctgacagccctgagcaggcctggcaccaagacaggccccctgatggaggacagaagtgaaggaggccgggcccgctgggtgatgcctgagatcccagccctgtgggaggctgatgctgggggcagcctggaggtgttcagccctggcaccctgtacagctggccctggaggtctgccagcgcctggctgaagcccagctacagcagccacctgaacaccccctgcagcagcagcgcccctgagaagcacggcagcggcagcacaggccagggccggccctag

SEQ ID NO: 33731 - DNA, 756 bp, Artificial Sequence
  Description of Artificial Sequence: Synthetic coding sequence
atgcagcccctggaggtgggcctggtgcctgccccagctggggagccccggctgacccgctggctgcggcggggcagcggcatcctggcccacctggtggccctgggcttcaccatcttcctgacagccctgagcaggcctggcaccaagacaggccccctgatggaggacagaagtgaaggaggccgggcccgctgggtgatgcctgagatcccagccctgtgggaggctgatgctgggggcagcctggagttctgcctgtgcatggccgaggccatcctgctcttcagccctgagcacagcctcttcttcttctgcagcaggaaggcccgcatccggctgcactgggccggccagaccctggccatcctgtgtgccgccctgggcctgggcttcatcatcagcagcaggaccaggtctgagctgccccacctggtgtcctggcacagctgggtgggcgccctgaccctgctggccacagctgtgcaggccctgtgtggcctgtgcctgctgtgccccagggctgcccgggtgtcccgggtggcccggctgaagctgtaccacctgacctgtggcctggtggtgtacctgatggccaccgtgacagtgctgctgggcatgtacagcgtgtggttccaggcccagatcaagggagctgcctggtacctgtgcctggccctgcctgtgtacccagccctggtgatcatgcaccagatcagccgcagctacctgcccaggaagaagatggagatgtag

SEQ ID NO: 33732 - DNA, 519 bp, Artificial Sequence
  Description of Artificial Sequence: Synthetic coding sequence
atgcagcccctggagttctgcctgtgcatggccgaggccatcctgctcttcagccctgagcacagcctcttcttcttctgcagcaggaaggcccgcatccggctgcactgggccggccagaccctggccatcctgtgtgccgccctgggcctgggcttcatcatcagcagcaggaccaggtctgagctgccccacctggtgtcctggcacagctgggtgggcgccctgaccctgctggccacagctgtgcaggccctgtgtggcctgtgcctgctgtgcccccgggccgcccgggtgtcccgggtggcccggctgaagctgtaccacctgacctgtggcctggtggtgtacctgatggccaccgtgacagtgctgctgggcatgtacagcgtgtggttccaggcccagatcaagggggccgcctggtacctgtgcctggccctgcctgtgtacccagccctggtgatcatgcaccagatcagccgcagctacctgcccaggaagaagatggagatgtag

SEQ ID NO: 33733 - DNA, 690 bp, Artificial Sequence
  Description of Artificial Sequence: Synthetic coding sequence
atgcagcccctggaggtgggcctggtgcctgccccagctggggagccccggctgacccgctggctgcggcggggcagcggcatcctggcccacctggtggccctgggcttcaccatcttcctgacagccctgagcaggcctggcaccagcctcttctcctggcaccctgtgttcatggccctggccttctgcctgtgcatggccgaggccatcctgctcttcagccctgagcacagcctcttcttcttctgcagcaggaaggcccgcatccggctgcactgggccggccagaccctggccatcctgtgtgccgccctgggcctgggcttcatcatcagcagcaggaccaggtctgagctgccccacctggtgtcctggcacagctgggtgggcgccctgaccctgctggccacagctgtgcaggccctgtgtggcctgtgcctgctgtgccccagggctgcccgggtgtcccgggtggcccggctgaagctgtaccacctgacctgtggcctggtggtgtacctgatggccaccgtgacagtgctgctgggcatgtacagcgtgtggttccaggcccagatcaagggagctgcctggtacctgtgcctggccctgcctgtgtacccagccctggtgatcatgcaccagatcagccgcagctacctgcccaggaagaagatggagatgtag

SEQ ID NO: 33734 - DNA, 387 bp, Artificial Sequence
  Description of Artificial Sequence: Synthetic coding sequence
atgcagcccctggaggtgggcctggtgcctgccccagctggggagccccggctgacccgctggctgcggcggggcagcggcatcctggcccacctggtggccctgggcttcaccatcttcctgacagccctgagcaggcctggcaccaagacaggccccctgatggaggacagaagtgaaggaggccgggcccgctgggtgatgcctgagatcccagccctgtgggaggctgatgctgggggcagcctggaggtgttcagccctggcaccctgtacagctggccctggaggatgtatgagagcaccagcttcttcagcggcctgcaggcccggcatgaggcctactggctgagccccatgttcaccgtgctgcccctgcatggatag

SEQ ID NO: 33735 - DNA, 225 bp, Artificial Sequence
  Description of Artificial Sequence: Synthetic coding sequence
atgcccaagtactatgaggacaagccccagggcggggcctgtgccggcctgaaggaggacctgggcgcctgcctgctgcagagcgactgtgtggtgcaggagggcaagagcccccggcagtgcctgaaggagggctactgcaacagcctgaagtatgccttctttgagtgcaagaggtctgtgctggacaacagagcccgcttccggggcaggaagggctactag

SEQ ID NO: 33736 - DNA, 330 bp, Artificial Sequence
  Description of Artificial Sequence: Synthetic coding sequence
atggctgctgtgggcgtcttctctgtgtcccggctgctgggccgcagccggccccagctgggccggcccatgagcagcggggcccatggagaggagggcagcgccaggatgtggaagaccctgaccttctttgtggccctgcccggggtggccgtgtccatgctgaatgtgtacctgaagagccaccacggggagcacgagaggcctgagttcatcgcctacccccacctgcgcatccgcaccaagcccttcccctggggagatggcaaccacaccctcttccacaacccccacgtgaaccccctgcccaccggctatgaagatgaatag

SEQ ID NO: 33737 - DNA, 294 bp, Artificial Sequence
  Description of Artificial Sequence: Synthetic coding sequence
atggccctgcccctgcggcccctgacccggggcctggccagcgctgccaagggcggccacggcggggccggggcccggacctggaggctgctgacctttgtgctggccctgcccagcgtggccctgtgcaccttcaacagctacctgcacagcggccaccggcccaggcctgagttccggccctaccagcacctgcgcatccgcaccaagccctacccctggggagatggcaaccacaccctcttccacaacagccacgtgaaccccctgcccaccggctatgagcacccctag

SEQ ID NO: 33738 - DNA, 267 bp, Artificial Sequence
  Description of Artificial Sequence: Synthetic coding sequence
atgctggatgtggaggcccaggagccccccaagggcaagtggagcaccccaccatttgacccccgcttccccagccagaaccagatccggaactgctaccagaacttcctggactaccaccgctgcctgaagaccaggacccggcggggcaagagcacccagccctgtgagtactacttccgggtgtaccacagcctgtgccccatctcctgggtggagagctggaatgagcagatcaagaatggcatctttgctgggaagatctag

SEQ ID NO: 33739 - DNA, 243 bp, Artificial Sequence
  Description of Artificial Sequence: Synthetic coding sequence
atgttccccctggtgaagagcgccctgaaccggctgcaggtgcgcagcatccagcagaccatggcccggcagagccaccagaagaggaccccagacttccatgacaagtatggaaatgctgtgctggccagcggggccaccttctgcatcgtgacctggacctacgtggccacccaggtgggcatcgagtggaacctgagccctgtgggccgggtgacccccaaggagtggaggaaccagtag

SEQ ID NO: 33740 - DNA, 210 bp, Artificial Sequence
  Description of Artificial Sequence: Synthetic coding sequence
atgtctgtgctgacccccctgctgctgcggggcctgactggaagtgcccggcggctgcctgtgccccgggccaagatccacagcctgcccccagagggcaagctgggcatcatggagctggccgtgggcctgaccagctgctttgtgaccttcctgctgcctgctggctggatcctgagccacctggagacctacagaagacctgagtag

SEQ ID NO: 33741 - DNA, 219 bp, Artificial Sequence
  Description of Artificial Sequence: Synthetic coding sequence
atgcccctgctgcggggccgctgcccagcccggcggcactacagaaggctggccctgctgggcctgcagcctgcccccaggtttgcccacagcggccccccccggcagaggcccctgtctgctgctgagatggctgtgggcctggtggtgttcttcaccaccttcctgaccccagctgcctacgtgctgggcaacctgaagcagttcagaagaaattag

SEQ ID NO: 33742 - DNA, 1092 bp, Artificial Sequence
  Description of Artificial Sequence: Synthetic coding sequence
atggcccctgaggccaccaagaacttcctgcccctgctggatgctgtgtcccgggactttgtgtctgtgctgcaccggcgcatcaagaaggccggcagcggcaactacagcggggacatcagtgatgacctcttccgctttgcctttgagagcatcaccaacgtcatctttggagagcggcagggcatgctggaggaggtggtgaaccctgaggcccagcgcttcattgatgccatctaccagatgttccacacctctgtgcccatgctgaacctgcccccagacctcttccgcctcttccgcaccaagacctggaaggaccacgtggccgcctgggatgtgatcttcagcaaggctgacatctacacccagaacttctactgggagctgcggcagaagggctctgtgcaccacgactaccggggcatcctgtaccgcctgctgggggacagcaagatgagctttgaggacatcaaggccaacgtgacagagatgctggccggcggcgtggacaccacctccatgaccctgcagtggcacctgtatgagatggccaggaacctgaaggtgcaggacatgctgcgggcagaggtgctggccgcccggcaccaggcccagggcgacatggccaccatgctgcagctggtgcccctgctgaaggccagcatcaaggagaccctgcggctgcaccccatctctgtgaccctgcagcgctacctggtgaatgacctggtgctgcgggactacatgatcccagccaagaccctggtgcaggtggccatctatgccctgggccgggagcccaccttcttctttgatcctgaaaattttgaccccacccgctggctgagcaaggacaagaacatcacctacttcaggaacctgggcttcggctggggcgtgcggcagtgcctgggcagaagaattgctgagctggagatgaccatcttcctgatcaacatgctggagaacttccgggtggagatccagcacctgagtgatgtgggcaccaccttcaacctgatcctgatgcctgagaagcccatctccttcaccttctggcccttcaaccaggaggccacccagcagtag

SEQ ID NO: 33743 - DNA, 1566 bp, Artificial Sequence
  Description of Artificial Sequence: Synthetic coding sequence
atgctggccaagggcctgcccccaagatctgtgctggtgaagggctgccagaccttcctgagcgccccccgggagggcctgggccgcctgcgggtgcccaccggggagggcgccggcatcagcaccaggagcccccggcccttcaatgagatccccagccctggggacaatggctggctgaacctgtaccacttctggagggagaccggcacccacaaggtgcacctgcaccacgtgcagaacttccagaagtatggccccatctaccgggagaagctgggcaatgtggagagcgtgtatgtgattgatcctgaagatgtggccctgctcttcaagtctgagggccccaaccctgagcgcttcctgatccccccctgggtggcctaccaccagtactaccagaggcccatcggcgtgctgctgaagaagtctgctgcctggaagaaggacagagtggccctgaaccaggaggtgatggcccctgaggccaccaagaacttcctgcccctgctggatgctgtgtcccgggactttgtgtctgtgctgcaccggcgcatcaagaaggccggcagcggcaactacagcggggacatcagtgatgacctcttccgctttgcctttgagagcatcaccaacgtcatctttggagagcggcagggcatgctggaggaggtggtgaaccctgaggcccagcgcttcattgatgccatctaccagatgttccacacctctgtgcccatgctgaacctgcccccagacctcttccgcctcttccgcaccaagacctggaaggaccacgtggccgcctgggatgtgatcttcagcaaggctgacatctacacccagaacttctactgggagctgcggcagaagggctctgtgcaccacgactaccggggcatcctgtaccgcctgctgggggacagcaagatgagctttgaggacatcaaggccaacgtgacagagatgctggccggcggcgtggacaccacctccatgaccctgcagtggcacctgtatgagatggccaggaacctgaaggtgcaggacatgctgcgggcagaggtgctggccgcccggcaccaggcccagggcgacatggccaccatgctgcagctggtgcccctgctgaaggccagcatcaaggagaccctgcggctgcaccccatctctgtgaccctgcagcgctacctggtgaatgacctggtgctgcgggactacatgatcccagccaagaccctggtgcaggtggccatctatgccctgggccgggagcccaccttcttctttgatcctgaaaattttgaccccacccgctggctgagcaaggacaagaacatcacctacttcaggaacctgggcttcggctggggcgtgcggcagtgcctgggcagaagaattgctgagctggagatgaccatcttcctgatcaacatgctggagaacttccgggtggagatccagcacctgagtgatgtgggcaccaccttcaacctgatcctgatgcctgagaagcccatctccttcaccttctggcccttcaaccaggaggccacccagcagtag

SEQ ID NO: 33744 - DNA, 1092 bp, Artificial Sequence; identical to SEQ ID NO: 33742
  Description of Artificial Sequence: Synthetic coding sequence

SEQ ID NO: 33745 - DNA, 1245 bp, Artificial Sequence
  Description of Artificial Sequence: Synthetic coding sequence
atgctggccaagggcctgcccccaagatctgtgctggtgaagggctgccagaccttcctgagcgccccccgggagggcctgggccgcctgcgggtgcccaccggggagggcgccggcatcagcaccaggagcccccggcccttcaatgagatccccagccctggggacaatggctggctgaacctgtaccacttctggagggagaccggcacccacaaggtgcacctgcaccacgtgcagaacttccagaagtatggccccatctaccgggagaagctgggcaatgtggagagcgtgtatgtgattgatcctgaagatgtggccctgctcttcaagtctgagggccccaaccctgagcgcttcctgatccccccctgggtggcctaccaccagtactaccagaggcccatcggcgtgctgctgaagaagtctgctgcctggaagaaggacagagtggccctgaaccaggaggtgatggcccctgaggccaccaagaacttcctgcccctgctggatgctgtgtcccgggactttgtgtctgtgctgcaccggcgcatcaagaaggccggcagcggcaactacagcggggacatcagtgatgacctcttccgctttgcctttgagagcatcaccaacgtcatctttggagagcggcagggcatgctggaggaggtggtgaaccctgaggcccagcgcttcattgatgccatctaccagatgttccacacctctgtgcccatgctgaacctgcccccagacctcttccgcctcttccgcaccaagacctggaaggaccacgtggccgcctgggatgtgatcttcagcaaggctgacatctacacccagaacttctactgggagctgcggcagaagggctctgtgcaccacgactaccggggcatcctgtaccgcctgctgggggacagcaagatgagctttgaggacatcaaggccaacgtgacagagatgctggccggcggcgtggacaccacctccatgaccctgcagtggcacctgtatgagatggccaggaacctgaaggtgcaggacatgctgcgggcagaggtgctggccgcccggcaccaggcccagggcgacatggccaccatgctgcagctggtgcccctgctgaaggccagcatcaaggagaccctgcggcactggtgcaagtggcccagcatgctgtgggccgagagcccccccagcagcagcaccaggaagatcctgacccagccagatggatag

SEQ ID NO: 33746 - DNA, 861 bp, Artificial Sequence
  Description of Artificial Sequence: Synthetic coding sequence
atgcccagcacccgctgcagcaccccagccagcccctgcagcaccttcccccagacctgcagcgtgtgcagcggcccccggcccaaggaccacgtggccgcctgggatgtgatcttcagcaaggctgacatctacacccagaacttctactgggagctgcggcagaagggctctgtgcaccacgactaccggggcatcctgtaccgcctgctgggggacagcaagatgagctttgaggacatcaaggccaacgtgacagagatgctggccggcggcgtggacaccacctccatgaccctgcagtggcacctgtatgagatggccaggaacctgaaggtgcaggacatgctgcgggcagaggtgctggccgcccggcaccaggcccagggcgacatggccaccatgctgcagctggtgcccctgctgaaggccagcatcaaggagaccctgcggctgcaccccatctctgtgaccctgcagcgctacctggtgaatgacctggtgctgcgggactacatgatcccagccaagaccctggtgcaggtggccatctatgccctgggccgggagcccaccttcttctttgatcctgagaactttgaccccacccgctggctgagcaaggacaagaacatcacctacttcaggaacctgggcttcggctggggcgtgcggcagtgcctgggcagaagaattgctgagctggagatgaccatcttcctgatcaacatgctggagaacttccgggtggagatccagcacctgagtgatgtgggcaccaccttcaacctgatcctgatgcctgagaagcccatctccttcaccttctggcccttcaaccaggaggccacccagcagtag

SEQ ID NO: 33747 - DNA, 435 bp, Artificial Sequence
  Description of Artificial Sequence: Synthetic coding sequence
atgctggccaagggcctgcccccaagatctgtgctggtgaagggctgccagaccttcctgagcgccccccgggagggcctgggccgcctgcgggtgcccaccggggagggcgccggcatcagcaccaggagcccccggcccttcaatgagatccccagccctggggacaatggctggctgaacctgtaccacttctggagggagaccggcacccacaaggtgcacctgcaccacgtgcagaacttccagaagtatggccccatctaccgggagaagctgggcaatgtggagagcgtgtatgtgattgatcctgaagatgtggccctgctcttcaagtctgagggccccaaccctgagcgcttcctgatccccccctgggtggcctaccaccagtactaccagaggcccatcggcgtgctgctgaaccaccactag

SEQ ID NO: 33748 - DNA, 1473 bp, Artificial Sequence
  Description of Artificial Sequence: Synthetic coding sequence
atggaccctgctgtggccctggtgctgtgcctgagctgcctcttcctgctgagcctgtggaggcagagcagcggccggggccgcctgcccagcggccccacccccctgcccatcatcggcaacatcctgcagctggatgtgaaggacatgagcaagagcctgaccaacttcagcaaggtgtatggccctgtgttcaccgtgtacttcggcctgaagcccatcgtggtgctgcacggctatgaggccgtgaaggaggccctgattgaccacggggaggagttcagcggccggggcagcttccctgtggccgagaaggtgaacaagggcctgggcatcctcttcagcaatggcaagcgctggaaggagatccgccgcttctgcctgatgaccctgaggaactttggcatgggcaagaggagcattgaggacagagtgcaggaggaggcccgctgcctggtggaggagctgaggaagaccaatgccagcccctgtgaccccaccttcatcctgggctgtgccccctgcaacgtcatctgcagcgtcatcttccatgacagatttgactacaaggaccagcgcttcctgaacctgatggagaagttcaatgaaaacctgcgcatcctgagcagcccctggatccaggtgtgcaacaacttccctgccctgattgactacctgcccggcagccacaacaagattgctgaaaattttgcctacatcaagagctatgtgctggagcgcatcaaggagcaccaggagagcctggacatgaacagcgcccgggacttcatcgactgcttcctgatcaagatggagcaggagaagcacaaccagcagagcgagttcaccgtggagagcctcatcgccaccgtgacagacatgtttggagctggaacagagaccaccagcaccaccctgcgctatggcctgctgctgctgctgaagtacccagaggtgacagccaaggtgcaggaggagattgaatgtgtggtgggcaggaacagaagcccctgcatgcaggacaggagccacatgccctacacagatgctgtggtgcatgagatccagcgctacatcgacctgctgcccaccaacctgccccatgctgtgacctgtgatgtgaagttcaagaactacctgatccccaagggcaccaccatcatcaccagcctgacctctgtgctgcacaatgacaaggagttccccaaccctgagatgtttgatcctggccacttcctggacaagagcggcaacttcaagaagagtgactacttcatgcccttctctgctgggaagaggatgtgcatgggagagggcctggccaggatggagctgttcctgttcctgaccaccatcctgcagaacttcaacctgaagagccaggtggaccccaaggacatcgacatcacccccatcgccaatgccttcggccgggtgccccccctgtaccagctgtgcttcatccctgtgtag

SEQ ID NO: 33749 - DNA, 1296 bp, Artificial Sequence
  Description of Artificial Sequence: Synthetic coding sequence
atggaccctgctgtggccctggtgctgtgcctgagctgcctcttcctgctgagcctgtggaggcagagcagcggccggggccgcctgcccagcggccccacccccctgcccatcatcggcaacatcctgcagctggatgtgaaggacatgagcaagagcctgaccaacttcagcaaggtgtatggccctgtgttcaccgtgtacttcggcctgaagcccatcgtggtgctgcacggctatgaggccgtgaaggaggccctgattgaccacggggaggagttcagcggccggggcagcttccctgtggccgagaaggtgaacaagggcctgggcatcctcttcagcaatggcaagcgctggaaggagatccgccgcttctgcctgatgaccctgaggaactttggcatgggcaagaggagcattgaggacagagtgcaggaggaggcccgctgcctggtggaggagctgaggaagaccaatgccagcccctgtgaccccaccttcatcctgggctgtgccccctgcaacgtcatctgcagcgtcatcttccatgacagatttgactacaaggaccagcgcttcctgaacctgatggagaagttcaatgaaaacctgcgcatcctgagcagcccctggatccaggagaagcacaaccagcagagcgagttcaccgtggagagcctgattgccaccgtgacagacatgtttggagctggaacagagaccaccagcaccaccctgcgctatggcctgctgctgctgctgaagtacccagaggtgacagccaaggtgcaggaggagattgaatgtgtggtgggcaggaacagaagcccctgcatgcaggacaggagccacatgccctacacagatgctgtggtgcatgagatccagcgctacatcgacctgctgcccaccaacctgccccatgctgtgacctgtgatgtgaagttcaagaactacctgatccccaagggcaccaccatcatcaccagcctgacctctgtgctgcacaatgacaaggagttccccaaccctgagatgtttgaccccggccacttcctggacaagagcggcaacttcaagaagagtgactacttcatgcccttctctgctgggaagaggatgtgcatgggagagggcctggccaggatggagctgttcctgttcctgaccaccatcctgcagaacttcaacctgaagagccaggtggaccccaaggacatcgacatcacccccatcgccaatgccttcggccgggtgccccccctgtaccagctgtgcttcatccctgtgtag

SEQ ID NO: 33750 - DNA, 1473 bp, Artificial Sequence
  Description of Artificial Sequence: Synthetic coding sequence
atggccctgctgctgctgctcttcctgggcctgctgggcctgtggggcctgctgtgtgcctgtgcccaggaccccagccctgctgcccgctggcccccaggcccccggcccctgcccctggtgggcaacctgcacctgctgcggctgagccagcaggacaggagcctgatggagctgtctgaaagatatggccctgtgttcaccgtgcacctgggccggcagaagacagtggtgctgaccggctttgaggccgtgaaggaggccctggccggccctggccaggagctggccgaccggccccccatcgccatcttccagctgatccagagaggaggcggcatcttcttcagcagcggggcccgctggagggctgcccggcagttcaccgtgcgggccctgcacagcctgggcgtgggccgggagcctgtggccgacaagatcctgcaggagctgaagtgcctgagcggccagctggatggctaccggggccggcccttccccctggccctgctgggctgggcccccagcaacatcacctttgccctgctgtttggccgccgctttgactacagagatcctgtgtttgtgtccctgctgggcctgattgatgaggtgatggtgctgctgggcagccctggcctgcagctgttcaacgtgtacccctggctgggcgccctgctgcagctgcacaggcctgtgctgaggaagattgaggaggtgcgggccatcctgcggaccctgctggaggcccggcggccccacgtgtgccctggggaccctgtgtgcagctatgtggatgccctgatccagcagggccagggagatgatcctgagggcctgtttgctgaggccaatgctgtggcctgcaccctggacatggtgatggccggcacagagaccaccagcgccaccctgcagtgggccgccctgctgatgggccgccacccagatgtgcagggccgggtgcaggaggagctggacagagtgctgggccctggccgcaccccccggctggaggaccagcaggccctgccctacaccagcgctgtgctgcacgaggtgcagcgcttcatcaccctgctgccccacgtgccccgctgcacagctgctgacacccagctgggcggcttcctgctgcccaagggcacccctgtgatccccctgctgacctctgtgctgctggatgagacccagtggcagaccccaggccagttcaaccctggccacttcctggatgccaacggccactttgtgaagcgggaggccttcctgcccttctctgctggccggcgggtgtgtgtgggggagcggctggccaggacagagctgttcctgctgtttgctggcctgctgcagcgctaccgcctgctgcccccacctggggtgtccccagccagcctggacaccaccccagcccgggccttcaccatgaggccccgggcccaggccctgtgtgctgtgccccggccctag

SEQ ID NO: 33751 - DNA, 1389 bp, Artificial Sequence
  Description of Artificial Sequence: Synthetic coding sequence
atgctggactttgccatctttgctgtgaccttcctgctggccctggtgggcgctgtgctgtacctgtacccagccagccggcaggccgccggcatccctggcatcacccccacagaggagaaggatggcaacctgcctgacatcgtgaacagcggcagcctgcacgagttcctggtgaacctgcacgagagatatggccctgtggtgtccttctggtttggaagaaggctggtggtgtccctgggcaccgtggatgtgctgaagcagcacatcaaccccaacaagaccagtgacccctttgagaccatgctgaagagcctgctgcgctaccagagcggcggcggctctgtgtctgagaaccacatgaggaagaagctgtatgaaaatggagtgacagacagcctgaagagcaactttgccctgctgctgaagctgtctgaggagctgctggacaagtggctgagctacccagagacccagcacgtgcccctgagccagcacatgctgggctttgccatgaagtctgtgacccagatggtgatgggcagcacctttgaagatgaccaggaggtgatccgcttccagaagaaccacggcaccgtgtggagcgagatcggcaagggcttcctggatggcagcctggacaagaacatgaccaggaagaagcagtatgaagatgccctgatgcagctggagagcgtgctgaggaacatcatcaaggagaggaaaggaagaaacttcagccagcacatcttcatcgacagcctggtgcagggcaacctgaatgaccagcagatcctggaggacagcatgatcttcagcctggccagctgcatcatcacagccaagctgtgcacctgggccatctgcttcctgaccaccagcgaggaggtgcagaagaagctgtatgaggagatcaaccaggtgtttggaaatggacctgtgaccccagagaagattgagcagctgcgctactgccagcacgtgctgtgtgaaacagtgaggacagccaagctgacccctgtgtctgcccagctgcaggacatcgagggcaagattgaccgcttcatcatcccccgggagaccctggtgctgtatgccctgggcgtggtgctgcaggaccccaacacctggcccagcccccacaagtttgatcctgacagatttgatgatgagctggtgatgaagaccttcagcagcctgggcttcagcggcacccaggagtgcccagagctgcgctttgcctacatggtgaccaccgtgctgctgtctgtgctggtgaagaggctgcacctgctgtctgtggagggccaggtgattgagaccaagtatgagctggtgaccagcagccgggaggaggcctggatcaccgtgtccaagcgctactag

SEQ ID NO: 33752 - DNA, 1308 bp, Artificial Sequence
  Description of Artificial Sequence: Synthetic coding sequence
atgctggactttgccatctttgctgtgaccttcctgctggccctggtgggcgctgtgctgtacctgtacccagccagccggcaggccgccggcatccctggcatcacccccacagaggagaaggatggcaacctgcctgacatcgtgaacagcggcagcctgcacgagttcctggtgaacctgcacgagagatatggccctgtggtgtccttctggtttggaagaaggctggtggtgtccctgggcaccgtggatgtgctgaagcagcacatcaaccccaacaagaccagtgacccctttgagaccatgctgaagagcctgctgcgctaccagagcggcggcggctctgtgtctgagaaccacatgaggaagaagctgtatgaaaatggagtgacagacagcctgaagagcaactttgccctgctgctgaagctgtctgaggagctgctggacaagtggctgagctacccagagacccagcacgtgcccctgagccagcacatgctgggctttgccatgaagtctgtgacccagatggtgatgggcagcacctttgaagatgaccaggaggtgatccgcttccagaagaaccacggcacccccagctgcaactggagcctcttcaaggagcaccacaagaggaccaagaggaaggagctgcagagcacctacttcatcgacagcctggtgcagggcaacctgaatgaccagcagatcctggaggacagcatgatcttcagcctggccagctgcatcatcacagccaagctgtgcacctgggccatctgcttcctgaccaccagcgaggaggtgcagaagaagctgtatgaggagatcaaccaggtgtttggaaatggacctgtgaccccagagaagattgagcagctgcgctactgccagcacgtgctgtgtgagaccgtgaggacagccaagctgacccctgtgtctgcccagctgcaggacatcgagggcaagattgaccgcttcatcatcccccgggagaccctggtgctgtatgccctgggcgtggtgctgcaggaccccaacacctggcccagcccccacaagtttgatcctgacagatttgatgatgagctggtgatgaagaccttcagcagcctgggcttcagcggcacccaggagtgcccagagctgcgctttgcctacatggtgaccaccgtgctgctgtctgtgctggtgaagaggctgcacctgctgtctgtggagggccaggtgattgagaccaagtatgagctggtgaccagcagccgggaggaggcctggatcaccgtgtccaagcgctactag

SEQ ID NO: 33753 - DNA, 1539 bp, Artificial Sequence
  Description of Artificial Sequence: Synthetic coding sequence
atgctgtttgagggcctggacctggtgtctgccctggccaccctggccgcctgcctggtgtctgtgaccctgctgctggccgtgtcccagcagctgtggcagctgcgctgggccgccacccgggacaagagctgcaagctgcccatccccaagggctccatgggcttccccctgattggagagaccggccactggctgctgcagggcagcggcttccagagcagccggcgggagaagtatggaaatgtgttcaagacccacctgctgggccggcccctcatccgggtgactggagcagaaaatgtgaggaagatcctgatgggagagcaccacctggtgtccacagagtggcccaggagcaccaggatgctgctgggccccaacacagtgagcaacagcatcggggacatccacaggaacaagaggaaggtgttcagcaagatcttcagccatgaggccctggagagctacctgcccaagatccagctggtgatccaggacaccctgcgggcctggagcagccaccctgaggccatcaacgtgtaccaggaggcccagaagctgaccttcaggatggccatccgggtgctgctgggcttcagcatccctgaggaggacctgggccacctgtttgaggtgtaccagcagtttgtggacaacgtgttcagcctgcctgtggacctgcccttcagcggctaccgccggggcatccaggcccggcagatcctgcagaagggcctggagaaggccatccgggagaagctgcagtgcacccagggcaaggactacctggatgccctggacctgctgattgagagcagcaaggagcacggcaaggagatgaccatgcaggagctgaaggatggcaccctggagctgatctttgctgcctatgccaccacagccagcgccagcaccagcctcatcatgcagctgctgaagcaccccaccgtgctggagaagctgagagatgagctgcgggcccacggcatcctgcacagcggcggctgcccctgtgagggcaccctgcggctggacaccctgagcggcctgcgctacctggactgtgtgatcaaggaggtgatgaggctcttcacccccatcagcggcggctacagaacagtgctgcagacctttgagctggatggcttccagatccccaagggctggagcgtgatgtacagcatccgggacacccatgacacagcccctgtgttcaaggatgtgaatgtgtttgatcctgaccgcttcagccaggcccggtctgaggacaaggatggccgcttccactacctgccctttggaggaggagtgaggacctgcctgggcaagcacctggccaagctgttcctgaaggtgctggccgtggagctggccagcaccagcagatttgagctggccaccaggaccttcccccgcatcaccctggtgcctgtgctgcaccctgtggatggcctgtctgtgaagttcttcggcctggacagcaaccagaatgagatcctgcctgagacagaggccatgctgagcgccaccgtgtag

SEQ ID NO: 33754 - DNA, 1314 bp, Artificial Sequence
  Description of Artificial Sequence: Synthetic coding sequence
atgctgtttgagggcctggacctggtgtctgccctggccaccctggccgcctgcctggtgtctgtgaccctgctgctggccgtgtcccagcagctgtggcagctgcgctgggccgccacccgggacaagagctgcaagctgcccatccccaagggctccatgggcttccccctgattggagagaccggccactggctgctgcaggtgttcagcaagatcttcagccatgaggccctggagagctacctgcccaagatccagctggtgatccaggacaccctgcgggcctggagcagccaccctgaggccatcaacgtgtaccaggaggcccagaagctgaccttcaggatggccatccgggtgctgctgggcttcagcatccctgaggaggacctgggccacctgtttgaggtgtaccagcagtttgtggacaacgtgttcagcctgcctgtggacctgcccttcagcggctacagaagaggcatccaggcccggcagatcctgcagaagggcctggagaaggccatccgggagaagctgcagtgcacccagggcaaggactacctggatgccctggacctgctgattgagagcagcaaggagcacggcaaggagatgaccatgcaggagctgaaggatggcaccctggagctgatctttgctgcctatgccaccacagccagcgccagcaccagcctcatcatgcagctgctgaagcaccccaccgtgctggagaagctgagagatgagctgcgggcccacggcatcctgcacagcggcggctgcccctgtgagggcaccctgcggctggacaccctgagcggcctgcgctacctggactgtgtgatcaaggaggtgatgaggctcttcacccccatcagcggcggctacagaacagtgctgcagacctttgagctggatggcttccagatccccaagggctggagcgtgatgtacagcatccgggacacccatgacacagcccctgtgttcaaggatgtgaatgtgtttgatcctgaccgcttcagccaggcccggtctgaggacaaggatggccgcttccactacctgccctttggaggcggcgtgaggacctgcctgggcaagcacctggccaagctgttcctgaaggtgctggccgtggagctggccagcaccagcagatttgagctggccaccaggaccttcccccgcatcaccctggtgcctgtgctgcaccctgtggatggcctgtctgtgaagttcttcggcctggacagcaaccagaatgagatcctgcctgagacagaggccatgctgagcgccaccgtgtag

SEQ ID NO: 33755 - DNA, 1368 bp, Artificial Sequence
  Description of Artificial Sequence: Synthetic coding sequence
atgtctgtgtctgtgctgagccccagccggcggctgggcggcgtgtctggcatcctgcaggtgaccagcctgctgatcctgctgctgctgctgatcaaggccgcccagctgtacctgcaccggcagtggctgctgaaggccctgcagcagttcccctgcccccccagccactggctgtttggccacatccaggagttccagcacgaccaggagctgcagaggatccaggagcgggtgaagaccttccccagcgcctgcccctactggatctggggcggcaaggtgcgggtgcagctgtatgaccctgactacatgaaggtgatcctgggccgcagtgaccccaagagccacggcagctacaagttcctggcccccagaattggctacggcctgctgctgctgaatggccagacctggttccagcacaggaggatgctgaccccagccttccacaatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagagcgccttcagccaccagggcagcatccaggtggacaggaacagccagagctacatccaggccatcagtgacctgaacagcctggtgttctgctgcatgagaaatgccttccatgaaaatgacaccatctacagcctgaccagcgctggccgctggacccaccgggcctgccagctggcccaccagcacacagaccaggtgatccagctgaggaaggcccagctgcagaaggagggggagctggagaagatcaagaggaagaggcacctggacttcctggacatcctgctgctggccaagatggagaatggcagcatcctgagtgacaaggacctgcgggcagaggtggacaccttcatgtttgagggccatgacaccacagccagcggcatctcctggatcctgtatgccctggccacccaccccaagcaccaggagcgctgccgggaggagatccacggcctgctgggagatggagccagcatcacctggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaacctggaggtgtttgaccccagcagatttgcccctggcagcgcccagcacagccacgccttcctgcccttcagcggcggcagcaggtag

SEQ ID NO: 33756 - DNA, 1266 bp, Artificial Sequence
  Description of Artificial Sequence: Synthetic coding sequence
atgtctgtgtctgtgctgagccccagccggcggctgggcggcgtgtctggcatcctgcaggtgaccagcctgctgatcctgctgctgctgctgatcaaggccgcccagctgtacctgcaccggcagtggctgctgaaggccctgcagcagttcccctgcccccccagccactggctgtttggccacatccaggagttccagcacgaccaggagctgcagaggatccaggagcgggtgaagaccttccccagcgcctgcccctactggatctggggcggcaaggtgcgggtgcagctgtatgaccctgactacatgaaggtgatcctgggccgcagtgaccccaagagccacggcagctacaagttcctggcccccagaattggctacggcctgctgctgctgaatggccagacctggttccagcacaggaggatgctgaccccagccttccacaatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagagcgccttcagccaccagggcagcatccaggtggaccggcccagcgaccccacagaggagggcagcaccacagaaggaggaggagctggggaggaccaggaggaggaggccctgggcttcagcggccacccccccctgggccagagggcccctggcctgccccggccctgctggtgcagcggctggaactgcttcaggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaacctggaggtgtttgaccccagcagatttgcccctggcagcgcccagcacagccacgccttcctgcccttcagcggcggcagcaggaactgcatcggcaagcagtttgccatgaaccagctgaaggtggcccgggccctgaccctgctgcgctttgagctgctgcctgaccccacccgcatccccatccccatggcccggctggtgctgaagagcaagaatggcatccacctgcggctgcggcggctgcccaacccctgtgaggacaaggaccagctgtag

SEQ ID NO: 33757 - DNA, 1560 bp, Artificial Sequence
  Description of Artificial Sequence: Synthetic coding sequence
atgtctgtgtctgtgctgagccccagccggcggctgggcggcgtgtctggcatcctgcaggtgaccagcctgctgatcctgctgctgctgctgatcaaggccgcccagctgtacctgcaccggcagtggctgctgaaggccctgcagcagttcccctgcccccccagccactggctgtttggccacatccaggagttccagcacgaccaggagctgcagaggatccaggagcgggtgaagaccttccccagcgcctgcccctactggatctggggcggcaaggtgcgggtgcagctgtatgaccctgactacatgaaggtgatcctgggccgcagtgaccccaagagccacggcagctacaagttcctggcccccagaattggctacggcctgctgctgctgaatggccagacctggttccagcacaggaggatgctgaccccagccttccacaatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagagcgccttcagccaccagggcagcatccaggtggacaggaacagccagagctacatccaggccatcagtgacctgaacagcctggtgttctgctgcatgagaaatgccttccatgaaaatgacaccatctacagcctgaccagcgctggccgctggacccaccgggcctgccagctggcccaccagcacacagaccaggtgatccagctgaggaaggcccagctgcagaaggagggggagctggagaagatcaagaggaagaggcacctggacttcctggacatcctgctgctggccaagatggagaatggcagcatcctgagtgacaaggacctgcgggcagaggtggacaccttcatgtttgagggccatgacaccacagccagcggcatctcctggatcctgtatgccctggccacccaccccaagcaccaggagcgctgccgggaggagatccacggcctgctgggagatggagccagcatcacctggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaacctggaggtgtttgaccccagcagatttgcccctggcagcgcccagcacagccacgccttcctgcccttcagcggcggcagcaggaactgcatcggcaagcagtttgccatgaaccagctgaaggtggcccgggccctgaccctgctgcgctttgagctgctgcctgaccccacccgcatccccatccccatggcccggctggtgctgaagagcaagaatggcatccacctgcggctgcggcggctgcccaacccctgtgaggacaaggaccagctgtag

SEQ ID NO: 33758 - DNA, 1536 bp, Artificial Sequence
  Description of Artificial Sequence: Synthetic coding sequence
atggtgcccagcttcctgagcctgtccttcagcagcctgggcctgtgggccagcggcctcatcctggtgctgggcttcctgaagctgatccacctgctgctgcggcggcagaccctggccaaggccatggacaagtttcctggcccccccacccactggctgtttggacatgccctggagatccaggagaccggcagcctggacaaggtggtgtcctgggcccaccagttcccctatgcccaccccctgtggtttggccagttcatcggcttcctgaacatctatgagccagactatgccaaggctgtgtacagcagaggagaccccaaggccccagatgtgtatgacttcttcctgcagtggattggccggggcctgctggtgctggagggccccaagtggctgcagcacaggaagctgctgaccccaggcttccactatgatgtgctgaagccctacgtggccgtgttcacagagagcacccgcatcatgctggacaagtgggaggagaaggcccgggagggcaagagctttgacatcttctgtgatgtgggccacatggccctgaacaccctgatgaagtgcaccttcggccgcggggacaccggcctgggccaccgggacagcagctactacctggccgtgtctgacctgaccctgctgatgcagcagaggctggtgtccttccagtaccacaatgacttcatctactggctgaccccccacggccgccgcttcctgcgggcctgccaggtggcccatgaccacacagaccaggtgatccgggagaggaaggccgccctgcaggatgagaaggtgaggaagaagatccagaacagaagacacctggacttcctggacatcctgctgggcgccagagatgaagatgacatcaagctgagtgatgctgacctgcgggcagaggtggacaccttcatgtttgagggccatgacaccaccaccagcggcatctcctggttcctgtactgcatggccctgtacccagagcaccagcaccgctgccgggaggaggtgcgggagatcctgggggaccaggacttcttccagtgggatgacctgggcaagatgacctacctgaccatgtgcatcaaggagagcttccggctgtacccacctgtgccccaggtgtaccggcagctgagcaagcctgtgacctttgtggatggccgcagcctgcctgctggcagcctcatctccatgcacatctatgccctgcacaggaacagcgctgtgtggccagaccctgaggtgtttgacagcctgcgcttcagcacagaaaatgccagcaagaggcacccctttgccttcatgcccttctctgctggccccaggaactgcatcggccagcagtttgccatgtctgagatgaaggtggtgacagccatgtgcctgctgcgctttgagttcagcctggaccccagccggctgcccatcaagatgccccagctggtgctgcggagcaagaatggcttccacctgcacctgaagcccctgggccctggcagcggcaagtag

SEQ ID NO: 33759 - DNA, 1494 bp, Artificial Sequence
  Description of Artificial Sequence: Synthetic coding sequence
atggtgcccagcttcctgagcctgtccttcagcagcctgggcctgtgggccagcggcctcatcctggtgctgggcttcctgaagctgatccacctgctgctgcggcggcagaccctggccaaggccatggacaagtttcctggcccccccacccactggctgtttggacatgccctggagatccaggagaccggcagcctggacaaggtggtgtcctgggcccaccagttcccctatgcccaccccctgtggtttggccagttcatcggcttcctgaacatctatgagccagactatgccaaggctgtgtacagcagaggaggccggggcctgctggtgctggagggccccaagtggctgcagcacaggaagctgctgaccccaggcttccactatgatgtgctgaagccctacgtggccgtgttcacagagagcacccgcatcatgctggacaagtgggaggagaaggcccgggagggcaagagctttgacatcttctgtgatgtgggccacatggccctgaacaccctgatgaagtgcaccttcggccgcggggacaccggcctgggccacagccgggacagcagctactacctggccgtgtctgacctgaccctgctgatgcagcagaggctggtgtccttccagtaccacaatgacttcatctactggctgaccccccacggccgccgcttcctgcgggcctgccaggtggcccatgaccacacagaccaggtgatccgggagaggaaggccgccctgcaggatgagaaggtgaggaagaagatccagaacagaagacacctggacttcctggacatcctgctgggcgccagagatgaagatgacatcaagctgagtgatgctgacctgcgggcagaggtggacaccttcatgtttgagggccatgacaccaccaccagcggcatctcctggttcctgtactgcatggccctgtacccagagcaccagcaccgctgccgggaggaggtgcgggagatcctgggggaccaggacttcttccagtgggatgacctgggcaagatgacctacctgaccatgtgcatcaaggagagcttccggctgtacccacctgtgccccaggtgtaccggcagctgagcaagcctgtgacctttgtggatggccgcagcctgcctgctggcagcctcatctccatgcacatctatgccctgcacaggaacagcgctgtgtggccagaccctgaggtgtttgacagcctgcgcttcagcacagaaaatgccagcaagaggcacccctttgccttcatgcccttctctgctggccccaggaactgcatcggccagcagtttgccatgtctgagatgaaggtggtgacagccatgtgcctgctgcgctttgagttcagcctggaccccagccggctgcccatcaagatgccccagctggtgctgcggagcaagaatggcttccacctgcacctgaagcccctgggccctggcagcggcaagtag

SEQ ID NO: 33760 - DNA, 1539 bp, Artificial Sequence
  Description of Artificial Sequence: Synthetic coding sequence
atggtgcccagcttcctgagcctgtccttcagcagcctgggcctgtgggccagcggcctcatcctggtgctgggcttcctgaagctgatccacctgctgctgcggcggcagaccctggccaaggccatggacaagtttcctggcccccccacccactggctgtttggacatgccctggagatccaggagaccggcagcctggacaaggtggtgtcctgggcccaccagttcccctatgcccaccccctgtggtttggccagttcatcggcttcctgaacatctatgagccagactatgccaaggctgtgtacagcagaggagaccccaaggccccagatgtgtatgacttcttcctgcagtggattggccggggcctgctggtgctggagggccccaagtggctgcagcacaggaagctgctgaccccaggcttccactatgatgtgctgaagccctacgtggccgtgttcacagagagcacccgcatcatgctggacaagtgggaggagaaggcccgggagggcaagagctttgacatcttctgtgatgtgggccacatggccctgaacaccctgatgaagtgcaccttcggccgcggggacaccggcctgggccacagccgggacagcagctactacctggccgtgtctgacctgaccctgctgatgcagcagaggctggtgtccttccagtaccacaatgacttcatctactggctgacccctcatggaagacgcttcctgcgggcctgccaggtggcccatgaccacacagaccaggtgatccgggagaggaaggccgccctgcaggatgagaaggtgaggaagaagatccagaacagaagacacctggacttcctggacatcctgctgggcgccagagatgaagatgacatcaagctgagtgatgctgacctgcgggcagaggtggacaccttcatgtttgagggccatgacaccaccaccagcggcatctcctggttcctgtactgcatggccctgtacccagagcaccagcaccgctgccgggaggaggtgcgggagatcctgggggaccaggacttcttccagtgggatgacctgggcaagatgacctacctgaccatgtgcatcaaggagagcttccggctgtacccacctgtgccccaggtgtaccggcagctgagcaagcctgtgacctttgtggatggccgcagcctgcctgctggcagcctcatctccatgcacatctatgccctgcacagaaattctgctgtgtggccagaccctgaggtgtttgacagcctgcgcttcagcacagaaaatgccagcaagaggcacccctttgccttcatgcccttctctgctggccccaggaactgcatcggccagcagtttgccatgtctgagatgaaggtggtgacagccatgtgcctgctgcgctttgagttcagcctggaccccagccggctgcccatcaagatgccccagctggtgctgcggagcaagaatggcttccacctgcacctgaagcccctgggccctggcagcggcaagtag

SEQ ID NO: 33761 - DNA, 573 bp, Artificial Sequence
  Description of Artificial Sequence: Synthetic coding sequence
atgctgaccccagccttccacttcaacatcctgaagccctacatgaagatcttcaatgaatctgtgaacatcatgcacgccaagtggcagctgctggccagcgagggcagcgcctgcctggacatgtttgagcacatcagcctgatgaccctggacagcctgcagaagtgtgtgttctcctttgacagccactgccaggagaagcccagcgagtacatcgccgccatcctggagctgagcgccctggtgtccaagaggcaccacgagatcctgctgcacatcgacttcctgtactacctgaccccagatggccagcgcttccggcgggcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggccatgacccccaggcctgtggtgtccccaggcagctgcaccaccctgcagagcacccagaacaccaggtctgctgctggaagacgctgcaagaacttctag

SEQ ID NO: 33762 - DNA, 1974 bp, Artificial Sequence
  Description of Artificial Sequence: Synthetic coding sequence
atggccagcgccaggaaggccagccggcccatgagagatgtgtttggagacttcagtgatgtgtccctggaggacagcaccatggaggagatccggaacttccagatcagcaggaacctgaccaagatcgcccctggccacagccgcttcctgaagaggaaccagaccctggatgagaagcacctgctgctgaaggagaaccctgtgctgggcagcggcccccggctggccagctgcaggcctcccaccacagccagccgcatccgggccaatgctgccctgatgaagctggcccagctggagacccgcatcatgaacaggaagctgcagaggaacctgagtgacacagaaagtgacagcatgacagcagatgctggcctgcccaagagagctgaccgcatcctgagcggcggggccctggagctggccagccagaacacagacaagaccagccagaaccaggcccgggagctgcctgtgacagagaacaatgcccagaatgccaaggtgagccgcttcctgaagaagaagcaggcccctgtggagaacatcagccctgaggccccagctgggaaggagaggaccctgcagacccccaagcagaaggagcccgcccggacctttgacagcccagacagtgatgaggaggagatgaaggtgctgctgggcagcctgatggacagcagccgggagaagaacaccaaccagggcttcagcagcgccaacgtgtctgaggaggaggagaggaagctgttctctgtgcccagccagctgcgggccttcaccgtgcccagcgtggagctgagcagcgccaagcccagccagaccagccacctgcccaccagcctggccgctgacaggaccctgcacagcaccaggagcagagctgactacccccagagccacgtgtccagtgacacagccagccacaccccatctgtgtccatcactggagccttcagcaacagcgtgtccctgaagatgggccacgtgaagctggtgagcagccctggccgctctgaggccgagaccgtggatgagcctgtgtctgagggcgcagatgacagcctggatgagttccgcatcaacatcctgagcctggatggcctggccccagctgtgtctgagaacagcgacctggagcaggaggaggagagcgcccagaggcagaagacagctgggaagatcttccgggcagaggccagcacaggccaggatgccccccggcaggcccaggcccgctcctgggccagccagggcaaggccgccagcgcagaaggagatgagagcgaggtgtctgagcacctgagcgccagcagcgccagcgccatccagcaggacagcaccagctccatgcagccccccagcgaggcccccatggtgaacacagtgagcagcgcctacagcgaggactttgagaacagccccagcctgacagccagcgagcccacagcccacagcaaggagagcctggacaggaccctggatgccctgtctgagagcagcagctctgtgaagacagacctgccccagacagctgagagcaggaagaagagcggccgccacgtgaccagggtgctggtgaaggacacagctgtgcagaccccagaccctgccttcacctatgagtggaccaaggtggcctccatggccgccatgggccctgccctgggcggggcctacgtggaccccacccccatcgccaaccacgtgatctctgcagatgccatcgaggccctgacagcctacagccctgctgtgctggccctgcatgatgtgctgaagcagcagctgagcctgacccagcagttcatccaggccagccgccacctgcacgccagcctgctgcggagcctggatgctgacagcttccactaccacaccctggaggaggccaaggagtacatccgctgccacaggcctgcccccctgaccatggaggatgccctggaggaggtgaacaaggagctgtag

SEQ ID NO: 33763 - DNA, 1116 bp, Artificial Sequence
  Description of Artificial Sequence: Synthetic coding sequence
atgctgaccccagccttccacttcaacatcctgaagccctacatgaagatcttcaatgaatctgtgaacatcatgcacgccaagtggcagctgctggccagcgagggcagcgcctgcctggacatgtttgagcacatcagcctgatgaccctggacagcctgcagaagtgtgtgttctcctttgacagccactgccaggagaagcccagcgagtacatcgccgccatcctggagctgagcgccctggtgtccaagaggcaccacgagatcctgctgcacatcgacttcctgtactacctgaccccagatggccagcgcttccggcgggcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggatgaagatggcaagaagctgagtgatgaggacatccgggcagaggccgacaccttcatgtttgagggccatgacaccacagccagcggcctgtcctgggtgctgtaccacctggccaagcaccctgagtaccaggagcgctgccggcaggaggtgcaggagctgctgaaggaccgggagcccaaggagattgagtgggatgacctggcccacctgcccttcctgaccatgtgcatgaaggagagcctgcggctgcacccccctgtgcctgtgatcagccgccacgtgacccaggacatcgtgctgcctgatggccgggtcatccccaagggcatcatctgcctgatctctgtgtttggcacccaccacaacccagctgtgtggccagaccctgaggtgtatgaccccttccgctttgatcctgagaacatcaaggagaggagccccctggccttcatccccttctctgctggccccaggaactgcatcggccagacctttgccatggccgagatgaaggtggtgctggccctgaccctgctgcgcttccgggtgctgcctgaccacacagagcccaggaggaagccagagctggtgctgcgggcagagggcggcctgtggctgcgggtggagcccctgtcctag

SEQ ID NO: 33764 - DNA, 1530 bp, Artificial Sequence
  Description of Artificial Sequence: Synthetic coding sequence
atggagttctcctggctggagacccgctgggcccggcccttctacctggcctttgtgttctgcctggccctgggcctgctgcaggccatcaagctgtacctgcggcggcagaggctgctgcgggacctgcggcccttccctgccccacccacccactggttcctgggccaccagaagttcatccaggatgacaacatggagaagctggaggagatcatcgagaagtacccccgggccttccccttctggattggccccttccaggccttcttctgcatctatgaccctgactatgccaagaccctgctgagcaggacagaccccaagagccagtacctgcagaagttcagcccccccctgctgggcaagggcctggccgccctggatggccccaagtggttccagcaccggcggctgctgaccccaggcttccacttcaacatcctgaaggcctacatcgaggtgatggcccacagcgtgaagatgatgctggacaagtgggagaagatctgcagcacccaggacacctctgtggaggtgtatgagcacatcaacagcatgagcctggacatcatcatgaagtgtgccttcagcaaggagaccaactgccagaccaacagcacccatgacccctatgccaaggccatctttgagctgagcaagatcatcttccaccggctgtacagcctgctgtaccacagcgacatcatcttcaagctgagcccccagggctaccgcttccagaagctgagccgggtgctgaaccagtacacagacaccatcatccaggagaggaagaagagcctgcaggccggcgtgaagcaggacaacacccccaagaggaagtaccaggacttcctggacatcgtgctgagcgccaaggatgaaagtggcagcagcttcagtgacattgatgtgcacagcgaggtgtccaccttcctgctggccggccatgacaccctggccgccagcatctcctggatcctgtactgcctggccctgaaccctgagcaccaggagcgctgccgggaggaggtgcggggcatcctgggagatggcagcagcatcacctgggaccagctgggggagatgagctacaccaccatgtgcatcaaggagacctgccgcctcatcccagctgtgcccagcatcagccgggacctgagcaagcccctgaccttcccagatggctgcaccctgcctgctggcatcaccgtggtgctgagcatctggggcctgcaccacaacccagctgtgtggaagaaccccaaggtgtttgaccccctgcgcttcagccaggagaacagcgaccagaggcacccctatgcctacctgcccttctctgctggcagcaggaactgcatcggccaggagtttgccatgattgagctgaaggtgaccatcgccctgatcctgctgcacttccgggtgaccccagaccccacccggcccctgaccttccccaaccacttcatcctgaagcccaagaatggcatgtacctgcacctgaagaagctgtctgagtgctag

SEQ ID NO: 33765 - DNA, 1527 bp, Artificial Sequence
  Description of Artificial Sequence: Synthetic coding sequence
atgatgtggggcggcggcctggacctgtgccccatgcctggccagctgaagtttcctccctgcctgagccgctgcctgctgtgggagccccccagcctgtacctgacccagcccaccagcagcctggccgagccccaggccctgatctgcatgaccagcagcagcagcggcctcttcatccaggatgacaacatggagaagctggaggagatcatcgagaagtacccccgggccttccccttctggattggccccttccaggccttcttctgcatctatgaccctgactatgccaagaccctgctgagcaggacagaccccaagagccagtacctgcagaagttcagcccccccctgctgggcaagggcctggccgccctggatggccccaagtggttccagcaccggcggctgctgaccccaggcttccacttcaacatcctgaaggcctacatcgaggtgatggcccacagcgtgaagatgatgctggacaagtgggagaagatctgcagcacccaggacacctctgtggaggtgtatgagcacatcaacagcatgagcctggacatcatcatgaagtgtgccttcagcaaggagaccaactgccagaccaacagcacccatgacccctatgccaaggccatctttgagctgagcaagatcatcttccaccggctgtacagcctgctgtaccacagcgacatcatcttcaagctgagcccccagggctaccgcttccagaagctgagccgggtgctgaaccagtacacagacaccatcatccaggagaggaagaagagcctgcaggccggcgtgaagcaggacaacacccccaagaggaagtaccaggacttcctggacatcgtgctgagcgccaaggatgagagcggcagcagcttcagtgacattgatgtgcacagcgaggtgtccaccttcctgctggccggccatgacaccctggccgccagcatctcctggatcctgtactgcctggccctgaaccctgagcaccaggagcgctgccgggaggaggtgcggggcatcctgggagatggcagcagcatcacctgggaccagctgggggagatgagctacaccaccatgtgcatcaaggagacctgccgcctcatcccagctgtgcccagcatcagccgggacctgagcaagcccctgaccttcccagatggctgcaccctgcctgctggcatcaccgtggtgctgagcatctggggcctgcaccacaacccagctgtgtggaagaaccccaaggtgtttgaccccctgcgcttcagccaggagaacagcgaccagaggcacccctatgcctacctgcccttctctgctggcagcaggaactgcatcggccaggagtttgccatgattgagctgaaggtgaccatcgccctgatcctgctgcacttccgggtgaccccagaccccacccggcccctgaccttccccaaccacttcatcctgaagcccaagaatggcatgtacctgcacctgaagaagctgtctgaatgttag

SEQ ID NO: 33766 - DNA, 1518 bp, Artificial Sequence
  Description of Artificial Sequence: Synthetic coding sequence
atggagcccagctggctgcaggagctgatggcccaccccttcctgctgctgatcctgctgtgcatgagcctgctgctcttccaggtgatccggctgtaccagaggcggcgctggatgatccgggccctgcacctgtttcctgcccccccagcccactggttctacggccacaaggagttctaccctgtgaaggagtttgaggtgtaccacaagctgatggagaagtacccctgtgctgtgcccctgtgggtgggccccttcaccatgttcttctctgtgcatgaccctgactatgccaagatcctgctgaagaggcaggaccccaagtctgctgtgagccacaagatcctggagagctgggtgggccggggcctggtgaccctggatggcagcaagtggaagaagcaccggcagatcgtgaagccaggcttcaacatcagcatcctgaagatcttcatcaccatgatgtctgagagcgtgaggatgatgctgaacaagtgggaggagcacatcgcccagaacagccggctggagctgttccagcacgtgtccctgatgaccctggacagcatcatgaagtgtgccttcagccaccagggcagcatccagctggacagcaccctggacagctacctgaaggctgtgttcaacctgagcaagatcagcaaccagaggatgaacaacttcctgcaccacaatgacctggtgttcaagttcagcagccagggccagatcttcagcaagttcaaccaggagctgcaccagttcacagagaaggtgatccaggacaggaaggagagcctgaaggacaagctgaagcaggacaccacccagaagaggcgctgggacttcctggacatcctgctgagcgccaagtctgagaacaccaaggacttcagcgaggccgacctgcaggccgaggtgaagaccttcatgtttgctggccatgacaccaccagcagcgccatctcctggatcctgtactgcctggccaagtacccagagcaccagcagcgctgcagagatgagatccgggagctgctgggagatggcagcagcatcacctgggagcacctgagccagatgccctacaccaccatgtgcatcaaggaatgtctgcggctgtatgcccctgtggtgaacatcagccggctgctggacaagcccatcaccttcccagatggccgcagcctgcctgctggcatcaccgtcttcatcaacatctgggccctgcaccacaacccctacttctgggaggacccccaggtgttcaaccccctgcgcttcagccgggagaacagcgagaagatccacccctatgccttcatccccttctctgctggcctgaggaactgcatcggccagcactttgccatcatcgagtgcaaggtggccgtggccctgaccctgctgcgcttcaagctggccccagaccacagccggcccccccagcctgtgcggcaggtggtgctgaagagcaagaatggcatccacgtgtttgccaagaaggtgtgctag

SEQ ID NO: 33767 - DNA, 1809 bp, Artificial Sequence
  Description of Artificial Sequence: Synthetic coding sequence
atgcccagcgccaagcagaggggcagcaagggcggccatggagctgccagccccagcgagaagggggcccaccccagcggcggcgcagatgatgtggccaagaagcccccaccagccccccagcagcccccacctcctccagccccccacccccagcagcacccccagcagcacccccagaaccaggcccacggcaagggcggccacagaggaggcggcggcggcggcggcaagagcagcagcagcagcagcgccagcgctgctgctgctgctgctgctgccagcagcagcgccagctgcagccggcggctgggccgggccctgaacttcctgttctacctggccctggtggccgccgccgccttcagcggctggtgtgtgcaccacgtgctggaggaggtgcagcaggtgcggcgcagccaccaggacttcagccggcagcgggaggagctgggccagggcctgcagggcgtggagcagaaggtgcagagcctgcaggccaccttcggcacctttgagagcatcctgcggagcagccagcacaagcaggacctgacagagaaggctgtgaagcagggcgagagcgaggtgagccgcatcagcgaggtgctgcagaagctgcagaatgagatcctgaaggacctgagtgatggcatccacgtggtgaaggatgcccgggagcgggacttcaccagcctggagaacacagtggaggagcggctgacagagctgaccaagagcatcaatgacaacatcgccatcttcacagaggtgcagaagaggagccagaaggagatcaatgacatgaaggccaaggtggccagcctggaggagagcgagggcaacaagcaggacctgaaggccctgaaggaggccgtgaaggagatccagaccagcgccaagagccgggagtgggacatggaggccctgcggagcaccctgcagaccatggagagtgacatctacacagaggtgcgggagctggtgtccctgaagcaggagcagcaggccttcaaggaggccgctgacacagagcggctggccctgcaggccctgacagagaagctgctgcggtctgaggagagcgtgtcccggctgcctgaggagatccggcggctggaggaggagctgcggcagctgaagagtgacagccacggccccaaggaggatggcggcttccgccacagcgaggcctttgaggccctgcagcagaagagccagggcctggacagccggctgcagcacgtggaggatggagtgctgtccatgcaggtggccagcgcccggcagacagagagcctggagagcctgctgagcaagagccaggagcacgagcagaggctggccgccctgcagggccgcctggagggcctgggcagcagcgaggccgaccaggacggcctggccagcacagtgcgcagcctgggggagacccagctggtgctgtatggagatgtggaggagctgaagaggtctgtgggggagctgcccagcacagtggagagcctgcagaaggtgcaggagcaggtgcacaccctgctgagccaggaccaggcccaggccgcccggctgcccccccaggacttcctggaccggctgagcagcctggacaacctgaaggcctctgtgtcccaggtggaggccgacctgaagatgctgaggacagctgtggacagcctggtggcctacagcgtgaagattgagaccaatgaaaacaacctggagagcgccaagggcctgctggatgacctgagaaatgacctggaccggctgtttgtgaaggtggagaagatccacgagaaggtgtag

SEQ ID NO: 33768 - DNA, 9897 bp, Artificial Sequence
  Description of Artificial Sequence: Synthetic coding sequence
atgcagaaggagctgggcatcgtgcccagctgccccggcatgaagagcccccggccccacctgctgctgcccctgctgctgctgctgctgctgctgctgggcgccggcgtgcctggggcctggggccaggccggcagcctggacctgcagattgatgaggagcagcctgctggcaccctgattggagacatctctgctggcctgcctgctggaacagctgcccccctgatgtacttcatcagcgcccaggagggcagcggcgtgggcacagacctggccattgatgagcacagcggcgtggtgaggacagcccgggtgctggaccgggagcagagggaccgctaccgcttcaccgctgtgaccccagatggagccaccgtggaggtgacagtgcgggtggccgacatcaatgaccacgccccagccttcccccaggcccgggccgccctgcaggtgcctgagcacacagccttcggcacccgctaccccctggagcccgccagagatgctgatgctggccgcctgggcacccagggctacgccctgtctggagatggagctggggagaccttccggctggagaccaggcctggcccagatggcacccctgtgcctgagctggtggtgactggagagctggaccgggagaacagaagccactacatgctgcagctggaggcctatgatggcggcagccccccaagaagagcccaggccctgctggatgtgaccctgctggacatcaatgaccacgccccagccttcaaccagagccgctaccacgctgtggtgtctgagagcctggcccctggcagccctgtgctgcaggtgtttgccagtgatgctgatgctggggtgaatggagctgtgacctatgagatcaacagacggcagagtgaaggagatggccccttcagcattgatgcccacacaggcctgctgcagctggagcggcccctggactttgagcagaggagagtgcatgagctggtggtgcaggccagagatggaggagcccaccctgagctgggcagcgcctttgtgacagtgcacgtgagagatgccaatgacaaccagcccagcatgaccgtcatcttcctgtctgcagatggcagcccccaggtgtctgaggccgcccctcctggccagctggtggcccgcatctctgtgtctgaccctgatgatggagactttgcccacgtgaatgtgtccctggagggcggggagggccactttgccctgagcacccaggacagcgtcatctacctggtgtgtgtggcccggcggctggaccgggaggagagagatgcctacaacctgcgggtgacagccacagattctggcagcccccccctgcgggcagaggccgcctttgtgctgcacgtgacagatgtgaatgacaatgccccagcctttgaccggcagctgtacagacctgagcccctgcctgaggtggccctgcccggcagctttgtggtgcgggtgacagcccgggaccctgaccagggcaccaacggccaggtgacctacagcctggcccctggggcccacacccactggttcagcattgaccccaccagcggcatcatcaccacagctgccagcctggactatgagctggagccccagccccagctgattgtggtggccacagatggcggcctgccccccctggccagcagcgccaccgtgtctgtggccctgcaggatgtgaatgacaatgagccccagttccagaggaccttctacaatgccagcctgcctgagggcacccagcccggcacctgcttcctgcaggtgacagccacagatgctgacagcggccccttcggcctgctgagctacagcctgggcgccggcctgggcagcagcggcagcccccccttcagaattgatgcccacagcggagatgtgtgcaccaccaggaccctggaccgggaccagggccccagcagctttgacttcaccgtgacagctgtggatggcggcggcctgaagtccatggtgtatgtgaaggtgttcctgagtgatgaaaatgacaaccccccccagttctacccccgggagtatgctgccagcatcagcgcccagagccccccaggcacagctgtgctgcggctgcgggcccatgaccctgaccagggcagccacggccgcctgagctaccacatcctggccggcaacagccccccactcttcaccctggatgagcagagcggcctgctgactgtggcctggcccctggcccggcgggccaacagcgtggtgcagctggagatcggggctgaagatggcggcggcctgcaggccgagcccagcgcccgggtggacatcagcatcgtgcccggcacccccaccccacccatctttgagcagctgcagtatgtgttttctgtgcctgaagatgtggcccctggcacctctgtgggcatcgtgcaggcccacaaccccccaggccgcctggcccctgtgaccctgagcctgtctggaggagacccccggggcctcttcagcctggatgctgtgtctggcctgctgcagaccctgcggcccctggaccgggagctgctgggccctgtgctggagctggaggtgcgggccggcagcggcgtgcccccagcctttgctgtggcccgggtgcgggtgctgctggatgatgtgaatgacaacagccctgccttccctgcccctgaggacacagtgctgctgccccccaacacagcccctggcacccccatctacaccctgcgggccctggaccctgattctggagtgaacagccgggtgaccttcaccctgctggccggcggcggcggggccttcaccgtggaccccaccactggacatgtgcggctgatgaggcccctgggccccagcggcggccctgcccacgagctggagctggaggccagagatggcggcagcccccccaggaccagccacttccggctgcgggtggtggtgcaggatgtgggcacccggggcctggccccccgcttcaacagccccacctacagagtggacctgcccagcggcaccacagctggcacccaggtgctgcaggtgcaggcccaggccccagatggcggccccatcacctaccacctggccgctgagggcgccagcagccccttcggcctggagccccagagcggctggctgtgggtgcgggccgccctggaccgggaggcccaggagctgtacatcctgaaggtgatggctgtgtctggcagcaaggccgagctgggccagcagacaggaacagccaccgtgcgggtgtccatcctgaaccagaatgagcacagcccccggctgtctgaggaccccaccttcctggccgtggccgagaaccagcccccaggcacctctgtgggccgggtgtttgccacagaccgggacagcggccccaacggccgcctgacctacagcctgcagcagctgtctgaggacagcaaggccttccgcatccacccccagacaggagaggtgaccaccctgcagaccctggaccgggagcagcagagcagctaccagctgctggtgcaggtgcaggacggcggcagccccccaagaagcaccaccggcaccgtgcacgtggccgtgctggacctgaatgacaacagccccaccttcctgcaggccagcggggccgccggcggcggcctgcccatccaggtgcctgacagagtgcccccaggcaccctggtgaccaccctgcaggccaaggaccctgatgaaggagaaaatggcaccatcctgtacaccctgactggacctggcagcgagctgttcagcctgcacccccacagcggggagctgctgacagctgcccccctcatccgggcagagcggccccactacgtgctgaccctgagcgcccatgaccagggcagccccccaagaagtgccagcctgcagctgctggtgcaggtgctgcccagcgcccggctggccgagcccccaccagacctggccgagcgggaccctgctgcccctgtgcctgtggtgctgactgtgacagctgctgagggcctgcggcccggcagcctgctgggctctgtggccgcccctgagcctgctggggtgggcgccctgacctacaccctggtgggcggcgctgaccctgagggcacctttgccctggatgctgccagcggccgcctgtacctggcccggcccctggactttgaggccggccccccctggagggccctgactgtgcgggcagagggccctgggggcgctggggcccggctgctgcgggtgcaggtgcaggtgcaggatgaaaatgagcacgccccagcctttgcccgggaccccctggccctggccctgcctgaaaatcctgagcctggagctgccctgtacaccttccgggccagtgatgctgatggccctggccccaacagtgatgtgcgctaccgcctgctgcggcaggagccccctgtgcctgccctgcggctggatgccaggactggagccctgagcgccccccggggcctggaccgggagaccaccccagccctgctgctgctggtggaggccacagacaggcctgccaatgccagcagaagaagagctgcccgggtgtctgcccgggtgtttgtgacagatgaaaatgacaatgcccctgtgtttgccagccccagccgggtgcggctgcctgaggaccagcccccaggccctgctgccctgcacgtggtggcccgggaccctgacctgggggaggccgcccgggtgtcctaccgcctggccagcggaggagatggccacttccggctgcacagcagcactggagccctgtctgtggtgcggcccctggaccgggagcagagagctgagcacgtgctgactgtggtggccagtgaccacggcagccccccaagaagtgccacccaggtgctgactgtgtctgtggctgatgtgaatgatgaggcccccaccttccagcagcaggagtacagcgtgctgctgcgggagaacaaccccccaggcaccagcctgctgaccctgcgggccacagatcctgatgtgggcgccaacggccaggtgacctacggcggcgtgtcctctgagagcttcagcctggaccctgacaccggggtgctgaccaccctgcgggccctggaccgggaggagcaggaggagatcaacctgactgtgtatgcccaggaccggggcagccccccccagctgacccacgtgacagtgcgggtggccgtggaggatgaaaatgaccacgcccccacctttggaagtgcccacctgagcctggaggtgcctgagggccaggacccccagaccctgaccatgctgcgggccagtgaccctgatgtgggcgccaacggccagctgcagtaccgcatcctggatggagaccccagcggggcctttgtgctggacctggccagcggggagtttggcaccatgaggcccctggaccgggaggtggagcccgccttccagctgagaattgaggccagagatggcggccagcctgccctgagcgccaccctgctgctgactgtgacagtgctggatgccaatgaccacgccccagccttccctgtgcctgcctacagcgtggaggtgcctgaagatgtgcctgctggcaccctgctgctgcagctgcaggcccatgaccctgatgctggggccaatggacatgtgacctactacctgggcgccggcacagctggggccttcctgctggagcccagcagcggggagctgaggacagctgctgccctggaccgggagcagtgccccagctacaccttctctgtgtctgctgtggatggagctgctgctggccccctgagcaccaccgtgtctgtgaccatcaccgtgagagatgtgaatgaccacgcccccaccttccccaccagccccctgcggctgcggctgccccggcccggccccagcttcagcacccccaccctggccctggccaccctgcgggcagaagatagagatgctggggccaatgccagcatcctgtaccgcctggccggcaccccacctcctggcaccaccgtggacagctacacaggagagatccgggtggcccggagccctgtggccctgggcccccgggacagagtgctcttcatcgtggccacagacctgggccggcctgcccggagcgccactggagtcatcatcgtgggcctgcagggcgaggccgagcggggcccccgcttcccccgggccagcagcgaggccaccatcagagaaaatgcccctcctggcacccccatcgtgagccccagggctgtgcatgctgggggcaccaacggccccatcacctacagcatcctgtctggaaatgagaagggcaccttcagcatccagcccagcactggagccatcaccgtgcgctctgctgagggcctggactttgaggtgagcccccggctgcggctggtgctgcaggccgagagcggcggggcctttgccttcaccgtgctgaccctgaccctgcaggatgccaatgacaatgccccccgcttcctgcggccccactacgtggccttcctgcctgagagccggcccctggagggccccctgctgcaggtggaggctgatgacctggaccagggcagcggcggccagatctcctacagcctggccgccagccagcctgcccggggcctcttccacgtggaccccaccaccggcaccatcaccaccacagccatcctggaccgggagatctgggccgagacccggctggtgctgatggccacagaccggggcagccctgccctggtgggcagcgccaccctgactgtgatggtgattgacaccaatgacaaccggcccaccatcccccagccctgggagctgcgggtgtctgaagatgccctgctgggcagcgagatcgcccaggtgactggaaatgatgtggacagcggccctgtgctgtggtacgtgctgagccccagcggcccccaggaccccttctctgtgggccgctatggaggccgggtgtccctgaccggccccctggactttgagcagtgtgaccgctaccagctgcagctgctggcccatgatggcccccatgagggccgggccaacctgactgtgctggtggaggatgtgaatgacaatgccccagccttcagccagagcctgtaccaggtgatgctgctggagcacaccccacctggcagcgccatcctgtctgtgtctgccacagaccgggacagcggggccaacggccacatctcctaccacctggccagccctgcagatggcttctctgtggaccccaacaacggcaccctcttcaccatcgtgggcaccgtggccctgggccatgatggcagcggggctgtggatgtggtgctggaggcccgggaccatggagcccctggccgggccgcccgggccaccgtgcacgtgcagctgcaggaccagaatgaccacgcccccagcttcaccctgagccactacagagtggccgtgacagaggacctgcccccaggcagcaccctgctgaccctggaggccacagatgctgatggcagccgcagccacgccgctgtggactacagcatcatcagcggcaactggggccgggtcttccagctggagccccggctggccgaggccggggagagcgctggccctggcccccgggccctgggctgcctggtgctgctggagcccctggactttgagagcctgacccagtacaacctgactgtggccgctgctgaccggggccagcccccccagagctctgtggtgcctgtgacagtgacagtgctggatgtgaatgacaacccccctgtgttcacccgggccagctacagagtgacagtgcctgaggacacccctgtgggcgctgagctgctgcacgtggaggccagtgatgctgaccccggcccccacggcctggtgcgcttcaccgtgtcctctggggaccccagcggcctgtttgagctggatgagagcagcggcaccctgcggctggcccacgccctggactgtgagacccaggcccggcaccagctggtggtgcaggccgctgaccctgctggggcccactttgccctggcccctgtgaccatcgaggtgcaggatgtgaatgaccacggccctgccttccccctgaacctgctgagcacctctgtggccgagaaccagcccccaggcaccctggtgaccaccctgcacgccattgatggagatgctggggccttcggccgcctgcgctacagcctgctggaggccggccctggccctgagggccgggaggcctttgccctgaacagcagcactggagagctgcgggcccgggtgccctttgattatgagcacacagagagcttccggctgctggtgggcgctgctgatgctggcaacctgagcgcctctgtgacagtgtctgtgctggtgactggagaagatgaatatgaccctgtgttcctggccccagccttccacttccaggtgcctgagggcgcccggcggggccacagcctgggccacgtgcaggccacagatgaagatggaggagcagatggcctggtgctgtacagcctggccaccagcagcccctacttcggcatcaaccagaccactggagccctgtacctgcgggtggacagccgggcccctggcagcggcacagccaccagcggcggcggcggccgcacccggcgggaggccccccgggagctgcggctggaggtgattgcccggggccccctgcccggcagccgcagcgccaccgtgcctgtgacagtggacatcacccacacagccctgggcctggccccagacctgaacctgctgctggtgggcgctgtggccgccagcctgggcgtggtggtggtgctggccctggccgccctggtgctgggcctggtgcgggcccggagcaggaaggccgaggccgcccctggccccatgagccaggccgcccccctggccagtgacagcctgcagaagctgggccgggagccccccagccccccaccttctgagcacctgtaccaccagaccctgcccagctatggaggccctggagctgggggcccctacccccggggcggcagcctggaccccagccacagcagcggccggggcagcgctgaggccgcagaagatgatgagatccgcatgatcaatgagttcccccgggtggcctctgtggccagcagcctggccgcccggggcccagattctggcatccagcaggatgctgatggcctgagtgacaccagctgtgagcccccagccccagacacctggtacaagggcaggaaggccggcctgctgctgcccggggccggggccaccctgtaccgggaggagggccccccagccacagccacagccttcctgggcggctgcggcctgagccctgcccccaccggggactatggcttcccagcagatggcaagccctgtgtggccggggccctgacagccatcgtggccggggaggaggagctgcggggcagctacaactgggactacctgctgtcctggtgcccccagttccagcccctggccagcgtcttcacagaaattgcccggctgaaggatgaggcccggccctgccccccagcccccagaattgatcctccacccctcatcacagctgtggcccaccctggggccaagtctgtgccccccaagccagccaacacagctgctgcccgggccatcttccccccagccagccacaggagccccatcagccatgagggcagcctgagcagcgctgccatgagccccagcttcagccccagcctgagccccctggccgcccggagccctgtggtgagcccctttggagtggcccagggccccagcgccagcgccctgtctgctgagagcggcctggagcccccagatgacacagagctgcacatctag

SEQ ID NO: 33769 - DNA, 462 bp, Artificial Sequence
  Description of Artificial Sequence: Synthetic coding sequence
atgaaggccccctgcccccagctgccctgccccccagccagccaccccctgtgcctgctgtggctgctggcccaccccctgagccaccacctgggctggccccgggtgccccagccccagcacagcgcccagagcctggcctggagccacctgatgaccaggagctgcaccagcagctgtggccctggctgggcccccacctgggatgcccacagcgtgcccaatgccggccccaccctgagcctgccctgggccgccagtgactatgactggctgcggggcggccaccaccaggccccagccctgcaccctgagctgcccagccccctgcgggtgctgggcccccagaagccctgctgcagcctgacctgtgaccaggtgcagtgtggggagaagtatgaaggaggcagcagccctggcttcagctctgtgcgggacccctgcccagccccagccccctag

SEQ ID NO: 33770 - DNA, 2121 bp, Artificial Sequence
  Description of Artificial Sequence: Synthetic coding sequence
atggacatcaagcaccaccagaatggcacccggggccagaggaggaagcagccccacaccaccgtgcagaggctgctgacctggggcctgcctgtgtcctgctcctggttcctgtggaggcagcccggggagttccctgtgacagccctgctgctgggcgctggggccggcggcctgctggccatcggcctcttccagctgctggtgaaccccatgaacatctatgaggagcagaagatcatgttcctgtacagcctggtgggcctgggcgccatgggctggggcaccagcccccacatccgctgtgccagcctgctgctggtgcccaagatgctgggcaaggagggccgcctgtttgtgctgggctacgccctggccgccatctacgtgggccctgtggccaacctgcggcacaacctgaacaacgtcatcgccagcctgggctgcaccgtggagctgcagatcaacaacacccgggccgcctggaggatcagcacagcccccctgcgggccatgttcaaggacctgctgagcagcaaggagctgctgcgggcagagaccaggaacatcagcgccacctttgaggacctggatgcccaggtgaacagcgagaccggctacaccccagaggacaccatggattctggagaaacagcccagggccgggaggcccggcaggccccagccagccggctgcacctgagcacccagaagatgtatgagctgaagaccaagctgcgctgcagctatgtggtgaaccaggccatcctgagctgccgccgctggtttgacaggaagcatgagcagtgcatgaagcacatctgggtgcccctgctgacccacctgctgtgcctgcccatgaagttcaagttcttctgtggcatcgccaaggtgatggaggtgtggtgcaggaaccgcatccctgtggagggcaactttggccagacctatgacagcctgaaccagagcatccggggcctggatggagagttcagcgccaacatcgacttcaaggaggagaagcaggccggcgtgctgggcctgaacacctcctgggagcgggtgtccacagaggtgcgggactatgtgtaccggcaggaggcccggctggagtgggccctgggcctgctgcacgtgctgctgagctgcaccttcctgctggtgctgcacgccagcttctcctacatggacagctacaaccacgacatccgctttgacaacatctacatcagcacctacttctgccagattgatgacaggaggaagaagctgggcaagaggaccctgctgcccctgaggaaggccgaggagaagacagtcatcttcccctgcaagcccaccatccaggccagcgagatgagcaatgtggtgcgggagctgctggagaccctgcccatcctgctgctgctggtggtgctgtgtggcctggactgggccctgtacagcatctttgacaccatccgccaccacagcttcctgcagtacagcttccgcagcagccacaagctggaggtgaaggtgggcggggacagcatgctggcccggctgctgaggaagaccatcggggccctgaacaccagcagcgagaccgtgatggagagcaacaacatgccctgcctgccccagcctgtgggcctggatgcccgggcctactggagggctgctgtgcccatcggcctgctggtgtgcctgtgcctgctgcaggccttcggctaccgcctgcggcgggtgattgctgccttctacttccccaagcgggagaagaagaggatcctcttcctgtacaatgacctgctgaagaagagagctgccttcaccaagctgcggcgggccgccatcctgcggcgggagcggcagcagaaggcccccaggcaccccctggccgacatcctgcaccggggctgccccctgctgcggcgctggctgtgccgccgctgtgtggtgtgccaggcccctgagaccccagagagctatgtgtgcaggaccctggactgtgaggccgtgtactgctggagctgctgggatgacatgaggcagcgctgccctgtgtgcaccccccgggaggagctgagcagcagcgccttcagtgacagcaatgatgacacagcctatgccggctag

SEQ ID NO: 33771 - DNA, 1995 bp, Artificial Sequence
  Description of Artificial Sequence: Synthetic coding sequence
atggacatcaagcaccaccagaatggcacccggggccagaggaggaagcagccccacaccaccgtgcagaggctgctgacctggggcctgcctgtgtcctgctcctggttcctgtggaggcagcccggggagttccctgtgacagccctgctgctgggcgctggggccggcggcctgctggccatcggcctcttccagctgctggtgaaccccatgaacatctatgaggagcagaagatcatgttcctgtacagcctggtgggcctgggcgccatgggctggggcaccagcccccacatccgctgtgccagcctgctgctggtgcccaagatgctgggcaaggagggccgcctgtttgtgctgggctacgccctggccgccatctacgtgggccctgtggccaacctgcggcacaacctgaacaacgtcatcgccagcctgggctgcaccgtggagctgcagatcaacaacacccgggccgcctggaggatcagcacagcccccctgcgggccatgttcaaggacctgctgagcagcaaggagctgctgcgggcagagaccaggaacatcagcgccacctttgaggacctggatgcccaggtgaacagcgagaccggctacaccccagaggacaccatggattctggagaaacagcccagggccgggaggcccggcaggccccagccagccggctgcacctgagcacccagaagatgtatgagctgaagaccaagctgcgctgcagctatgtggtgaaccaggccatcctgagctgccgccgctggtttgacaggaagcatgagcagtgcatgaagcacatctgggtgcccctgctgacccacctgctgtgcctgcccatgaagttcaagttcttctgtggcatcgccaaggtgatggaggtgtggtgcaggaaccgcatccctgtggagggcaactttggccagacctatgacagcctgaaccagagcatccggggcctggatggagagttcagcgccaacatcgacttcaaggaggagaagcaggccggcgtgctgggcctgaacacctcctgggagcgggtgtccacagaggtgcgggactatgtgtaccggcaggaggcccggctggagtgggccctgggcctgctgcacgtgctgctgagctgcaccttcctgctggtgctgcacgccagcttctcctacatggacagctacaaccacgacatccgctttgacaacatctacatcagcacctacttctgccagattgatgacaggaggaagaagctgggcaagaggaccctgctgcccctgaggaaggccgaggagaagacagtcatcttcccctgcaagcccaccatccaggccagcgagatgagcaatgtggtgcgggagctgctggagaccctgcccatcctgctgctgctggtggtgctgtgtggcctggactgggccctgtacagcatctttgacaccatccgccaccacagcttcctgcagtacagcttccgcagcagccacaagctggaggtgaaggtgggcggggacagcatgctggcccggctgctgaggaagaccatcggggccctgaacaccagcagcgagaccgtgatggagagcaacaacatgccctgcctgccccagcctgtgggcctggatgcccgggcctactggagggctgctgtgcccatcggcctgctggtgtgcctgtgcctgctgcaggccttcggctaccgcctgcggcgggtgattgctgccttctacttccccaagcgggagaagaagaggatcctcttcctgtacaatgacctgctgaagaagagagctgccttcaccaagctgcggcgggccgccatcctgcggcgggagcggcagcagaaggcccctgtgttcacagagccccagttcctgcccctgaagaatggcaagacaggagagatctgcaaggcctgcagcctggagatcagcctggagtggtggagcggcgtgggcctgcgctgccagagggcctag

SEQ ID NO: 33772 - DNA, 1995 bp, Artificial Sequence; identical to SEQ ID NO: 33771
  Description of Artificial Sequence: Synthetic coding sequence

SEQ ID NO: 33773 - DNA, 2046 bp, Artificial Sequence
  Description of Artificial Sequence: Synthetic coding sequence
atggacatcaagcaccaccagaatggcacccggggccagaggaggaagcagccccacaccaccgtgcagaggctgctgacctggggcctgcctgtgtcctgctcctggttcctgtggaggcagcccggggagttccctgtgacagccctgctgctgggcgctggggccggcggcctgctggccatcggcctgggcgccatgggctggggcaccagcccccacatccgctgtgccagcctgctgctggtgcccaagatgctgggcaaggagggccgcctgtttgtgctgggctacgccctggccgccatctacgtgggccctgtggccaacctgcggcacaacctgaacaacgtgattgccagcctgggctgcaccgtggagctgcagatcaacaacaccagggctgcctggaggatcagcacagcccccctgcgggccatgttcaaggacctgctgagcagcaaggagctgctgcgggcagagaccaggaacatcagcgccacctttgaggacctggatgcccaggtgaacagcgagaccggctacaccccagaggacaccatggacagcggggagacagcccagggccgggaggcccggcaggccccagccagccggctgcacctgagcacccagaagatgtatgagctgaagaccaagctgcgctgcagctatgtggtgaaccaggccatcctgagctgccgccgctggtttgacaggaagcatgagcagtgcatgaagcacatctgggtgcccctgctgacccacctgctgtgcctgcccatgaagttcaagttcttctgtggcatcgccaaggtgatggaggtgtggtgcaggaaccgcatccctgtggagggcaactttggccagacctatgacagcctgaaccagagcatccggggcctggatggagagttcagcgccaacatcgacttcaaggaggagaagcaggccggcgtgctgggcctgaacacctcctgggagcgggtgtccacagaggtgcgggactatgtgtaccggcaggaggcccggctggagtgggccctgggcctgctgcacgtgctgctgagctgcaccttcctgctggtgctgcacgccagcttctcctacatggacagctacaaccacgacatccgctttgacaacatctacatcagcacctacttctgccagattgatgacaggaggaagaagctgggcaagaggaccctgctgcccctgaggaaggccgaggagaagacagtcatcttcccctgcaagcccaccatccaggccagcgagatgagcaatgtggtgcgggagctgctggagaccctgcccatcctgctgctgctggtggtgctgtgtggcctggactgggccctgtacagcatctttgacaccatccgccaccacagcttcctgcagtacagcttccgcagcagccacaagctggaggtgaaggtgggcggggacagcatgctggcccggctgctgaggaagaccatcggggccctgaacaccagcagcgagaccgtgatggagagcaacaacatgccctgcctgccccagcctgtgggcctggatgcccgggcctactggagggctgctgtgcccatcggcctgctggtgtgcctgtgcctgctgcaggccttcggctaccgcctgcggcgggtgattgctgccttctacttccccaagcgggagaagaagaggatcctcttcctgtacaatgacctgctgaagaagagagctgccttcaccaagctgcggcgggccgccatcctgcggcgggagcggcagcagaaggcccccaggcaccccctggccgacatcctgcaccggggctgccccctgctgcggcgctggctgtgcagaagatgtgtggtgtgccaggcccctgagaccccagagagctatgtgtgcaggaccctggactgtgaggccgtgtactgctggagctgctgggatgacatgaggcagcgctgccctgtgtgcaccccccgggaggagctgagcagcagcgccttcagtgacagcaatgatgacacagcctatgccggctag

SEQ ID NO: 33774 - DNA, 1920 bp, Artificial Sequence
  Description of Artificial Sequence: Synthetic coding sequence
atgcccaaggtgatgaaggatgtggtgcaccccctgggcggggaggagcccagcatggcccgggctgtggtgcgctctgtgggcggcttcaccctgggcctgagcctggccacagcctacggcctgctggagctgctggtggagggccacagcccctggggctgcctggtgggcaccctgaccctggccgccttcctgagcctgggcatgggcttcagccggcaggtgcgggccaccgtgctgctgctgctgccccaggccttcagccggcagggccgcaccctgctgctggtggccgccttcggcctggtgctgcagggcccctgtgccaacaccctgaggaacttcacccgggccagcgaggccgtggcctgtggggctgagctggccctgaaccagacagctgaggtgctgcagagggccaagcagcccctggtgtctgccctgaacaagatcaaggccatcgccaggaagaccaaggaggtggccgacagagtgaggaagttcttccgcagcatcatggatggagtgaagcacatcgcccgggccctgagaaatgtgtggcagtggctgctgcacatcggagatgtgtgcaacagcgagctgggcaacccctacctgaagtgtgcccgggtgtttgatgatgccaaggacagctgcatgatggtgatcccccaggcctaccacctgtgctacgtgctgatgcccttcaagctggccctgtgtggcctggccagcctggtgcaggtgttctgtgtgatccccaagtacatccagcccttcctgcggcagaccatcggcacccctgtgatccagctgctgaacagagtgcggcaggagtttgagttcaacatgacagccacccaccacttctctgtggacctgaatgccagccgcagcctgagccaggtggccatggacctgcatgaagctgtgtccatgaagctgcaccgggtgcgggaggccctggccctgatgggcttcaccacccccctgctgctggtgctgctgtacctgcaggccctcttctaccgctactgctacctgaactgggaccactatgacaacatctacatcaccagccgcttcctgaggatggaggccgtgcgcagcacagctggcctgcccaccgtgctgcccctgagcgcccacgaggcccggcgctacatccccccaggcagcatcttcctgagccagtgggagaagttcttctacatcctggagaccttcaacctgatccgccacctgctgctggtgctcttcctggtgttcctggactatgctgtgttctgggtgctggacctggcccggcaccagctgcagggcgagatcgtggcccggagccctgtgctggtgtccctgactgtggagggcaccggctacgccggcaacatctacagagacctggtgtctgcctttgatgtgctgcagcagggcaacatcagcatcctgagccgccgctgcctgctgcggcccagcgagccagacagcacaggctacatcgtgattggagtgatgtatggcctgtgcttcttcatcaccctgtttggcagctatgtgtcccggctgcggcgggtcatctgtgccagctactaccccagccgggagcaggagcgcatctcctacctgtacaacgtgctgctgagcaggaggaccaacctgctggccgccctgcacaggtctgtgagaagaagagctgctgaccagggccacaggtctgccttcctggtgctggccagccgctgcccctgcctgggcccctttgtgagccacttctggctgcaccaggcctactgcctgggctgcggccagccccaggatgaaggagacatggagaacacagtgtcctgcagcaccccaggctgccagggcttcatctgcaagtggcactgcagcagcagcctggtgtgcaccccctag

SEQ ID NO: 33775 - DNA, 2322 bp, Artificial Sequence
  Description of Artificial Sequence: Synthetic coding sequence
atgcccaaggtgatgaaggatgtggtgcaccccctgggcggggaggagcccagcatggcccgggctgtggtgcgctctgtgggcggcttcaccctgggcctgagcctggccacagcctacggcctgctggagctgctggtggagggccacagcccctggggctgcctggtgggcaccctgaccctggccgccttcctgagcctgggcatgggcttcagccggcaggtgcgggccaccgtgctgctgctgctgccccaggccttcagccggcagggccgcaccctgctgctggtggccgccttcggcctggtgctgcagggcccctgtgccaacaccctgaggaacttcacccgggccagcgaggccgtggcctgtggggctgagctggccctgaaccagacagctgaggtgctgcagagggccaagcagcccctggtgtctgccctgaacaagatcaaggccatcgccaggaagaccaaggaggtggccgacagagtgaggaagttcttccgcagcatcatggatggagtgaagcacatcgcccgggccctgagaaatgtgtggcagtggctgctgcacatcggagatgtgtgcaacagcgagctgggcaacccctacctgaagtgtgcccgggtgtttgatgatgccaaggacagctgcatgatggtgatcccccaggcctaccacctgtgctacgtgctgatgcccttcaagctggccctgtgtggcctggccagcctggtgcaggtgttctgtgtgatccccaagtacatccagcccttcctgcggcagaccatcggcacccctgtgatccagctgctgaacagagtgcggcaggagtttgagttcaacatgacagccacccaccacttctctgtggacctgaatgccagccgcagcctgagccaggtggccatggacctgcatgaagctgtgtccatgaagctgcaccgggtgcgggaggccctggccctgatgggcttcaccacccccctgctgctggtgctgctgtacctgcaggccctcttctaccgctactgctacctgaactgggaccactatgacaacatctacatcaccagccgcttcctgaggatggaggccgtgcgcagcacagctggcctgcccaccgtgctgcccctgagcgcccacgaggcccggcgctacatccccccaggcagcatcttcctgagccagtgggagaagttcttctacatcctggagaccttcaacctgatccgccacctgctgctggtgctcttcctggtgttcctggactatgctgtgttctgggtgctggacctggcccggcaccagctgcagggcgagatcgtggcccggagccctgtgctggtgtccctgactgtggagggcaccggctacgccggcaacatctacagagacctggtgtctgcctttgatgtgctgcagcagggcaacatcagcatcctgagccgccgctgcctgctgcggcccagcgagccagacagcacaggctacatcgtgattggagtgatgtatggcctgtgcttcttcatcaccctgtttggcagctatgtgtcccggctgcggcgggtcatctgtgccagctactaccccagccgggagcaggagcgcatctcctacctgtacaacgtgctgctgagcaggaggaccaacctgctggccgccctgcacaggtctgtgagaagaagagctgctgaccagggccacaggtctgccttcctggtgctggccagccgctgcccctgcctgggcccctttgtgagccacttctggctgcaccaggcctactgcctgggctgcggccagccccaggatgaaggagacatggagaacacagtgtcctgcagcaccccaggctgccagggcctgtactgcctgacctgcttccggctgctggacaacacctgcagcgtgtgtgccagccccctgagctaccagggcgacctggacctggagctggacagcagtgatgaggagggcccccagctgtggctggccgccgcccagaggaaggaccctgagcaggcctggctgctgcagcagcagctgcaggaggtgctgggccgcagcctgtccatggagagcaccagcgagagcagtgacctggatgaggagaagggcccccagcagaggaagcacggccagcagcccctgcctgaggcccaccagcctgtgtccatcctgaccagccctgagccccaccggcccccagagaccagcagcgccaccaagggggcccccaccccagccagcgagcccagcgtgcccctgagcccccccagcctgcctgaccccagccaccccccacccaagtag

SEQ ID NO: 33776 - DNA, 1563 bp, Artificial Sequence
  Description of Artificial Sequence: Synthetic coding sequence
atgggccccaccaggaagcccaacgtgtgcagccggctgagcagaagagccctgggctgcttcagcagagatgctggggtggtgcagaggaccaacctgggcatcctgcgggccctggtgtgccaggagagcaccaagttcaagaatgtgtggaccacccacagccgcagccccatcgcctatgagcggggccgcatctactttgacaactaccgccgctgtgtgtcctctgtggccagcgagcccaggaagctgtatgagatgcccaagtgcagcaagtctgagaagattgaagatgccctgctgtgggagtgccctgtgggggacatcctgcccaacagcagtgactacaagagcagcctcatcgccctgacagcccacaactggctgctgcgcatcagcgccaccaccgggaagatcctggagaagatctacctggccccctactgcaagttccgctacctgtcctgggacaccccccaggaggtgattgctgtgaagagcgcccagaacagaggcagcgctgtggcccggcaggccggcatccagcagcacgtgctgctgtacctggccgtgttccgggtgctgcccttcagcctggtgggcatcctggagatcaacaagaagatctttggaaatgtgacagatgccaccctgagccacggcatcctgattgtgatgtacagcagcggcctggtgcggctgtacagcttccagaccatcgccgagcagttcatgcagcagaagctggacctgggctgtgcctgccgctggggcggcaccaccggcaccgtgggggaggcccccttcggcatcccctgcaacatcaagatcacagacatgccacccctgctgtttgaggtgagcagcctggagaatgccttccagattggaggccacccctggcactacatcgtgacccccaacaagaagaagcagaagggcgtcttccacatctgtgccctgaaggacaacagcctggccaagaatggcatccaggagatggactgctgcagcctggagagtgactggatctacttccacccagatgccagcggccgcatcatccacgtgggccccaaccaggtgaaggtgctgaagctgacagaaattgagaacaacagcagccagcaccagatcagcgaggactttgtgatcctggccaaccgggagaaccacaagaatgaaaatgtgctgactgtgacagccagcggccgggtggtgaagaagagcttcaacctgctggatgatgatcctgagcaggagaccttcaagatcgtggactatgaagatgagctggacctgctgtctgtggtggccgtgacccagattgatgctgagggcaaggcccacctggacttccactgcaatgaatatggcaccctgctgaagagcatccccctggtggagagctgggatgtgacctacagccatgaggtgtactttgaccgggacctggtgctgcacatcgagcagaagcccaacagagtcttcagctgctacgtgtaccagatgatctgtgacacaggagaggaggaggagaccatcaacagaagctgctag

SEQ ID NO: 33777 - DNA, 813 bp, Artificial Sequence
  Description of Artificial Sequence: Synthetic coding sequence
cgccacagcaccacctgctttgctgtgccctgcagcgtgcccagcagcaccttcttcacctgccgggacagccgggaccagcagaaggacatgccacccctgctgtttgaggtgagcagcctggagaatgccttccagattggaggccacccctggcactacatcgtgacccccaacaagaagaagcagaagggcgtcttccacatctgtgccctgaaggacaacagcctggccaagaatggcatccaggagatggactgctgcagcctggagagtgactggatctacttccacccagatgccagcggccgcatcatccacgtgggccccaaccaggtgaaggtgctgaagctgacagaaattgagaacaacagcagccagcaccagatcagcgaggactttgtgatcctggccaaccgggagaaccacaagaatgaaaatgtgctgactgtgacagccagcggccgggtggtgaagaagagcttcaacctgctggatgatgatcctgagcaggagaccttcaagatcgtggactatgaagatgagctggacctgctgtctgtggtggccgtgacccagattgatgctgagggcaaggcccacctggacttccactgcaatgaatatggcaccctgctgaagagcatccccctggtggagagctgggatgtgacctacagccatgaggtgtactttgaccgggacctggtgctgcacatcgagcagaagcccaacagagtcttcagctgctacgtgtaccagatgatctgtgacacaggagaggaggaggagaccatcaacagaagctgctag

SEQ ID NO: 33778 - DNA, 1362 bp, Artificial Sequence
  Description of Artificial Sequence: Synthetic coding sequence
atgggccccaccaggaagcccaacgtgtgcagccggctgagcagaagagccctgggctgcttcagcagagatgctggggtggtgcagaggaccaacctgggcatcctgcgggccctggtgtgccaggagagcaccaagttcaagaatgtgtggaccacccacagccgcagccccatcgcctatgagcggggccgcatctactttgacaactaccgccgctgtgtgtcctctgtggccagcgagcccaggaagctgtatgagatgcccaagtgcagcaagtctgagaagattgaagatgccctgctgtgggagtgccctgtgggggacatcctgcccaacagcagtgactacaagagcagcctcatcgccctgacagcccacaactggctgctgcgcatcagcgccaccaccgggaagatcctggagaagatctacctggccccctactgcaagttccgctacctgtcctgggacaccccccaggaggtgattgctgtgaagagcgcccagaacagaggcagcgctgtggcccggcaggccggcatccagcagcacgtgctgctgtacctggccgtgttccgggtgctgcccttcagcctggtgggcatcctggagatcaacaagaagatctttggaaatgtgacagatgccaccctgagccacggcatcctgattgtgatgtacagcagcggcctggtgcggctgtacagcttccagaccatcgccgagcagttcatgcagcagaagctggacctgggctgtgcctgccgctggggcggcaccaccggcaccgtgggggaggcccccttcggcatcccctgcaacatcaagatcacagacatgccacccctgctgtttgaggtgagcagcctggagaatgccttccagattggaggccacccctggcactacatcgtgacccccaacaagaagaagcagaagggcgtcttccacatctgtgccctgaaggacaacagcctgaatgaaaatgtgctgactgtgacagccagcggccgggtggtgaagaagagcttcaacctgctggatgatgatcctgagcaggagaccttcaagatcgtggactatgaagatgagctggacctgctgtctgtggtggccgtgacccagattgatgctgagggcaaggcccacctggacttccactgcaatgaatatggcaccctgctgaagagcatccccctggtggagagctgggatgtgacctacagccatgaggtgtactttgaccgggacctggtgctgcacatcgagcagaagcccaacagagtcttcagctgctacgtgtaccagatgatctgtgacaccggggaggaggaggagaccatcaacagaagctgctag

SEQ ID NO: 33779 - DNA, 945 bp, Artificial Sequence
  Description of Artificial Sequence: Synthetic coding sequence
atggtggcccctgtgtggtacctggtggccgccgccctgctggtgggcttcatcctcttcctgaccaggagccggggccgggccgccagcgctggccaggagcccctgcacaatgaggagctggccggggccggccgggtggcccagcccggccccctggagcctgaggagccccgggccggcggccggcccaggagaagaagagacctgggcagccggctgcaggcccagaggcgggcccagagggtggcctgggccgaggctgatgaaaatgaggaggaggccgtcatcctggcccaggaggaggagggcgtggagaagccagctgagacccacctgagcggcaagattggagccaagaagctgaggaagctggaggagaagcaggccaggaaggcccagcgggaggccgaggaggccgagcgggaggagaggaagaggctggagagccagcgggaggccgagtggaagaaggaggaggagcggctgcggctggaggaggagcagaaggaggaggaggagaggaaggcccgggaggagcaggcccagcgggagcacgaggagtacctgaagctgaaggaggcctttgtggtggaggaggagggcgtgggggagaccatgacagaggagcagagccagagcttcctgacagagttcatcaactacatcaagcagagcaaggtggtgctgctggaggacctggccagccaggtgggcctgcggacccaggacaccatcaaccgcatccaggacctgctggccgagggcaccatcactggagtgattgatgaccggggcaagttcatctacatcaccccagaggagctggccgctgtggccaacttcatccggcagaggggccgggtgtccattgctgagctggcccaggccagcaacagcctcatcgcctggggccgggagagccctgcccaggccccagcctag

SEQ ID NO: 33780 - DNA, 897 bp, Artificial Sequence
  Description of Artificial Sequence: Synthetic coding sequence
atggtggcccctgtgtggtacctggtggccgccgccctgctggtgggcttcatcctcttcctgaccaggagccggggccgggccgccagcgctggccaggagcccctgcacaatgaggagctggccggggccggccgggtggcccagcccggccccctggagcctgaggagccccgggccggcggccggcccaggagaagaagagacctgggcagccggctgcaggcccagaggcgggcccagagggtggcctgggccgaggctgatgaaaatgaggaggaggccgtcatcctggcccaggaggaggagggcgtggagaagccagctgagacccacctgagcggcaagattggagccaagaagctgaggaagctggaggagaagcaggccaggaaggcccagcgggaggccgaggaggccgagcgggaggagaggaagaggctggagagccagcgggaggccgagtggaagaaggaggaggagcggctgcggctggaggaggagcagaaggaggaggaggagaggaaggcccgggaggagcaggcccagcgggagcacgaggagtacctgaagctgaaggaggcctttgtggtggaggaggagggcgtgggggagaccatgacagaggagcagagccagagcttcctgacagagttcatcaactacatcaagcagagcaaggtggtgctgctggaggacctggccagccaggtgggcctgcggacccaggtgtccccaggcacctggccagctgtgtgcagcgtggcccggggcctgtggctggccgagaggacctgccccaaggacagagtgctgatgcaccggctgccctgcccccagccccgggtgtcctctgcccagaagagccctggcaccctgggcatcctgcacttctag

SEQ ID NO: 33781 - DNA, 942 bp, Artificial Sequence
  Description of Artificial Sequence: Synthetic coding sequence
atggtggcccctgtgtggtacctggtggccgccgccctgctggtgggcttcatcctcttcctgaccaggagccggggccgggccgccagcgctggccaggagcccctgcacaatgaggagctggccggggccggccgggtggcccagcccggccccctggagcctgaggagccccgggccggcggccggcccaggagaagaagagacctgggcagccggctgcaggcccagaggcgggcccagagggtggcctgggccgaggctgatgaaaatgaggaggaggccgtcatcctggcccaggaggaggagggcgtggagaagccagctgagacccacctgagcggcaagattggagccaagaagctgaggaagctggaggagaagcaggccaggaaggcccagcgggaggccgaggaggccgagcgggaggagaggaagaggctggagagccagcgggaggccgagtggaagaaggaggaggagcggctgcggctggaggaggagcagaaggaggaggaggagaggaaggcccgggaggagcaggcccagcgggagcacgaggagtacctgaagctgaaggaggcctttgtggtggaggaggagggcgtgggggagaccatgacagaggagcagagccagagcttcctgacagagttcatcaactacatcaagcagagcaaggtggtgctgctggaggacctggccagccaggtgggcctgcggacccaggtgtccccaggcacctggccagctgtgtgcagcgtggcccggggcctgtggctggccgagaggacctgccccaaggacagagtgctgatgcaccggctgccctgcccccagccccgggtgtcctctgcccagaagagccctggcaccctgggcatcctgcacttcagcctgattgcctggggccgggagagccctgcccaggccccagcctag

SEQ ID NO: 33782 - DNA, 324 bp, Artificial Sequence
  Description of Artificial Sequence: Synthetic coding sequence
atggccaatgaggtgcaggacctgctgagccccaggaaaggaggccaccccccagctgtgaaggccggcggcatgaggatcagcaagaagcaggagatcggcaccctggagcggcacaccaagaagacaggctttgagaagaccagcgccatcgccaacgtggccaagatccagaccctggatgccctgaatgatgccctggagaagctgaactacaagtttcctgccaccgtgcacatggcccaccagaagcccaccccagccctggagaaggtggtgcccctgaagaggatctacatcatccagcagcccaggaagtgctag

SEQ ID NO: 33783 - DNA, 2760 bp, Artificial Sequence
  Description of Artificial Sequence: Synthetic coding sequence
atggccagcgccacagctgctgctgcccggcggggcctgggccgggccctgcccctcttctggaggggctaccagacagagcggggcgtgtatggctaccggcccaggaagccagagagccgggagccccagggcgccctggagcggccccctgtggaccacggcctggcccggctggtgacagtgtactgtgagcacggccacaaggccgccaagatcaaccccctcttcaccggccaggccctgctggagaatgtgcctgagatccaggccctggtgcagaccctgcagggccccttccacacagctggcctgctgaacatgggcaaggaggaggccagcctggaggaggtgctggtgtacctgaaccagatctactgcggccagatcagcattgagaccagccagctgcagagccaggatgagaaggactggtttgccaagagatttgaggagctgcagaaggagaccttcaccacagaggagaggaagcacctgagcaagctgatgctggagagccaggagtttgaccacttcctggccaccaagttcagcacagtgaagagatatggaggagagggcgctgagagcatgatgggcttcttccacgagctgctgaagatgtctgcctacagcggcatcacagatgtgatcatcggcatgccccaccggggccgcctgaacctgctgaccggcctgctgcagtttcctcctgagctgatgttcaggaagatgaggggcctgtctgagttccctgagaacttcagcgccactggagatgtgctgagccacctgaccagctctgtggacctgtactttggagcccaccaccccctgcacgtgaccatgctgcccaaccccagccacctggaggccgtgaaccctgtggccgtgggcaagacccggggccggcagcagagccggcaggatggagactacagcccagacaacagcgcccagcccggggacagagtcatctgcctgcaggtgcatggagatgccagcttctgtggccagggcatcgtgcctgagaccttcaccctgagcaacctgccccacttccgcatcggcggctctgtgcacctgattgtgaacaaccagctgggctacaccaccccagctgagcggggccgcagcagcctgtactgcagcgacatcggcaagctggtgggctgtgccatcatccacgtgaatggagacagccctgaggaggtggtgcgggccacccggctggcctttgagtaccagaggcagttcaggaaggatgtgatcatcgacctgctgtgctaccggcagtggggccacaatgagctggatgagcccttctacaccaaccccatcatgtacaagatcatccgggccaggaagagcatcccagacacctatgcagagcacctgattgctgggggcctgatgacccaggaggaggtgtctgagatcaagagcagctactatgccaagctgaatgaccacctgaacaacatggcccactaccggcccccagccctgaacctgcaggcccactggcagggcctggcccagcctgaggcccagatcaccacctggagcactggagtgcccctggacctgctgcgctttgtgggcatgaagtctgtggaggtgccccgggagctgcagatgcacagccacctgctgaagacccacgtgcagagcaggatggagaagatgatggatggcatcaagctggactgggccacagctgaggccctggccctgggcagcctgctggcccagggcttcaacgtgcggctgagcggccaggatgtgggccggggcaccttcagccagagacatgccatcgtggtgtgccaggagacagatgacacctacatccccctgaaccacatggaccccaaccagaagggcttcctggaggtgagcaacagccccctgtctgaggaggccgtgctgggctttgaatatggcatgagcattgagagccccaagctgctgcccctgtgggaggcccagtttggagacttcttcaacggggcccagatcatctttgacaccttcatctctggaggagaggccaagtggctgctgcagagcggcatcgtcatcctgctgccccacggctatgatggagctggccctgaccacagcagctgcagaattgagcgcttcctgcagatgtgtgacagcgctgaggagggcgtggatggagacacagtgaacatgtttgtggtgcaccccaccaccccagcccagtacttccacctgctgcggcggcagatggtgaggaacttcaggaagcccctcatcgtggccagccccaagatgctgctgcggctgcctgctgctgtgtccaccctgcaggagatggcccctggcaccaccttcaaccctgtgattggagacagctctgtggaccccaagaaggtgaagaccctggtgttctgcagcggcaagcacttctacagcctggtgaagcagcgggagagcctgggcgccaagaagcatgactttgccatcatccgggtggaggagctgtgccccttccccctggacagcctgcagcaggagatgagcaagtacaagcacgtgaaggaccacatctggagccaggaggagccccagaacatgggcccctggagctttgtgagccccaggtttgagaagcagctggcctgcaagctgcggctggtgggccggccccccctgcctgtgcctgctgtgggcatcggcaccgtgcacctgcaccagcacgaggacatcctggccaagacctttgcctag

SEQ ID NO: 33784 - DNA, 486 bp, Artificial Sequence
  Description of Artificial Sequence: Synthetic coding sequence
ggccggcagcagagccggcaggatggagactacagcccagacaacagcgcccagcccggggacagagtcatctgcctgcaggtgcatggagatgccagcttctgtggccagggcatcgtgcctgagaccttcaccctgagcaacctgccccacttccgcatcggcggctctgtgcacctgattgtgaacaaccagctgggctacaccaccccagctgagcggggccgcagcagcctgtactgcagcgacatcggcaagctggtgggctgtgccatcatccacgtgaatggagacagccctgaggaggtggtgcgggccacccggctggcctttgagtaccagaggcagttcaggaaggatgtgatcatcgacctgctgtgctaccggcagtggggccacaatgagctggatgagcccttctacaccaaccccatcatgtacaagatcatccgctacaactacaagcccctgtgtgacatgccctag

SEQ ID NO: 33785 - DNA, 927 bp, Artificial Sequence
  Description of Artificial Sequence: Synthetic coding sequence
atggccagcgccacagctgctgctgcccggcggggcctgggccgggccctgcccctcttctggaggggctaccagacagagcggggcgtgtatggctaccggcccaggaagccagagagccgggagccccagggcgccctggagcggccccctgtggaccacggcctggcccggctggtgacagtgtactgtgagcacggccacaaggccgccaagatcaaccccctcttcaccggccaggccctgctggagaatgtgcctgagatccaggccctggtgcagaccctgcagggccccttccacacagctggcctgctgaacatgggcaaggaggaggccagcctggaggaggtgctggtgtacctgaaccagatctactgcggccagatcagcattgagaccagccagctgcagagccaggatgagaaggactggtttgccaagagatttgaggagctgcagaaggagaccttcaccacagaggagaggaagcacctgagcaagctgatgctggagagccagctgatgttcaggaagatgaggggcctgtctgagttccctgagaacttcagcgccactggagatgtgctgagccacctgaccagctctgtggacctgtactttggagcccaccaccccctgcacgtgaccatgctgcccaaccccagccacctggaggccgtgaaccctgtggccgtgggcaagacccggggccggcagcagagccggcaggatggagactacagcccagacaacagcgcccagcccggggacagagtcatctgcctgcaggtgcatggagatgccagcttctgtggccagggcatcgtgcctgagaccttcaccctgagcaacctgccccacttcagaattggaggctctgtgcacctgattgtgaacaaccagctgggctacaccaccccctag

SEQ ID NO: 33786 - DNA, 645 bp, Artificial Sequence
  Description of Artificial Sequence: Synthetic coding sequence
tgaaaaatcatccgggccaggaagagcatcccagacacctatgcagagcacctgattgctgggggcctgatgacccaggaggaggtgtctgagatcaagagcagctactatgccaagctgaatgaccacctgaacaacatggcccactaccggcccccagccctgaacctgcaggcccactggcagggcctggcccagcctgaggcccagatcaccacctggagcactggagtgcccctggacctgctgcgctttgtgggcatgaagtctgtggaggtgccccgggagctgcagatgcacagccacctgctgaagacccacgtgcagagcaggatggagaagatgatggatggcatcaagctggactgggccacagctgaggccctggccctgggcagcctgctggcccagggcttcaacgtgcggctgagcggccaggatgtgggccggggcaccttcagccagagacatgccatcgtggtgtgccaggagacagatgacacctacatccccctgaaccacatggaccccaaccagaagggcttcctggaggagcggcccagcggcagctacaaggccgccagcagcagcagcttccacatggccaccatgggcctgggccagaccacccaccctgtggagtag

SEQ ID NO: 33787 - DNA, 942 bp, Artificial Sequence
  Description of Artificial Sequence: Synthetic coding sequence
atggccgcccccatgaatggccaggtgtgtgtggtgactggagccagccggggcatcggccggggcatcgccctgcagctgtgcaaggccggggccaccgtgtacatcaccggccgccacctggacaccctgcgggtggtggcccaggaggcccagagcctgggcggccagtgtgtgcctgtggtgtgtgacagcagccaggagagcgaggtgcgcagcctgtttgagcaggtggaccgggagcagcagggccgcctggatgtgctggtgaacaatgcctatgccggcgtgcagaccatcctgaacaccaggaacaaggccttctgggagaccccagcctccatgtgggatgacatcaacaacgtgggcctgcggggccactacttctgcagcgtgtatggagcccggctgatggtgcctgctggccagggcctcatcgtggtgatcagcagccctggcagcctgcagtacatgttcaacgtgccctatggagtgggcaaggccgcctgtgacaagctggccgctgactgtgcccacgagctgcggagacatggagtgtcctgtgtgtccctgtggccaggcatcgtgcagacagagctgctgaaggagcacatggccaaggaggaggtgctgcaggaccctgtgctgaagcagttcaagagcgccttcagcagcgctgagaccacagagctgagcgggaaatgtgtggtggccctggccacagaccccaacatcctgagcctgagcggcaaggtgctgcccagctgtgacctggcccggcgctatggcctgagagatgtggatggccggcctgtgcaggactacctgagcctgagctctgtgctgagccacgtgtctggcctgggctggctggccagctacctgcccagcttcctgcgggtgcccaagtggatcatcgccctgtacaccagcaagttctag

SEQ ID NO: 33788 - DNA, 942 bp, Artificial Sequence; identical to SEQ ID NO: 33787
  Description of Artificial Sequence: Synthetic coding sequence

SEQ ID NO: 33789 - DNA, 978 bp, Artificial Sequence
  Description of Artificial Sequence: Synthetic coding sequence
ttcatcagcggcagcagcaggaagagcctgcccaaggtgaaggccatggacttcatcaccagcacagccatcctgcccctgctgtttggctgcctgggcgtgtttggcctcttccggctgctgcagtgggtgcggggcaaggcctacctgagaaatgctgtggtggtgatcaccggggccaccagcggcctgggcaaggaatgtgccaaggtgttctacgccgccggggccaagctggtgctgtgtggcagaaatggaggagccctggaggagctgatccgggagctgacagccagccacgccaccaaggtgcagacccacaagccctacctggtgacctttgacctgacagattctggggccatcgtggccgctgctgctgagatcctgcagtgcttcggctacgtggacatcctggtgaacaatgccggcatctcctaccggggcaccatcatggacaccaccgtggatgtggacaagagggtgatggagaccaactacttcggccctgtggccctgaccaaggccctgctgcccagcatgatcaagaggcggcagggccacatcgtggccatcagcagcatccagggcaagatgagcatccccttccgcagcgcctatgctgccagcaagcacgccacccaggccttctttgactgcctgcgggcagagatggagcagtatgaaattgaggtgaccgtcatcagccctggctacatccacaccaacctgtctgtgaatgccatcacagcagatggcagccgctatggagtgatggacaccaccacagcccagggccgcagccctgtggaggtggcccaggatgtgctggccgctgtgggcaagaagaagaaggatgtgatcctggccgacctgctgcccagcctggccgtgtacctgcggaccctggcccctggcctcttcttcagcctgatggccagccgggccaggaaggagaggaagagcaagaacagctag

SEQ ID NO: 33790 - DNA, 978 bp, Artificial Sequence
  Description of Artificial Sequence: Synthetic coding sequence
atggtgtccccagccaccaggaagagcctgcccaaggtgaaggccatggacttcatcaccagcacagccatcctgcccctgctgtttggctgcctgggcgtgtttggcctcttccggctgctgcagtgggtgcggggcaaggcctacctgagaaatgctgtggtggtgatcaccggggccaccagcggcctgggcaaggaatgtgccaaggtgttctacgccgccggggccaagctggtgctgtgtggcagaaatggaggagccctggaggagctgatccgggagctgacagccagccacgccaccaaggtgcagacccacaagccctacctggtgacctttgacctgacagattctggggccatcgtggccgctgctgctgagatcctgcagtgcttcggctacgtggacatcctggtgaacaatgccggcatctcctaccggggcaccatcatggacaccaccgtggatgtggacaagagggtgatggagaccaactacttcggccctgtggccctgaccaaggccctgctgcccagcatgatcaagaggcggcagggccacatcgtggccatcagcagcatccagggcaagatgagcatccccttccgcagcgcctatgctgccagcaagcacgccacccaggccttctttgactgcctgcgggcagagatggagcagtatgaaattgaggtgaccgtcatcagccctggctacatccacaccaacctgtctgtgaatgccatcacagcagatggcagccgctatggagtgatggacaccaccacagcccagggccgcagccctgtggaggtggcccaggatgtgctggccgctgtgggcaagaagaagaaggatgtgatcctggccgacctgctgcccagcctggccgtgtacctgcggaccctggcccctggcctcttcttcagcctgatggccagccgggccaggaaggagaggaagagcaagaacagctag

SEQ ID NO: 33791 - DNA, 4587 bp, Artificial Sequence
  Description of Artificial Sequence: Synthetic coding sequence
atgtctgtggccatcaggaagaggtcctgggaggagcacgtgacccactggatgggccagcccttcaacagtgatgacaggaacacagcctgccaccacggcctggtggccgacagcctgcaggcctccatggagaaggatgccaccctgaatgtggacaggaaggagaagtgtgtgtccctgcctgactgctgccacggcagcgagctgcgggacttccctggccggcccatgggccacctgagcaaggatgtggatgaaaatgacagccatgaaggagaggaccagttcctgagcctggaggccagcacagagaccctggtgcacgtgtctgatgaggacaacaatgctgacctgtgcctgacagatgacaagcaggtgctgaacacccagggccagaagaccagcggccagcacatgatccagggcgccggcagcctggagaaggccctgcccatcatccagagcaaccaggtgagcagcaacagctggggcattgctggggagacagagctggccctggtgaaggagagcggggagaggaaggtgacagacagcatcagcaagagcctggagctgtgcaatgagatcagcctgtctgagatcaaggatgcccccaaggtgaatgctgtggacaccctgaatgtgaaggacatcgcccctgagaagcagctgctgaacagcgctgtgattgcccagcagaggaggaagccagacccccccaaggatgaaaatgaaagaagcacctgcaatgtggtgcagaatgagttcctggacaccccctgcaccaacagaggcctgcccctgctgaagacagactttggcagctgcctgctgcagccccccagctgccccaacggcatgtctgcagaaaatggcctggagaagagcggcttcagccagcaccagaacaagagcccccccaaggtgaaggcagaagatggcatgcagtgcctgcagctgaaggagaccctggccacccaggagcccacagacaaccaggtgcggctgaggaagaggaaggagatcagagaagatcgggaccgggcccggctggacagcatggtgctgctgatcatgaagctggaccagctggaccaggacattgaaaatgccctgagcaccagcagcagccccagcggcacccccaccaacctgcggagacatgtgcctgacctggagagcggcagcgagagcggggctgacaccatctctgtgaaccagaccagggtgaacctgagcagtgacacagagagcacagacctgcccagcagcacccctgtggccaacagcggcaccaagcccaagaccacagccatccagggcatcagcgagaaggagaaggccgagattgaggccaaggaggcctgtgactggctgcgggccaccggcttcccccagtatgcccagctgtatgaggacttcctgttccccatcgacatcagcctggtgaagcgggagcatgacttcctggacagagatgccatcgaggccctgtgccggcggctgaacaccctgaacaagtgtgctgtgatgaagctggagatcagcccccacaggaagagaagtgatgacagtgatgaagatgagccctgtgccatcagcggcaagtggaccttccagagggacagcaagcgctggagccggctggaggagtttgatgtgttcagccccaagcaggacctggtgcccggcagcccagatgacagccaccccaaggatggccccagccctgggggcaccctgatggacctgtctgagcggcaggaggtgtcctctgtgcgcagcctgagcagcacaggcagcctgcccagccacgccccacccagtgaagatgctgccacccccaggaccaacagcgtcatctctgtgtgcagcagcagcaacctggccggaaatgatgacagctttggcagcctgcccagccccaaggagctgagcagcttctccttctccatgaagggccacgagaagacagccaagagcaagaccaggagcctgctgaagaggatggagagcctgaagctgaagagcagccaccacagcaagcacaaggcccccagcaagctgggcctcatcatcagcggccccatcctgcaggagggcatggatgaggagaagctgaagcagctgaactgtgtggagatcagcgccctgaatggaaaccgcatcaacgtgcccatggtgaggaagaggtctgtgagcaacagcacccagaccagcagcagcagcagccagagcgagaccagcagcgctgtgtccacccccagccctgtgaccaggaccaggagcctgagcgcctgcaacaagagggtgggcatgtacctggagggctttgaccccttcaaccagagcaccttcaacaacgtggtggagcagaacttcaagaaccgggagagctacccagaagatactgtgttctacatccctgaggaccacaagccaggcaccttccccaaggccctgaccaacggcagcttcagccccagcggcaacaatggatctgtgaactggaggacaggcagcttccacggccctggccacatcagcctgcggcgggagaacagcagtgacagccccaaggagctgaagagaagaaacagcagcagctccatgagcagccggctgagcatctatgacaacgtgcccggcagcatcctgtacagcagcagcggggacctggccgacctggagaatgaagacatcttccctgagctggatgacatcctgtaccacgtgaagggcatgcagagaattgtgaaccagtggagcgagaagttcagtgatgaaggagacagcgacagcgccctggacagcgtgagcccctgccccagcagccccaagcagatccacctggatgtggacaatgacaggaccacccccagcgacctggacagcactggaaacagcctgaatgaacctgaggagcccagcgagatccctgagcggcgggacagcggcgtgggcgccagcctgaccaggagcaacagacaccggctgcgctggcacagcttccagagcagccaccggcccagcctgaacagcgtgtccctgcagatcaactgccagagcgtggcccagatgaacctgctgcagaagtacagcctgctgaagctgacagccctgctggagaagtacacccccagcaacaagcacggcttctcctgggccgtgcccaagttcatgaagaggatcaaggtgcctgactacaaggacagatctgtgtttggagtgcccctgactgtgaatgtgcagaggacaggccagcccctgccccagagcatccagcaggccatgagatacctgaggaaccactgcctggaccaggtgggcctcttcaggaagagcggcgtgaagagccgcatccaggccctgcggcagatgaatgaaggagccatcgactgtgtgaactatgagggccagagcgcctatgatgtggccgacatgctgaagcagtacttccgggacctgcctgagcccctgatgaccaacaagctgtctgagaccttcctgcagatctaccagtatgtgcccaaggaccagaggctgcaggccatcaaggccgccatcatgctgctgcctgatgagaaccgggaggtgctgcagaccctgctgtacttcctgagtgatgtgacagctgctgtgaaggagaaccagatgacccccaccaacctggccgtgtgcctggcccccagcctcttccacctgaacaccctgaagcgggagaacagcagcccccgggtgatgcagaggaagcagagcctgggcaagccagaccagaaggacctgaatgaaaacctggccgccacccagggcctggcccacatgattgctgagtgcaagaagctgttccaggtgcctgaggagatgagccgctgcaggaacagctacacagagcaggagctgaagcccctgaccctggaggccctgggccacctgggcaatgatgacagcgctgactaccagcacttcctgcaggactgtgtggatggcctcttcaaggaggtgaaggagaagttcaagggctgggtgtcctacagcaccagcgagcaggccgagctgagctacaagaaggtgtctgagggcccccccctgcggctgtggaggagcgtcatcgaggtgcctgctgtgcctgaggagatcctgaagaggctgctgaaggagcagcacctgtgggatgtggacctgctggacagcaaggtgattgagatcctggacagccagacagagatctaccagtatgtgcagaacagcatggccccccacccagcccgggactatgtggtgctgcggacctggaggaccaacctgcccaagggggcctgtgccctgctgctgacctctgtggaccatgaccgggcccctgtggtgggcgtgcgggtgaatgtgctgctgagccgctacctgattgagccctgtggccctgggaagagcaagctgacctacatgtgccgggtggacctgcggggccacatgcctgagtggtacaccaagagctttggccacctgtgtgccgctgaggtggtgaagatccgggacagcttcagcaaccagaacacagagaccaaggacaccaagagcaggtag

SEQ ID NO: 33792 - DNA, 1497 bp, Artificial Sequence
  Description of Artificial Sequence: Synthetic coding sequence
atgtctgtggccatcaggaagaggtcctgggaggagcacgtgacccactggatgggccagcccttcaacagtgatgacaggaacacagcctgccaccacggcctggtggccgacagcctgcaggcctccatggagaaggatgccaccctgaatgtggacaggaaggagaagtgtgtgtccctgcctgactgctgccacggcagcgagctgcgggacttccctggccggcccatgggccacctgagcaaggatgtggatgaaaatgacagccatgaaggagaggaccagttcctgagcctggaggccagcacagagaccctggtgcacgtgtctgatgaggacaacaatgctgacctgtgcctgacagatgacaagcaggtgctgaacacccagggccagaagaccagcggccagcacatgatccagggcgccggcagcctggagaaggccctgcccatcatccagagcaaccaggtgagcagcaacagctggggcattgctggggagacagagctggccctggtgaaggagagcggggagaggaaggtgacagacagcatcagcaagagcctggagctgtgcaatgagatcagcctgtctgagatcaaggatgcccccaaggtgaatgctgtggacaccctgaatgtgaaggacatcgcccctgagaagcagctgctgaacagcgctgtgattgcccagcagaggaggaagccagacccccccaaggatgaaaatgaaagaagcacctgcaatgtggtgcagaatgagttcctggacaccccctgcaccaacagaggcctgcccctgctgaagacagactttggcagctgcctgctgcagccccccagctgccccaacggcatgtctgcagaaaatggcctggagaagagcggcttcagccagcaccagaacaagagcccccccaaggtgaaggcagaagatggcatgcagtgcctgcagctgaaggagaccctggccacccaggagcccacagacaaccaggtgcggctgaggaagaggaaggagatcagagaagatcgggaccgggcccggctggacagcatggtgctgctgatcatgaagctggaccagctggaccaggacattgaaaatgccctgagcaccagcagcagccccagcggcacccccaccaacctgcggagacatgtgcctgacctggagagcggcagcgagagcggggctgacaccatctctgtgaaccagaccagggtgaacctgagcagtgacacagagagcacagacctgcccagcagcacccctgtggccaacagcggcaccaagcccaagaccacagccatccagggcatcagcgagaaggagaaggctgctgtgaagtctgtgaagctggaggtggatgaggacaagagcaccaagggcagcaacttcagcaacagcgaggtggccatcggcctgagcccctacaccttcccccagaagaggctcttccacgtggccggggaggagaacatcacctag

SEQ ID NO: 33793 - DNA, 3276 bp, Artificial Sequence
  Description of Artificial Sequence: Synthetic coding sequence
atgtgcaggaagaagccagacaccatgatcctgacccagatcgaggccaaggaggcctgtgactggctgcgggccaccggcttcccccagtatgcccagctgtatgaggacttcctgttccccatcgacatcagcctggtgaagcgggagcatgacttcctggacagagatgccatcgaggccctgtgccggcggctgaacaccctgaacaagtgtgctgtgatgaagctggagatcagcccccacaggaagagaagtgatgacagtgatgaagatgagccctgtgccatcagcggcaagtggaccttccagagggacagcaagcgctggagccggctggaggagtttgatgtgttcagccccaagcaggacctggtgcccggcagcccagatgacagccaccccaaggatggccccagccctgggggcaccctgatggacctgtctgagcggcaggaggtgtcctctgtgcgcagcctgagcagcacaggcagcctgcccagccacgcccctccttctgaagatgctgccacccccaggaccaacagcgtcatctctgtgtgcagcagcagcaacctggccggaaatgatgacagctttggcagcctgcccagccccaaggagctgagcagcttctccttctccatgaagggccacgagaagacagccaagagcaagaccaggagcctgctgaagaggatggagagcctgaagctgaagagcagccaccacagcaagcacaaggcccccagcaagctgggcctcatcatcagcggccccatcctgcaggagggcatggatgaggagaagctgaagcagctgaactgtgtggagatcagcgccctgaatggaaaccgcatcaacgtgcccatggtgaggaagaggtctgtgagcaacagcacccagaccagcagcagcagcagccagagcgagaccagcagcgctgtgtccacccccagccctgtgaccaggaccaggagcctgagcgcctgcaacaagagggtgggcatgtacctggagggctttgaccccttcaaccagagcaccttcaacaacgtggtggagcagaacttcaagaaccgggagagctacccagaggacaccgtcttctacatccctgaggaccacaagccaggcaccttccccaaggccctgaccaacggcagcttcagccccagcggcaacaacggctctgtgaactggaggacaggcagcttccacggccctggccacatcagcctgcggcgggagaacagcagtgacagccccaaggagctgaagagaagaaacagcagcagctccatgagcagccggctgagcatctatgacaacgtgcccggcagcatcctgtacagcagcagcggggacctggccgacctggagaatgaagacatcttccctgagctggatgacatcctgtaccacgtgaagggcatgcagagaattgtgaaccagtggagcgagaagttcagtgatgaaggagacagcgacagcgccctggacagcgtgagcccctgccccagcagccccaagcagatccacctggatgtggacaatgacaggaccacccccagcgacctggacagcacaggcaacagcctgaatgaacctgaggagcccagcgagatccctgagcggcgggacagcggcgtgggcgccagcctgaccaggagcaacagacaccggctgcgctggcacagcttccagagcagccaccggcccagcctgaacagcgtgtccctgcagatcaactgccagagcgtggcccagatgaacctgctgcagaagtacagcctgctgaagctgacagccctgctggagaagtacacccccagcaacaagcacggcttctcctgggccgtgcccaagttcatgaagaggatcaaggtgcctgactacaaggacagatctgtgtttggagtgcccctgactgtgaatgtgcagaggacaggccagcccctgccccagagcatccagcaggccatgagatacctgaggaaccactgcctggaccaggtgggcctcttcaggaagtctggagtgaagagccgcatccaggccctgcggcagatgaatgaaggagccatcgactgtgtgaactatgagggccagagcgcctatgatgtggccgacatgctgaagcagtacttccgggacctgcctgagcccctgatgaccaacaagctgtctgagaccttcctgcagatctaccagtatgtgcccaaggaccagaggctgcaggccatcaaggccgccatcatgctgctgcctgatgaaaatcgggaggtgctgcagaccctgctgtacttcctgagtgatgtgacagctgctgtgaaggagaaccagatgacccccaccaacctggccgtgtgcctggcccccagcctcttccacctgaacaccctgaagcgggagaacagcagcccccgggtgatgcagaggaagcagagcctgggcaagccagaccagaaggacctgaatgaaaacctggccgccacccagggcctggcccacatgattgctgagtgcaagaagctgttccaggtgcctgaggagatgagccgctgcagaaattcctacacagagcaggagctgaagcccctgaccctggaggccctgggccacctgggcaatgatgattctgctgactaccagcacttcctgcaggactgtgtggatggcctcttcaaggaggtgaaggagaagttcaagggctgggtgtcctacagcaccagcgagcaggccgagctgagctacaagaaggtgtctgagggcccccccctgcggctgtggaggtctgtgattgaggtgcctgctgtgcctgaggagatcctgaagaggctgctgaaggagcagcacctgtgggatgtggacctgctggacagcaaggtgattgagatcctggacagccagacagagatctaccagtatgtgcagaacagcatggccccccacccagcccgggactatgtggtgctgcggacctggaggaccaacctgcccaagggggcctgtgccctgctgctgacctctgtggaccatgaccgggcccctgtggtgggcgtgcgggtgaatgtgctgctgagccgctacctgattgagccctgtggccctgggaagagcaagctgacctacatgtgccgggtggacctgcggggccacatgcctgagtggtacaccaagagctttggccacctgtgtgccgctgaggtggtgaagatccgggacagcttcagcaaccagaacacagagaccaaggacaccaagagcaggtag

SEQ ID NO: 33794 - DNA, 972 bp, Artificial Sequence
  Description of Artificial Sequence: Synthetic coding sequence
atgggcagccgggtgtcccgggaggactttgagtgggtgtacacagaccagccccacgccgacagaagaagagagatcctggccaagtacccagagatcaagagcctgatgaagccagaccccaacctgatctggatcatcatcatgatggtgctgacccagctgggcgccttctacatcgtgaaggacctggactggaagtgggtgatctttggagcctatgccttcggcagctgcatcaaccacagcatgaccctggccatccatgaaattgcccacaatgctgcctttggaaactgcaaggccatgtggaaccgctggtttggcatgtttgccaacctgcccatcggcatcccctacagcatctccttcaagcgctaccacatggaccaccaccgctacctgggcgcagatggagtggatgtggacatccccacagactttgagggctggttcttctgcacagccttcaggaagttcatctgggtgatcctgcagcccctcttctacgccttccggcccctcttcatcaaccccaagcccatcacctacctggaggtgatcaacacagtggcccaggtgacctttgacatcctgatctactacttcctgggcatcaagagcctggtgtacatgctggccgccagcctgctgggcctgggcctgcaccccatcagcggccacttcatcgccgagcactacatgttcctgaagggccacgagacctacagctactacggccccctgaacctgctgaccttcaacgtgggctaccacaatgagcaccacgacttccccaacatccctgggaagagcctgcccctggtgaggaagattgctgctgagtactatgacaacctgccccactacaacagctggatcaaggtgctgtatgactttgtgatggatgacaccatcagcccctacagcaggatgaagaggcaccagaagggggagatggtgctggagtag

SEQ ID NO: 33795 - DNA, 972 bp, Artificial Sequence; identical to SEQ ID NO: 33794
  Description of Artificial Sequence: Synthetic coding sequence

SEQ ID NO: 33796 - DNA, 786 bp, Artificial Sequence
  Description of Artificial Sequence: Synthetic coding sequence
atggtgagcccccagctggccaagtacccagagatcaagagcctgatgaagccagaccccaacctgatctggatcatcatcatgatggtgctgacccagctgggcgccttctacatcgtgaaggacctggactggaagtgggtgatctttggagcctatgccttcggcagctgcatcaaccacagcatgaccctggccatccacgagatcgcccacaatgctgccttcggcaactgcaaggccatgtggaaccgctggtttggcatgtttgccaacctgcccatcggcatcccctacagcatctccttcaagcgctaccacatggaccaccaccgctacctgggcgcagatggagtggatgtggacatccccacagactttgagggctggttcttctgcacagccttcaggaagttcatctgggtgatcctgcagcccctcttctacgccttccggcccctcttcatcaaccccaagcccatcacctacctggaggtgatcaacacagtggcccaggtgacctttgacatcctgatctactacttcctgggcatcaagagcctggtgtacatgctggccgccagcctgctgggcctgggcctgcaccccatcagcggccacttcatcgccgagcactacatgttcctgaagggccacgagacctacagctactacggccccctgaacctgctgaccttcaacgtgggctaccacaatgagcaccacgacttccccaacatccctgggaagagcctgcccctggtgaggaagattgctgctgagtag

SEQ ID NO: 33797 - DNA, 1152 bp, Artificial Sequence
  Description of Artificial Sequence: Synthetic coding sequence
atgcccagcggctgccgctgcctgcacctggtgtgcctgctgtgcatcctgggcgcccctggccagcctgtgcgggcagatgactgcagcagccactgtgacctggcccacggctgctgtgccccagatggcagctgccgctgtgaccccggctgggagggcctgcactgtgagcgctgtgtgaggatgcctggctgccagcacggcacctgccaccagccctggcagtgcatctgccacagcggctgggccggcaagttctgtgacaaggatgagcacatctgcaccacccagagcccctgccagaatggaggccagtgcatgtatgatggcggcggggagtaccactgtgtgtgcctgcccggcttccacggccgggactgtgagaggaaggccggcccctgtgagcaggccggcagcccctgcagaaatggaggccagtgccaggatgaccagggctttgccctgaacttcacctgccgctgcctggtgggctttgtgggcgcccgctgtgaggtgaatgtggatgactgcctgatgaggccctgtgccaatggagccacctgcctggatggcatcaaccgcttcagctgcctgtgcccagagggctttgctggccgcttctgcaccatcaacctggatgactgtgccagccggccctgccagagaggagcccgctgccgggacagagtgcatgactttgactgcctgtgccccagcggctacggcggcaagacctgtgagctggtgctgcctgtgcctgacccccccaccaccgtggacacccccctgggccccaccagcgctgtggtggtgcctgccactggacctgccccccacagcgctggggccggcctgctgcgcatctctgtgaaggaggtggtgcggcggcaggaggccggcctgggggagcccagcctggtggccctggtggtgtttggagccctgacagctgccctggtgctggccaccgtgctgctgaccctgcgggcctggaggagaggagtgtgccccccaggcccctgctgctacccagccccccactacgccccagcctgccaggaccaggagtgccaggtgtccatgctgcctgctggcctgcccctgccccgggacctgcccccagagcccgggaagaccacagccctgtag

SEQ ID NO: 33798 - DNA, 1134 bp, Artificial Sequence
  Description of Artificial Sequence: Synthetic coding sequence
atgcccagcggctgccgctgcctgcacctggtgtgcctgctgtgcatcctgggcgcccctggccagcctgtgcgggcagatgactgcagcagccactgtgacctggcccacggctgctgtgccccagatggcagctgccgctgtgaccccggctgggagggcctgcactgtgagcgctgtgtgaggatgcctggctgccagcacggcacctgccaccagccctggcagtgcatctgccacagcggctgggcagatgagcacatctgcaccacccagagcccctgccagaatggaggccagtgcatgtatgatggcggcggggagtaccactgtgtgtgcctgcccggcttccacggccgggactgtgagaggaaggccggcccctgtgagcaggccggcagcccctgcagaaatggaggccagtgccaggatgaccagggctttgccctgaacttcacctgccgctgcctggtgggctttgtgggcgcccgctgtgaggtgaatgtggatgactgcctgatgaggccctgtgccaatggagccacctgcctggatggcatcaaccgcttcagctgcctgtgcccagagggctttgctggccgcttctgcaccatcaacctggatgactgtgccagccggccctgccagagaggagcccgctgccgggacagagtgcatgactttgactgcctgtgccccagcggctacggcggcaagacctgtgagctggtgctgcctgtgcctgacccccccaccaccgtggacacccccctgggccccaccagcgctgtggtggtgcctgccactggacctgccccccacagcgctggggccggcctgctgcgcatctctgtgaaggaggtggtgcggcggcaggaggccggcctgggggagcccagcctggtggccctggtggtgtttggagccctgacagctgccctggtgctggccaccgtgctgctgaccctgcgggcctggaggagaggagtgtgccccccaggcccctgctgctacccagccccccactacgccccagcctgccaggaccaggagtgccaggtgtccatgctgcctgctggcctgcccctgccccgggacctgcccccagagcccgggaagaccacagccctgtag

SEQ ID NO: 33799 - DNA, 1152 bp, Artificial Sequence; identical to SEQ ID NO: 33797
  Description of Artificial Sequence: Synthetic coding sequence

SEQ ID NO: 33800 - DNA, 405 bp, Artificial Sequence
  Description of Artificial Sequence: Synthetic coding sequence
atgcccagcggctgccgctgcctgcacctggtgtgcctgctgtgcatcctgggcgcccctggccagcctgtgcgggcagatgactgcagcagccactgtgacctggcccacggctgctgtgccccagatggcagctgccgctgtgaccccggctgggagggcctgcactgtgagcgctgtgtgaggatgcctggctgccagcacggcacctgccaccagccctggcagtgcatctgccacagcggctgggccggcaagttctgtgacaaggatgagcacatctgcaccacccagagcccctgccagaatggaggccagtgcatgtatgatggcggcggggagtaccactgtgtgtgcctgcccggcttccacggccgggactgtgagaggaaggccggcccctag

SEQ ID NO: 33801 - DNA, 1134 bp, Artificial Sequence; identical to SEQ ID NO: 33798
  Description of Artificial Sequence: Synthetic coding sequence

SEQ ID NO: 33802 - DNA, 870 bp, Artificial Sequence
  Description of Artificial Sequence: Synthetic coding sequence
tgaggctgccagcacggcacctgccaccagccctggcagtgcatctgccacagcggctgggccggcaagttctgtgacaagggcttccacggccgggactgtgagaggaaggccggcccctgtgagcaggccggcagcccctgcagaaatggaggccagtgccaggatgaccagggctttgccctgaacttcacctgccgctgcctggtgggctttgtgggcgcccgctgtgaggtgaatgtggatgactgcctgatgaggccctgtgccaatggagccacctgcctggatggcatcaaccgcttcagctgcctgtgcccagagggctttgctggccgcttctgcaccatcaacctggatgactgtgccagccggccctgccagagaggagcccgctgccgggacagagtgcatgactttgactgcctgtgccccagcggctacggcggcaagacctgtgagctggtgctgcctgtgcctgacccccccaccaccgtggacacccccctgggccccaccagcgctgtggtggtgcctgccactggacctgccccccacagcgctggggccggcctgctgcgcatctctgtgaaggaggtggtgcggcggcaggaggccggcctgggggagcccagcctggtggccctggtggtgtttggagccctgacagctgccctggtgctggccaccgtgctgctgaccctgcgggcctggaggagaggagtgtgccccccaggcccctgctgctacccagccccccactacgccccagcctgccaggaccaggagtgccaggtgtccatgctgcctgctggcctgcccctgccccgggacctgcccccagagcccgggaagaccacagccctgtag

SEQ ID NO: 33803 - DNA, 3441 bp, Artificial Sequence
  Description of Artificial Sequence: Synthetic coding sequence
atgaggaagacagatgtggaccccctggatgaggtgtgctacagagtggtgatgcagctgtgtggcctgtggggccaccctgtgctggccgtgcgggtgctgtttgagatgaagacagcccgcatcaagcccaatgccatcacctacggctactacaacaaggtggtgctggagagcccctggcccagcagcaccaggagcggcatcttcctgtggaccaaggtgagaaatgtggtgcggggcctggcccagttccggcagcccctgaagaagacagtgcagaggagccaggtgagcagcatcagcgccctgcagaatgtgactggaggcagtgatggagacacagtgagccacggctctgtggacagcagcaatgatgccaacaatggagagcacacagtgtttgtgcgggacctgatccggctggagagcattgacaaccacagcagcactggaggccagagcgaccagggctacggcagcaaggatgagctgatcaaggatgatgctgagatccacgtgcctgaggagcaggccgcccgggagctgatcaccaagaccaagatgcagacagaggaggtgtgtgatgccagcgccatcgtggccaagcacagccagcccagccctgagccccacagccccacagagcccccagcctggggcagcagcatcgtgaaggtgcccagcggcatctttgatgtgaacagcaggaagagcagcatcagcaatgtgctcttcagcacccaggaccctgtggaggatgctgtgtttggagaggccaccaacctgaagaagaatggagacagaggagagaagaggcagaagcacttccctgagaggagctgcagcttcagcagcgagagccgggccggcatgctgctgaagaagagcagcctggacagcaacagcagcgagatggccatcatgatgggcgcagatgccaagatcctgacagctgccctgacctgccccaagaccagcctgctgcacatcgcccggacccacagctttgaaaatgtgtcctgccacctgcctgacagcaggacctgcatgtctgagagcacctggaaccctgagcacaggagcagccctgtgcctgagatgctggaggagagccaggagctgctggagcctgtggtggatgatgtgcccaagaccacagccaccgtggacacctatgagagcctgctgagtgacagcaacagcaaccagagccgggacctgaagacagtgtccaaggacctgaggaacaagaggagcagcctgtatggaattgccaaggtggtgcagcgggaggatgtggagaccggcctggaccccctgagcctgctggccacagaatgtactggaggcaagaccccagacagcgaggacaagctgttcagccctgtgattgccaggaacctggctgatgaaattgagagctacatgaacctgaagagccccctgggcagcaagagcagctccatggagctgcaccgggaggagaaccgggagagcggcatgaccacagccttcatccacgccctggagcggcgcagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccaccggggaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagaccggcagcgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggagcctgtaccgggagatcctcttcctgagcctggtgtccctgggcagagaaaatattgatattgaggcctttgacaatgaatatggcatcgcctacaacagcctgagcagcgagatcctggagcggctgcagaagattgatgcccctccttctgcctctgtggagtggtgcaggaaatgttttggagcccccctcatctag

SEQ ID NO: 33804 - DNA, 2013 bp, Artificial Sequence
  Description of Artificial Sequence: Synthetic coding sequence
atgaacctgaagagccccctgggcagcaagagcagctccatggagctgcaccgggaggagaaccgggagagcggcatgaccacagccttcatccacgccctggagcggcgcagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccaccggggaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagaccggcagcgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggagcctgtaccgggagatcctcttcctgagcctggtgtccctgggcagagaaaatattgatattgaggcctttgacaatgaatatggcatcgcctacaacagcctgagcagcgagatcctggagcggctgcagaagattgatgcccctccttctgcctctgtggagtggtgcaggaaatgttttggagcccccctcatctag

SEQ ID NO: 33805 - DNA, 777 bp, Artificial Sequence
  Description of Artificial Sequence: Synthetic coding sequence
atgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccaccggggaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagaccggcagcgctgtggagccccgctaccagagggtgcagaggcccctgtatgtggtgatcaacggggtgcccctgtag

SEQ ID NO: 33806 - DNA, 2376 bp, Artificial Sequence
  Description of Artificial Sequence: Synthetic coding sequence
atgctgctgaagaagagcagcctggacagcaacagcagcgagatggccatcatgatgggcgcagatgccaagatcctgacagctgccctgacctgccccaagaccagcctgctgcacatcgcccggacccacagctttgaaaatgtgtcctgccacctgcctgacagcaggacctgcatgtctgagagcacctggaaccctgagcacaggagcagccctgtgcctgagatgctggaggagagccaggagctgctggagcctgtggtggatgatgtgcccaagaccacagccaccgtggacacctatgagagcctgctgagtgacagcaacagcaaccagagccgggacctgaagacagtgtccaaggacctgaggaacaagaggagcagcctgtatggcatcgccaaggtggtgcagagagaagatgtggagaccggcctggaccccctgagcctgctggccacagagtgcaccggcggcaagaccccagattctgaggacaagctgttcagccctgtgattgccaggaacctggctgatgaaattgagagctacatgaacctgaagagccccctgggcagcaagagcagctccatggagctgcaccgggaggagaaccgggagagcggcatgaccacagccttcatccacgccctggagaggaggagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccactggagaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagactggatctgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggggcatctag

SEQ ID NO: 33807 - DNA, 3441 bp, Artificial Sequence; identical to SEQ ID NO: 33803
  Description of Artificial Sequence: Synthetic coding sequence

SEQ ID NO: 33808 - DNA, 5022 bp, Artificial Sequence
  Description of Artificial Sequence: Synthetic coding sequence
atgggcgccaccatcgagtgctgggaccctgagaccaagtaccccctgcctgtgttcagcacctttgtgctgaccggcagcagcgccaagaaggtgtatggagctgccatccagttctatgagccctacagccgggagctgctgtctgagaagcagctgatgcacctgggcctgctgacccctgtggagaggaagatggtgtccaagagcatcaacaccaacaagtgcatctgcctgctgagccactggcccttctttgaggccttcaggaagttcctgatgttcatctacaagctgtctgtgtctggcccccaccccctgcccatcgagaagcacatcagccacttcatgcagaacatccccttccccagcccccagaggccccgcatcctggtgcagctgtctgtgcatgatgccctgatcctgagccagcctgtgtccacccccctgcccctgagcggggccaacttcagcaccctgctgatgaacctgggccctgagaactgtgccaccctgctgctgtttgtgctgctggagagcaagatcctgctgcacagcctgcggcctgctgtgctgactggagtggccgaggccgtggtggccatgatcttccccttccagtggcagtgcccctacatccccctgtgccccctgagcctggccgctgtgctgagcgcccccctgcccttcatcgtgggcgtggacagccgctactttgacctgcatgaccccccccaggatgtggtgtgcatcgacctggacaccaacatgctgtatgtgtctgatgagaagaagaacatgaactggaagcagctgcccaagaagccctgcaagaacctgctgagcaccctgaagaagctgtacccccagctgagctctgtgcaccagaagacccaggagggcagcgccatcgacatgacccccattgaagctgacttctcctggcagaagaagatgacccagctggagatggagatccaggaggccttcctgcgcttcatggccagcatcctgaagggctaccgcacctacctgcggcccatcacagaggcccccagcaacaaggccacagctgctgacagcctgtttgaccggcagggcttcctgaagagccgggaccgggcctatgccaagttctacaccctgctgagcaagacccagatcttcatccgcttcattgaagaatgttcctttgtgtctgacaaggacaccggcctggccttctttgatgactgcatcgagaagctgttcccagacaagggcacagagaagacagacaaggtggactttgacagcgctgaggacacccggctgattgagctggatgacagccagaagtctgagcacacagtgttcatcatgcctcctgagcccccaccagatgatggcaaggacctgagccccaagtacagctacaagtacttcccccggctggacctgaagctgtttgaccggccccaggagctgaagctgtgcttcagccgccaccccaccggcaacagcatcaccaagagcccccccctgatggccaagaggaccaagcaggagatcaagacagcccacaagctggccaagcgctgctacaccaaccccccccagtgggccaagtgcctcttcagccactgctacagcctgtggttcatctgcctgcctgcctacgtgcgggtgagccaccccaaggtgcgggccctgcagcaggcctatgatgtgctgatcaagatgaggaagacagatgtggaccccctggatgaggtgtgctacagagtggtgatgcagctgtgtggcctgtggggccaccctgtgctggccgtgcgggtgctgtttgagatgaagacagcccgcatcaagcccaatgccatcacctacggctactacaacaaggtggtgctggagagcccctggcccagcagcaccaggagcggcatcttcctgtggaccaaggtgagaaatgtggtgcggggcctggcccagttccggcagcccctgaagaagacagtgcagaggagccaggtgagcagcatcagcggcggccagagcgaccagggctacggcagcaaggatgagctgatcaaggatgatgctgagatccacgtgcctgaggagcaggccgcccgggagctgatcaccaagaccaagatgcagacagaggaggtgtgtgatgccagcgccatcgtggccaagcacagccagcccagccctgagccccacagccccacagagcccccagcctggggcagcagcatcgtgaaggtgcccagcggcatctttgatgtgaacagcaggaagagcagcacaggcagcatcagcaatgtgctcttcagcacccaggaccctgtggaggatgctgtgtttggagaggccaccaacctgaagaagaatggagacagaggagagaagaggcagaagcacttccctgagaggagctgcagcttcagcagcgagagcagagctggcatgctgctgaagaagagcagcctggacagcaacagcagcgagatggccatcatgatgggcgcagatgccaagatcctgacagctgccctgacctgccccaagaccagcctgctgcacatcgcccggacccacagctttgaaaatgtgtcctgccacctgcctgacagcaggacctgcatgtctgagagcacctggaaccctgagcacaggagcagccctgtgcctgagatgctggaggagagccaggagctgctggagcctgtggtggatgatgtgcccaagaccacagccaccgtggacacctatgagagcctgctgagtgacagcaacagcaaccagagccgggacctgaagacagtgtccaaggacctgaggaacaagaggagcagcctgtatggcatcgccaaggtggtgcagagagaagatgtggagaccggcctggaccccctgagcctgctggccacagagtgcaccggcggcaagaccccagattctgaggacaagctgttcagccctgtgattgccaggaacctggctgatgaaattgagagctacatgaacctgaagagccccctgggcagcaagagcagctccatggagctgcaccgggaggagaaccgggagagcggcatgaccacagccttcatccacgccctggagaggaggagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccactggagaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagactggatctgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggagcctgtaccgggagatcctcttcctgagcctggtgtccctgggccgggagaacatcgacatcgaggcctttgacaatgaatatggaattgcctacaacagcctgagcagcgagatcctggagcggctgcagaagattgatgccccacccagcgcctctgtggagtggtgcaggaagtgcttcggggcccccctcatctag

SEQ ID NO: 33809 - DNA, 2376 bp, Artificial Sequence
  Description of Artificial Sequence: Synthetic coding sequence
atgctgctgaagaagagcagcctggacagcaacagcagcgagatggccatcatgatgggcgcagatgccaagatcctgacagctgccctgacctgccccaagaccagcctgctgcacatcgcccggacccacagctttgaaaatgtgtcctgccacctgcctgacagcaggacctgcatgtctgagagcacctggaaccctgagcacaggagcagccctgtgcctgagatgctggaggagagccaggagctgctggagcctgtggtggatgatgtgcccaagaccacagccaccgtggacacctatgagagcctgctgagtgacagcaacagcaaccagagccgggacctgaagacagtgtccaaggacctgaggaacaagaggagcagcctgtatggcatcgccaaggtggtgcagagagaagatgtggagaccggcctggaccccctgagcctgctggccacagagtgcaccggcggcaagaccccagattctgaggacaagctgttcagccctgtgattgccaggaacctggctgatgaaattgagagctacatgaacctgaagagccccctgggcagcaagagcagctccatggagctgcaccgggaggagaaccgggagagcggcatgaccacagccttcatccacgccctggagaggaggagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccactggagaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagactggatctgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggaacatctag

SEQ ID NO: 33810 - DNA, 3012 bp, Artificial Sequence
  Description of Artificial Sequence: Synthetic coding sequence
atgctgaccaccagcggcggccagagcgaccagggctacggcagcaaggatgagctgatcaaggatgatgctgagatccacgtgcctgaggagcaggccgcccgggagctgatcaccaagaccaagatgcagacagaggaggtgtgtgatgccagcgccatcgtggccaagcacagccagcccagccctgagccccacagccccacagagcccccagcctggggcagcagcatcgtgaaggtgcccagcggcatctttgatgtgaacagcaggaagagcagcacaggcagcatcagcaatgtgctcttcagcacccaggaccctgtggaggatgctgtgtttggagaggccaccaacctgaagaagaatggagacagaggagagaagaggcagaagcacttccctgagaggagctgcagcttcagcagcgagagcagagctggcatgctgctgaagaagagcagcctggacagcaacagcagcgagatggccatcatgatgggcgcagatgccaagatcctgacagctgccctgacctgccccaagaccagcctgctgcacatcgcccggacccacagctttgaaaatgtgtcctgccacctgcctgacagcaggacctgcatgtctgagagcacctggaaccctgagcacaggagcagccctgtgcctgagatgctggaggagagccaggagctgctggagcctgtggtggatgatgtgcccaagaccacagccaccgtggacacctatgagagcctgctgagtgacagcaacagcaaccagagccgggacctgaagacagtgtccaaggacctgaggaacaagaggagcagcctgtatggcatcgccaaggtggtgcagagagaagatgtggagaccggcctggaccccctgagcctgctggccacagagtgcaccggcggcaagaccccagattctgaggacaagctgttcagccctgtgattgccaggaacctggctgatgaaattgagagctacatgaacctgaagagccccctgggcagcaagagcagctccatggagctgcaccgggaggagaaccgggagagcggcatgaccacagccttcatccacgccctggagaggaggagcagcctgcccctggaccacggcagccctgcccaggagaaccctgagagcgagaagagcagccctgctgtgagccgcagcaagaccttcaccggccgcttcaagcagcagacccccagcaggacccacaaggagaggagcaccagcctgagcgccctggtgcgcagcagcccccacggcagcctgggctctgtggtgaacagcctgagcggcctgaagctggacaacatcctgagcggccccaagattgatgtgctgaagagcggcatgaagcaggccgccaccgtggccagcaagatgtgggtggccgtggccagcgcctacagctacagtgatgatgaggaggagaccaacagagactacagcttccctgctggcctggaggaccacatcctgggggagaacatcagccccaacaccagcatcagcggcctggtgcccagcgagctgacccagagcaacaccagcctgggcagcagcagcagcagtggagatgtgggcaagctgcactaccccactggagaggtgcccttcccccggggcatgaagggccaggactttgagaagagtgaccacggcagcagccagaacacctccatgagcagcatctaccagaactgtgccatggaggtgctgatgagcagctgcagccagtgccgggcctgtggggccctggtgtatgatgaggagatcatggccggctggacagcagatgacagcaacctgaacacagcctgccccttctgcaagagcaacttcctgcccctgctgaacatcgagttcaaggacctgcggggcagcgccagcttcttcctgaagcccagcaccagcggggacagcctgcagagcggcagcatccccctggccaatgaaagcctggagcacaagcctgtgagcagcctggccgagccagacctgatcaacttcatggacttccccaagcacaaccagatcatcacagaggagactggatctgctgtggagcccagtgatgagatcaagagggccagcggagatgtgcagaccatgaagatcagctctgtgcccaacagcctgagcaagagaaatgtgtccctgaccaggagccacagcgtgggcggccccctgcagaacatcgacttcacccagaggcccttccacggcatcagcacagtgtccctgcccaacagcctgcaggaggtggtggaccccctgggcaagaggcccaaccccccacctgtgtctgtgccctacctgagccccctggtgctgaggaaggagctggagagcctgctggagaatgaaggagaccaggtgatccacaccagcagcttcatcaaccagcaccccatcatcttctggaacctggtgtggtacttccggcggctggacctgcccagcaacctgcccggcctcatcctgaccagcgagcactgcaatgaaggagtgcagctgcccctgagcagcctgagccaggacagcaagctggtgtacatccagctgctgtgggacaacatcaacctgcaccaggagccccgggagcccctgtatgtgtcctggaggaacttcaacagcgagaagaagagcagcctgctgtctgaggagcagcaggagaccagcaccctggtggagaccatccggcagagcatccagcacaacaacgtgctgaagcccatcaacctgctgagccagcagatgaagccaggcatgaagaggcagaggagcctgtaccgggagatcctcttcctgagcctggtgtccctgggccgggagaacatcgacatcgaggcctttgacaatgaatatggaattgcctacaacagcctgagcagcgagatcctggagcggctgcagaagattgatgccccacccagcgcctctgtggagtggtgcaggaagtgcttcggggcccccctcatctag

SEQ ID NO: 33811 - DNA, 3864 bp, Artificial Sequence
  Description of Artificial Sequence: Synthetic coding sequence
atgtctgggggcggcggcggcggcggcagcgcccccagcagatttgctgactactttgtgatctgtggcctggacacagagaccggcctggagccagatgagctgagcgccctgtgccagtacatccaggccagcaaggccagagatggagccagccccttcatcagcagcaccacagaaggagagaactttgagcagacccccctgcggaggaccttcaagagcaaggtgctggcccgctacccagaaaatgtggagtggaacccctttgaccaggatgctgtgggcatgctgtgcatgcccaagggcctggccttcaagacccaggccgacccccgggagccccagttccacgccttcatcatcaccagagaagatggcagcaggacctttggatttgccctgaccttctatgaggaggtgaccagcaagcagatctgcagcgccatgcagaccctgtaccacatgcacaatgcagaatatgatgtgctgcacgcccccccagcagatgaccgggaccagagctccatggaggatggagaggacacccctgtgaccaagctgcagcgcttcaacagctatgacatcagccgggacaccctgtatgtgtccaagtgcatctgcctgatcacccccatgtccttcatgaaggcctgccgctctgtgctggagcagctgcaccaggccgtgaccagcccccagcccccacccctgcccctggagagctacatctacaacgtgctgtatgaggtgcccctgcccccacctggccgcagcctgaagttctctggagtgtatggccccatcatctgccagaggcccagcaccaatgagctgcccctgtttgacttccctgtgaaggaggtgtttgagctgctgggcgtggagaatgtgttccagctgttcacctgtgccctgctggagttccagatcctgctgtacagccagcactaccagaggctgatgacagtggccgagaccatcacagccctgatgttccccttccagtggcagcacgtgtatgtgcccatcctgcctgccagcctgctgcacttcctggatgcccctgtgccctacctgatgggcctgcacagcaatggcctggatgacaggagcaagctggagctgccccaggaggccaacctgtgctttgtggacatcgacaaccacttcatcgagctgcctgaggacctgccccagttccccaacaagctggagtttgtgcaggaggtgtctgagatcctgatggccttcggcatccccccagagggcaacctgcactgcagcgagagcgccagcaagctgaagaggctgcgggccagcgagctggtgtctgacaagagaaatggaaatattgctggcagccccctgcacagctatgagctgctgaaggaaaatgagaccatcgcccggctgcaggccctggtgaagaggactggagtgtccctggagaagctggaggtgcgggaggaccccagcagcaacaaggacctgaaggtgcagtgtgatgaggaggagctgcgcatctaccagctgaacatccagatccgggaggtgtttgccaaccgcttcacccagatgtttgctgactatgaggtgtttgtgatccagcccagccaggacaaggagagctggttcaccaaccgggagcagatgcagaactttgacaaggccagcttcctgagtgaccagcctgagccctacctgcccttcctgagccgcttcctggagacccagatgtttgccagcttcatcgacaacaagatcatgtgccatgatgatgatgacaaggaccctgtgctgcgggtgtttgacagccgggtggacaagatccggctgctgaatgtgaggacccccaccctgcggacctccatgtaccagaagtgcaccaccgtggatgaagctgagaaggccatcgagctgcggctggccaagattgaccacacagccatccacccccacctgctggacatgaagattggccagggcaagtatgagcccggcttcttccccaagctgcagagtgatgtgctgagcacaggccctgccagcaacaagtggaccaagagaaatgccccagcccagtggaggaggaaggaccggcagaagcagcacacagagcacctgcggctggacaatgaccagcgggagaagtacatccaggaggcccggaccatgggcagcaccatccggcagcccaagctgagcaacctgagccccagcgtgattgcccagaccaactggaagtttgtggagggcctgctgaaggaatgtagaaacaagaccaagaggatgctggtggagaagatgggccgggaggccgtggagctgggccatggagaggtgaacatcactggagtggaggagaacaccctgattgccagcctgtgtgacctgctggagcgcatctggagccacggcctgcaggtgaagcagggcaagagcgccctgtggagccacctgctgcactaccaggacaaccggcagaggaagctgaccagcggcagcctgagcaccagcggcatcctgctggacagcgagaggaggaagagtgatgccagcagcctgatgccacccctgcgcatcagcctcatccaggacatgaggcacatccagaacatcggggagatcaagacagatgtgggcaaggcccgggcctgggtgcggctgtccatggagaagaagctgctgagccgccacctgaagcagctgctgagtgaccacgagctgaccaagaagctgtacaagagatatgccttcctgcgctgtgatgatgagaaggagcagttcctgtaccacctgctgtccttcaatgctgtggactacttctgcttcaccaacgtgttcaccaccatcctgatcccctaccacatcctgattgtgcccagcaagaagctgggcggctccatgttcaccgccaacccctggatctgcatcagcggggagctgggggagacccagatcatgcagatccccagaaatgtgctggagatgacctttgagtgccagaacctgggcaagctgaccaccgtgcagattggacatgacaacagcggcctgtatgccaagtggctggtggagtatgtgatggtgagaaatgagatcaccggccacacctacaagttcccctgtggccgctggctgggcaagggcatggatgatggcagcctggagcgcatcctggtgggggagctgctgaccagccagcctgaggtggatgagcggccctgcaggaccccacccctgcagcagagccccagcgtcatccggcggctggtgaccatcagccccaacaacaagcccaagctgaacacaggccagatccaggagagcatcggggaggccgtgaatggaattgtgaagcacttccacaagccagagaaggagcggggcagcctgaccctgctgctgtgtggggagtgtggcctggtgtctgccctggagcaggccttccagcacggcttcaagagccccaggctcttcaagaatgtgttcatctgggacttcctggagaaggcccagacctactatgagaccctggagaagaatgaggtggtgcctgaggagaactggcacacccgggccaggaacttctgccgctttgtgacagccatcaacaacacccccaggaacatcggcaaggatggcaagttccagatgctggtgtgcctgggcgcccgggaccacctgctgcaccactggatcgccctgctggccgactgccccatcacagcccacatgtatgaagatgtggccctgatcaaggaccacaccctggtgaacagcctcatccgggtgctgcagaccctgcaggagttcaacatcaccctggagaccagcctggtgaagggcatcgacatctag

SEQ ID NO: 33812 - DNA, 1893 bp, Artificial Sequence
  Description of Artificial Sequence: Synthetic coding sequence
atgaagattggccagggcaagtatgagcccggcttcttccccaagctgcagagtgatgtgctgagcactggacctgccagcaacaagtggaccaagagaaatgccccagcccagtggaggaggaaggaccggcagaagcagcacacagagcacctgcggctggacaatgaccagcgggagaagtacatccaggaggcccggaccatgggcagcaccatccggcagcccaagctgagcaacctgagccccagcgtcatcgcccagaccaactggaagtttgtggagggcctgctgaaggagtgcaggaacaagaccaagaggatgctggtggagaagatgggccgggaggccgtggagctgggccacggggaggtgaacatcaccggggtggaggagaacaccctcatcgccagcctgtgtgacctgctggagcgcatctggagccacggcctgcaggtgaagcagggcaagagcgccctgtggagccacctgctgcactaccaggacaaccggcagaggaagctgaccagcggcagcctgagcaccagcggcatcctgctggacagcgagaggaggaagagtgatgccagcagcctgatgccacccctgcgcatcagcctcatccaggacatgaggcacatccagaacattggagagatcaagacagatgtgggcaaggcccgggcctgggtgcggctgtccatggagaagaagctgctgagccgccacctgaagcagctgctgagtgaccacgagctgaccaagaagctgtacaagagatatgccttcctgcgctgtgatgatgagaaggagcagttcctgtaccacctgctgtccttcaatgctgtggactacttctgcttcaccaacgtgttcaccaccatcctgatcccctaccacatcctgattgtgcccagcaagaagctgggcggctccatgttcaccgccaacccctggatctgcatctctggagagctgggggagacccagatcatgcagatccccagaaatgtgctggagatgacctttgagtgccagaacctgggcaagctgaccaccgtgcagatcggccatgacaacagcggcctgtatgccaagtggctggtggagtatgtgatggtgagaaatgagatcaccggccacacctacaagttcccctgtggccgctggctgggcaagggcatggatgatggcagcctggagcgcatcctggtgggggagctgctgaccagccagcctgaggtggatgagcggccctgcaggaccccacccctgcagcagagccccagcgtcatccggcggctggtgaccatcagccccaacaacaagcccaagctgaacacaggccagatccaggagagcattggagaggccgtgaatggcatcgtgaagcacttccacaagccagagaaggagcggggcagcctgaccctgctgctgtgtggagaatgtggcctggtgtctgccctggagcaggccttccagcacggcttcaagagccccaggctcttcaagaatgtgttcatctgggacttcctggagaaggcccagacctactatgagaccctggagaagaatgaggtggtgcctgaggagaactggcacacccgggccaggaacttctgccgctttgtgacagccatcaacaacaccccaagaaatattggcaaggatggcaagttccagatgctggtgtgcctgggcgcccgggaccacctgctgcaccactggatcgccctgctggccgactgccccatcacagcccacatgtatgaagatgtggccctgatcaaggaccacaccctggtgaacagcctcatccgggtgctgcagaccctgcaggagttcaacatcaccctggagaccagcctggtgaagggcatcgacatctag

SEQ ID NO: 33813 - DNA, 3726 bp, Artificial Sequence
  Description of Artificial Sequence: Synthetic coding sequence
atgtctgggggcggcggcggcggcggcagcgcccccagcagatttgctgactactttgtgatctgtggcctggacacagagaccggcctggagccagatgagctgagcgccctgtgccagtacatccaggccagcaaggccagagatggagccagccccttcatcagcagcaccacagaaggagagaactttgagcagacccccctgcggaggaccttcaagagcaaggtgctggcccgctacccagaaaatgtggagtggaacccctttgaccaggatgctgtgggcatgctgtgcatgcccaagggcctggccttcaagacccaggccgacccccgggagccccagttccacgccttcatcatcaccagagaagatggcagcaggacctttggatttgccctgaccttctatgaggaggtgaccagcaagcagatctgcagcgccatgcagaccctgtaccacatgcacaatgcagaatatgatgtgctgcacgcccccccagcagatgaccgggaccagagctccatggaggatggagaggacacccctgtgaccaagctgcagcgcttcaacagctatgacatcagccgggacaccctgtatgtgtccaagtgcatctgcctgatcacccccatgtccttcatgaaggcctgccgctctgtgctggagcagctgcaccaggccgtgaccagcccccagcccccacccctgcccctggagagctacatctacaacgtgctgtatgaggtgcccctgcccccacctggccgcagcctgaagttctctggagtgtatggccccatcatctgccagaggcccagcaccaatgagctgcccctgtttgacttccctgtgaaggaggtgtttgagctgctgggcgtggagaatgtgttccagctgttcacctgtgccctgctggagttccagatcctgctgtacagccagcactaccagaggctgatgacagtggccgagaccatcacagccctgatgttccccttccagtggcagcacgtgtatgtgcccatcctgcctgccagcctgctgcacttcctggatgcccctgtgccctacctgatgggcctgcacagcaatggcctggatgacaggagcaagctggagctgccccaggaggccaacctgtgctttgtggacatcgacaaccacttcatcgagctgcctgaggacctgccccagttccccaacaagctggagtttgtgcaggaggtgtctgagatcctgatggccttcggcatccccccagagggcaacctgcactgcagcgagagcgccagcaagctgaagaggctgcgggccagcgagctggtgtctgacaagagaaatggaaatattgctggcagccccctgcacagctatgagctgctgaaggaaaatgagaccatcgcccggctgcaggccctggtgaagaggactggagtgtccctggagaagctggaggtgcgggaggaccccagcagcaacaaggacctgaaggtgcagtgtgatgaggaggagctgcgcatctaccagctgaacatccagatccgggaggtgtttgccaaccgcttcacccagatgtttgctgactatgaggtgtttgtgatccagcccagccaggacaaggagagctggttcaccaaccgggagcagatgcagaactttgacaaggccagcttcctgagtgaccagcctgagccctacctgcccttcctgagccgcttcctggagacccagatgtttgccagcttcatcgacaacaagatcatgtgccatgatgatgatgacaaggaccctgtgctgcgggtgtttgacagccgggtggacaagatccggctgctgaatgtgaggacccccaccctgcggacctccatgtaccagaagtgcaccaccgtggatgaagctgagaaggccatcgagctgcggctggccaagattgaccacacagccatccacccccacctgctggacatgaagattggccagggcaagtatgagcccggcttcttccccaagctgcagagtgatgtgctgagcacaggccctgccagcaacaagtggaccaagagaaatgccccagcccagtggaggaggaaggaccggcagaagcagcacacagagcacctgcggctggacaatgaccagcgggagaagtacatccaggaggcccggaccatgggcagcaccatccggcagcccaagctgagcaacctgagccccagcgtgattgcccagaccaactggaagtttgtggagggcctgctgaaggaatgtagaaacaagaccaagaggatgctggtggagaagatgggccgggaggccgtggagctgggccatggagaggtgaacatcactggagtggaggagaacaccctgattgccagcctgtgtgacctgctggagcgcatctggagccacggcctgcaggtgaagcagggcaagagcgccctgtggagccacctgctgcactaccaggacaaccggcagaggaagctgaccagcggcagcctgagcaccagcggcatcctgctggacagcgagaggaggaagagtgatgccagcagcctgatgccacccctgcgcatcagcctcatccaggacatgaggcacatccagaacatcggggagatcaagacagatgtgggcaaggcccgggcctgggtgcggctgtccatggagaagaagctgctgagccgccacctgaagcagctgctgagtgaccacgagctgaccaagaagctgtacaagagatatgccttcctgcgctgtgatgatgagaaggagcagttcctgtaccacctgctgtccttcaatgctgtggactacttctgcttcaccaacgtgttcaccaccatcctgatcccctaccacatcctgattgtgcccagcaagaagctgggcggctccatgttcaccgccaacccctggatctgcatcagcggggagctgggggagacccagatcatgcagatccccagaaatgtgctggagatgacctttgagtgccagaacctgggcaagctgaccaccgtgcagattggacatgacaacagcggcctgtatgccaagtggctggtggagtatgtgatggtgagaaatgagatcaccggccacacctacaagttcccctgtggccgctggctgggcaagggcatggatgatggcagcctggagcgcatcctggtgggggagctgctgaccagccagcctgaggtggatgagcggccctgcaggaccccacccctgcagcagagccccagcgtcatccggcggctggtgaccatcagccccaacaacaagcccaagctgaacacaggccagatccaggagagcatcggggaggccgtgaatggaattgtgaagcacttccacaagccagagaaggagcggggcagcctgaccctgctgctgtgtggggagtgtggcctggtgtctgccctggagcaggccttccagcacggcttcaagagccccaggctcttcaagaatgtgttcatctgggacttcctggagaaggcccagacctactatgagaccctggagaagaatgaggtggtgcctgaggagaactggcacacccgggccaggaacttctgccgctttgtgacagccatcaacaacacccccaggaacatcggcaaggatgagatcaccagctacaccaccggcctgccctgctggctgacagcccccagcctgcacacctgcatgaggatgtggcactag

SEQ ID NO: 33814 - DNA, 3930 bp, Artificial Sequence
  Description of Artificial Sequence: Synthetic coding sequence
atgggcacccaccaccacgcccagctgatctttgtgttcctggtggagatgaggttccaccacgtggaccaggccggcctggagctgctgaccagcagcaacagccctgccagcgccagccgctctgctgagatcaccgtggtgtcccagcacgcccagcccggcttcctgtaccagtggctggaggccgacagacatggcaagagccagggcgccgccaacaccaccagcggagaaaattttgaccagagccccctgcggaggaccttcaagagcaaggtgctggcccactacccccagaacatcgagtggaacccctttgaccaggatgctgtgaacatgctgtgcatgcccaagggcctgtccttccgcacccagacagacaacaaggacccccagttccacagcttcatcatcacccgggaggatggcagcaggacctacggctttgtgctgaccttctatgaggaggtgaccagcaagcagatctgcacagccatgcagaccctgtaccagatgcacaatgctgagcactacagctctgtgtatgccagcagcagctgcagcatggacagcctggccagcagcctggatgaaggagacaccaccagcctgctgaagctgcagcgctacaacagctatgacatcagccgggacaccctgtatgtgtccaagagcatctgcctgatcacccccctgcccttcatgcaggcctgcaagaagttcctgatccagctgtacaaggctgtgaccagccagcagcccccacccctgcccctggagagctacatccacaacatcctgtatgaggtgcccctgcccccacctggccgcagcctgaagttctatggagtgtatgagcccgtcatctgccagaggcctggccccagcgagctgcccctgagtgactaccccctgcgggaggcctttgagctgctgggcctggagaacctggtgcaggtgttcacctgtgtgctgctggagatgcagatcctgctgtacagccaggactaccagaggctgatgacagtggccgagggcatcaccaccctgctcttccccttccagtggcagcacgtgtatgtgcccatcctgcctgccagcctgctgcacttcctggatgcccctgtgccctacctgatgggcctgcagagcaaggagggcacagacaggagcaagctggagctgccccaggaggccaacctgtgctttgtggacatcgacaaccacttcatcgagctgcctgaggagttcccccagttccccaacaaggtggacttcatccaggagctgtctgaggtgctggtgcagtttggcatccccccagagggcagcctgcactgcagcgagagcaccagcaagctgaagaacatggtgctgaaggacctggtgaatgacaagaagaatggaaatgtgtgcaccaacaacatctccatgtatgagctgctgaagggaaatgagaccatcgcccggctgcaggccctggccaagaggactggagtggccgtggagaagatggacctgagcgccagcctgggggagaaggacaaggacctgaagctgcactgtgaggaggccgagctgcgggactaccagctgaatgtgcagctgcgggaggtgtttgccaaccgcttcacccagatgtttgctgactatgaggcctttgtgatccagacagcccaggacatggagagctggctgaccaaccgggagcagatgcagaactttgacaaggccagcttcctgagtgaccagcctgagccctacctgcccttcctgagccgcttcatcgagacccagatgtttgccaccttcatcgacaacaagatcatgagccagtgggaggagaaggaccccctgctgcgggtgtttgacaccagaattgacaagatccggctgtacaacgtgcgggcccccaccctgcggaccagcatctaccagaagtgcagcaccctgaaggaggccgcccagagcattgagcagaggctgatgaagatggaccacacagccatccacccccacctgctggacatgaagattggccagggcaagtatgagcagggcttcttccccaagctgcagagtgatgtgctggccaccggccccaccagcaacaaccgctgggtgagccgcagcgccacagcccagaggaggaaggagcggctgcggcagcacagcgagcacgtgggcctggacaatgacctgcgggagaagtacatgcaggaggcccggagcctgggcaagaacctgcggcagcccaagctgagtgacctgagccctgctgtgattgcccagaccaactgcaagtttgtggagggcctgctgaaggaatgtaggatgaagaccaagaggatgctggtggagaagatgggccacgaggccgtggagctgggccatggagaggccaacatcaccggcctggaggagaacaccctgattgccagcctgtgtgacctgctggagcgcatctggagccacggcctgcaggtgaagcagggcaagagcgccctgtggagccacctgatccagttccaggaccgggaggagaagcaggagcacctggccgagagccctgtggccctgggccctgagaggaggaagagtgacagcggcgtgatgctgcccaccctgcgggtgtccctcatccaggacatgaggcacatccagaacatgtctgagatcaagacagatgtgggccgggcccgggcctggatccggctgagcctggagaagaagctgctgagccagcacctgaagcagctgctgagcaaccagcccctgaccaagaagctgtacaagagatatgccttcctgcgctgtgaggaggagcgggagcagttcctgtaccacctgctgagcctgaatgctgtggactacttctgcttcaccagcgtcttcaccaccatcatgatcccctacagaagtgtcatcatccccatcaagaagctgagcaatgccatcatcaccagcaacccctggatctgtgtgtctggagagctgggggacacaggagtgatgcagatccccaagaacctgctggagatgacctttgagtgccagaacctgggcaagctgaccaccgtgcagatcggccatgacaacagcggcctgctggccaagtggctggtggactgtgtgatggtgagaaatgagatcaccggccacacctaccgcttcccctgtggccgctggctgggcaaaggaattgatgatggcagcctggagcgcatcctgattggagagctgatgaccagcgccagtgatgaggacctggtgaagcagtgcaggaccccaccccagcagaagagccccaccacagcccggcggctgagcatcaccagcctgaccgggaagaacaacaagcccaatgccggccagatccaggagggcattggagaggccgtgaacaacatcgtgaagcacttccacaagccagagaaggagcggggcagcctgactgtgctgctgtgtggagaaaatggcctggtggccgccctggagcaggtgttccaccacggcttcaagagcgcccgcatcttccacaagaatgtgttcatctgggacttcatcgagaaggtggtggcctactttgagaccacagaccagatcctggacaatgaagatgatgtgctgatccagaagagcagctgcaagaccttctgccactacgtgaatgccatcaacacagcccccaggaacatcggcaaggatggcaagttccagatcctggtgtgcctgggcacccgggaccggctgctgccccagtggatccccctgctggccgagtgcccagccatcaccaggatgtatgaggagagcgccctgctgcgggacaggatgacagtgaacagcctcatccgcatcctgcagaccatccaggacttcaccatcgtgctggagggcagcctcatcaagggcgtggatgtgtag

SEQ ID NO: 33815 - DNA, 2217 bp, Artificial Sequence
  Description of Artificial Sequence: Synthetic coding sequence
atgagcggcagctgtgccgcccctggccctggcagcggcagcagccctgctgcctgccgctttgcccactactttgtgctgtgtggcattgatgctgacagcggcctggagccagatgagctggccgtgctgtaccagtggctggaggccgacagacatggcaagagccagggcgccgccaacaccaccagcggggagaactttgaccagagccccctgcggaggaccttcaagagcaaggtgctggcccactacccccagaacatcgagtggaacccctttgaccaggatgctgtgaacatgctgtgcatgcccaagggcctgtccttccgcacccagacagacaacaaggacccccagttccacagcttcatcatcaccagagaagatggcagcaggacctacggctttgtgctgaccttctatgaggaggtgaccagcaagcagatctgcacagccatgcagaccctgtaccagatgcacaatgctgagcactacagctctgtgtatgccagcagcagctgcagcatggacagcctggccagcagcctggatgaaggagacaccaccagcctgctgaagctgcagcgctacaacagctatgacatcagccgggacaccctgtatgtgtccaagagcatctgcctgatcacccccctgcccttcatgcaggcctgcaagaagttcctgatccagctgtacaaggctgtgaccagccagcagcccccacccctgcccctggagagctacatccacaacatcctgtatgaggtgcccctgcccccacctggccgcagcctgaagttctacggcgtgtatgagcctgtgatctgccagaggcctggccccagcgagctgcccctgagtgactaccccctgcgggaggcctttgagctgctgggcctggagaacctggtgcaggtgttcacctgtgtgctgctggagatgcagatcctgctgtacagccaggactaccagaggctgatgacagtggccgagggcatcaccaccctgctcttccccttccagtggcagcacgtgtatgtgcccatcctgcctgccagcctgctgcacttcctggatgcccctgtgccctacctgatgggcctgcagagcaaggagggcacagacaggagcaagctggagctgccccaggaggccaacctgtgctttgtggacatcgacaaccacttcatcgagctgcctgaggagttcccccagttccccaacaaggtggacttcatccaggagctgtctgaggtgctggtgcagtttggcatccccccagagggcagcctgcactgcagcgagagcaccagcaagctgaagaacatggtgctgaaggacctggtgaatgacaagaagaatggaaatgtgtgcaccaacaacatctccatgtatgagctgctgaagggaaatgagaccatcgcccggctgcaggccctggccaagaggactggagtggccgtggagaagatggacctgagcgccagcctgggggagaaggacaaggacctgaagctgcactgtgaggaggccgagctgcgggactaccagctgaatgtgcagctgcgggaggtgtttgccaaccgcttcacccagatgtttgctgactatgaggccttcgtcatccagacagcccaggacatggagagctggctgaccaaccgggagcagatgcagaactttgacaaggccagcttcctgagtgaccagcctgagccctacctgcccttcctgagccgcttcatcgagacccagatgtttgccaccttcatcgacaacaagatcatgagccagtgggaggagaaggaccccctgctgcgggtgtttgacaccagaattgacaagatccggctgtacaacgtgcgggcccccaccctgcggaccagcatctaccagaagtgcagcaccctgaaggaggccgcccagagcattgagcagaggctgatgaagatggaccacacagccatccacccccacctgctggacatgaagattggccagggcaagtatgagcagggcttcttccccaagctgcagagtgatgtgctggccaccggccccaccagcaacaaccgctgggtgagccgcagcgccacagcccagaggaggaaggagcggctgcggcagcacagcgagcacgtgggcctggacaatgacctgcgggaggtgtgtggcctgcccagctggggcgccagccagcaggccccctag

SEQ ID NO: 33816 - DNA, 3825 bp, Artificial Sequence
  Description of Artificial Sequence: Synthetic coding sequence
atgagcggcagctgtgccgcccctggccctggcagcggcagcagccctgctgcctgccgctttgcccactactttgtgctgtgtggcattgatgctgacagcggcctggagccagatgagctggccggggagaactttgaccagagccccctgcggaggaccttcaagagcaaggtgctggcccactacccccagaacatcgagtggaacccctttgaccaggatgctgtgaacatgctgtgcatgcccaagggcctgtccttccgcacccagacagacaacaaggacccccagttccacagcttcatcatcaccagagaagatggcagcaggacctacggctttgtgctgaccttctatgaggaggtgaccagcaagcagatctgcacagccatgcagaccctgtaccagatgcacaatgctgagcactacagctctgtgtatgccagcagcagctgcagcatggacagcctggccagcagcctggatgaaggagacaccaccagcctgctgaagctgcagcgctacaacagctatgacatcagccgggacaccctgtatgtgtccaagagcatctgcctgatcacccccctgcccttcatgcaggcctgcaagaagttcctgatccagctgtacaaggctgtgaccagccagcagcccccacccctgcccctggagagctacatccacaacatcctgtatgaggtgcccctgcccccacctggccgcagcctgaagttctacggcgtgtatgagcctgtgatctgccagaggcctggccccagcgagctgcccctgagtgactaccccctgcgggaggcctttgagctgctgggcctggagaacctggtgcaggtgttcacctgtgtgctgctggagatgcagatcctgctgtacagccaggactaccagaggctgatgacagtggccgagggcatcaccaccctgctcttccccttccagtggcagcacgtgtatgtgcccatcctgcctgccagcctgctgcacttcctggatgcccctgtgccctacctgatgggcctgcagagcaaggagggcacagacaggagcaagctggagctgccccaggaggccaacctgtgctttgtggacatcgacaaccacttcatcgagctgcctgaggagttcccccagttccccaacaaggtggacttcatccaggagctgtctgaggtgctggtgcagtttggcatccccccagagggcagcctgcactgcagcgagagcaccagcaagctgaagaacatggtgctgaaggacctggtgaatgacaagaagaatggaaatgtgtgcaccaacaacatctccatgtatgagctgctgaagggaaatgagaccatcgcccggctgcaggccctggccaagaggactggagtggccgtggagaagatggacctgagcgccagcctgggggagaaggacaaggacctgaagctgcactgtgaggaggccgagctgcgggactaccagctgaatgtgcagctgcgggaggtgtttgccaaccgcttcacccagatgtttgctgactatgaggccttcgtcatccagacagcccaggacatggagagctggctgaccaaccgggagcagatgcagaactttgacaaggccagcttcctgagtgaccagcctgagccctacctgcccttcctgagccgcttcatcgagacccagatgtttgccaccttcatcgacaacaagatcatgagccagtgggaggagaaggaccccctgctgcgggtgtttgacaccagaattgacaagatccggctgtacaacgtgcgggcccccaccctgcggaccagcatctaccagaagtgcagcaccctgaaggaggccgcccagagcattgagcagaggctgatgaagatggaccacacagccatccacccccacctgctggacatgaagattggccagggcaagtatgagcagggcttcttccccaagctgcagagtgatgtgctggccaccggccccaccagcaacaaccgctgggtgagccgcagcgccacagcccagaggaggaaggagcggctgcggcagcacagcgagcacgtgggcctggacaatgacctgcgggagaagtacatgcaggaggcccggagcctgggcaagaacctgcggcagcccaagctgagtgacctgagccctgctgtgattgcccagaccaactgcaagtttgtggagggcctgctgaaggagtgcaggatgaagaccaagaggatgctggtggagaagatgggccatgaagctgtggagctgggccacggggaggccaacatcaccggcctggaggagaacaccctcatcgccagcctgtgtgacctgctggagcgcatctggagccacggcctgcaggtgaagcagggcaagagcgccctgtggagccacctgatccagttccaggaccgggaggagaagcaggagcacctggccgagagccctgtggccctgggccctgagaggaggaagagtgacagcggcgtgatgctgcccaccctgcgggtgtccctcatccaggacatgaggcacatccagaacatgtctgagatcaagacagatgtgggccgggcccgggcctggatccggctgagcctggagaagaagctgctgagccagcacctgaagcagctgctgagcaaccagcccctgaccaagaagctgtacaagagatatgccttcctgcgctgtgaggaggagcgggagcagttcctgtaccacctgctgagcctgaatgctgtggactacttctgcttcacctctgtgttcaccaccatcatgatcccctaccgcagcgtcatcatccccatcaagaagctgagcaatgccatcatcaccagcaacccctggatctgtgtgtctggagagctgggggacaccggggtgatgcagatccccaagaacctgctggagatgacctttgagtgccagaacctgggcaagctgaccaccgtgcagattggacatgacaacagcggcctgctggccaagtggctggtggactgtgtgatggtgagaaatgagatcaccggccacacctaccgcttcccctgtggccgctggctgggcaagggcattgatgatggcagcctggagcgcatcctgattggagagctgatgaccagcgccagtgatgaggacctggtgaagcagtgcaggaccccaccccagcagaagagccccaccacagcccggcggctgagcatcaccagcctgaccgggaagaacaacaagcccaatgccggccagatccaggagggcatcggggaggccgtgaacaacatcgtgaagcacttccacaagccagagaaggagcggggcagcctgactgtgctgctgtgtggggagaatggcctggtggccgccctggagcaggtgttccaccacggcttcaagagcgcccgcatcttccacaagaatgtgttcatctgggacttcatcgagaaggtggtggcctactttgagaccacagaccagatcctggacaatgaagatgatgtgctgatccagaagagcagctgcaagaccttctgccactacgtgaatgccatcaacacagcccccagaaatattggcaaggatggcaagttccagatcctggtgtgcctgggcacccgggaccggctgctgccccagtggatccccctgctggctgaatgtcctgccatcaccaggatgtatgaggagagcgccctgctgcgggacaggatgacagtgaacagcctcatccgcatcctgcagaccatccaggacttcaccatcgtgctggagggcagcctcatcaagggcgtggatgtgtag

SEQ ID NO: 33817 - DNA, 3930 bp, Artificial Sequence; identical to SEQ ID NO: 33814
  Description of Artificial Sequence: Synthetic coding sequence

SEQ ID NO: 33818 - DNA, 399 bp, Artificial Sequence
  Description of Artificial Sequence: Synthetic coding sequence
atgttcctggtgggcctgactggaggcatcgccagcggcaagagcagcgtcatccaggtgttccagcagctgggctgtgctgtgattgatgtggatgtgatggcccggcacgtggtgcagcccggctacccagcccacagaagaattgtggaggtgtttggaacagaggtgctgctggagaatggagacatcaacaggaaggtgctgggggacctgatcttcaaccagcctgaccggcggcagctgctgaatgccatcacccaccctgagatcaggaaggagatgatgaaggagaccttcaagtacttcctgcgggagcccaggaccagcccccggggcaagaagcacgtgcccagcgccctgaaggaggccgacagcctgatgagaagagacacctag

SEQ ID NO: 33819 - DNA, 696 bp, Artificial Sequence
  Description of Artificial Sequence: Synthetic coding sequence
atgttcctggtgggcctgactggaggcatcgccagcggcaagagcagcgtcatccaggtgttccagcagctgggctgtgctgtgattgatgtggatgtgatggcccggcacgtggtgcagcccggctacccagcccacagaagaattgtggaggtgtttggaacagaggtgctgctggagaatggagacatcaacaggaaggtgctgggggacctgatcttcaaccagcctgaccggcggcagctgctgaatgccatcacccaccctgagatcaggaaggagatgatgaaggagaccttcaagtacttcctgcggggctaccgctacgtgatcctggacatccccctgctgtttgagaccaagaagctgctgaagtacatgaagcacacagtggtggtgtactgtgaccgggacacccagctggcccggctgatgagaagaaacagcctgaacaggaaggatgctgaggcccgcatcaatgcccagctgcccctgacagacaaggccaggatggcccggcacgtgctggacaacagcggggagtggagcgtgaccaagaggcaggtgatcctgctgcacacagagctggagaggagcctggagtacctgcccctgcgctttggagtgctgaccggcctggccgccatcgccagcctgctgtacctgctgacccactacctgctgccctatgcctag

SEQ ID NO: 33820 - DNA, 696 bp, Artificial Sequence; identical to SEQ ID NO: 33819
  Description of Artificial Sequence: Synthetic coding sequence

SEQ ID NO: 33821 - DNA, 756 bp, Artificial Sequence
  Description of Artificial Sequence: Synthetic coding sequence
atgtctgacatcggggactggttccgcagcatcccagccatcacccgctactggtttgctgccaccgtggccgtgcccctggtgggcaagctgggcctcatcagccctgcctacctgttcctgtggccagaggccttcctgtaccgcttccagatctggaggcccatcacagccaccttctacttccctgtgggccctggcaccggcttcctgtacctggtgaacctgtacttcctgtaccagtacagcacccggctggagaccggggcctttgatggccggcctgctgactacctgttcatgctgctcttcaactggatctgcatcgtcatcaccggcctggccatggacatgcagctgctgatgatccccctcatcatgtctgtgctgtatgtgtgggcccagctgaacagagacatgattgtgtccttctggtttggcacccgcttcaaggcctgctacctgccctgggtgatcctgggcttcaactacatcatcggcggcagcgtcatcaatgagctgattggcaacctggtgggccacctgtacttcttcctgatgttccgctaccccatggacctgggcggcaggaacttcctgagcaccccccagttcctgtaccgctggctgcccagcagaagaggaggagtgtctggcttcggcgtgcccccagcctccatgagaagagctgctgaccagaatggaggcggcggccgccacaactggggccagggcttccggctgggggaccagtag

SEQ ID NO: 33822 - DNA, 696 bp, Artificial Sequence
  Description of Artificial Sequence: Synthetic coding sequence
atgtctgacatcggggactggttccgcagcatcccagccatcacccgctactggtttgctgccaccgtggccgtgcccctggtgggcaagctgggcctcatcagccctgcctacctgttcctgtggccagaggccttcctgtaccgcttccagatctggaggcccatcacagccaccttctacttccctgtgggccctggcaccggcttcctgtacctggtgaacctgtacttcctgtaccagtacagcacccggctggagaccggggcctttgatggccggcctgctgactacctgttcatgctgctcttcaactggatctgcatcgtcatcaccggcctggccatggacatgcagctgctgatgatccccctcatcatgtctgtgctgtatgtgtgggcccagctgaacagagacatgattgtgtccttctggtttggcacccgcttcaaggcctgctacctgccctgggtgatcctgggcttcaactacatcatcggcggcagctaccccatggacctgggcggcaggaacttcctgagcaccccccagttcctgtaccgctggctgcccagcagaagaggaggagtgtctggcttcggcgtgcccccagcctccatgagaagagctgctgaccagaatggaggcggcggccgccacaactggggccagggcttccggctgggggaccagtag

SEQ ID NO: 33823 - DNA, 456 bp, Artificial Sequence
  Description of Artificial Sequence: Synthetic coding sequence
atgtctgacatcggggactggttccgcagcatcccagccatcacccgctactggtttgctgccaccgtggccgtgcccctggtgggcaagctgggcctcatcagccctgcctacctgttcctgtggccagaggccttcctgtaccgcttccaggcctgctacctgccctgggtgatcctgggcttcaactacatcatcggcggcagcgtcatcaatgagctgattggcaacctggtgggccacctgtacttcttcctgatgttccgctaccccatggacctgggcggcaggaacttcctgagcaccccccagttcctgtaccgctggctgcccagcagaagaggaggagtgtctggcttcggcgtgcccccagcctccatgagaagagctgctgaccagaatggaggcggcggccgccacaactggggccagggcttccggctgggggaccagtag

SEQ ID NO: 33824 - DNA, 720 bp, Artificial Sequence
  Description of Artificial Sequence: Synthetic coding sequence
atggcctaccagagcctgcggctggagtacctgcagatcccccctgtgtcccgggcctacaccacagcctgtgtgctgaccacagctgctgtgcagctggagctgatcacccccttccagctgtacttcaaccctgagctgatcttcaagcacttccagatctggaggctcatcaccaacttcctgttcttcggccctgtgggcttcaacttcctgttcaacatgatcttcctgtaccgctactgcaggatgctggaggagggcagcttccggggccgcacagctgactttgtgttcatgttcctgtttggaggcttcctgatgaccctgtttggcctgtttgtgtccctggtgttcctgggccaggccttcaccatcatgctggtgtatgtgtggagcagaagaaacccctacgtgaggatgaacttcttcggcctgctgaacttccaggcccccttcctgccctgggtgctgatgggcttcagcctgctgctgggcaacagcatcatcgtggacctgctgggcattgctgtgggccacatctacttcttcctggaggatgtgttccccaaccagcccggcggcatccgcatcctgaagacccccagcatcctgaaggccatctttgacaccccagatgaggaccccaactacaaccccctgcctgaggagaggcctgggggctttgcctggggcgagggccagaggctgggcggctag

SEQ ID NO: 33825 - DNA, 708 bp, Artificial Sequence
  Description of Artificial Sequence: Synthetic coding sequence
atggcctggcagggcctggccgctgagttcctgcaggtgcctgctgtgacccgggcctacacagctgcctgtgtgctgaccacagctgctgtgcagctggagctgctgagccccttccagctgtacttcaacccccacctggtgttcaggaagttccaggtgtggaggctggtgaccaacttcctgttcttcggccccctgggcttctccttcttcttcaacatgctgtttgtgttccgctactgcaggatgctggaggagggcagcttccggggccgcacagctgactttgtgttcatgttcctgtttggaggagtgctgatgaccctgctgggcctgctgggcagcctcttcttcctgggccaggccctgatggccatgctggtgtatgtgtggagccgccgcagcccccgggtgcgggtgaacttcttcggcctgctgaccttccaggcccccttcctgccctgggccctgatgggcttcagcctgctgctgggcaacagcatcctggtggacctgctgggcattgctgtgggccacatctactacttcctggaggatgtgttccccaaccagcccggcggcaagaggctgctgcagaccccaggcttcctgaagctgctgctggatgccccagctgaggaccccaactacctgcccctgcctgaggagcagcccggcccccacctgcccccaccccagcagtag

SEQ ID NO: 33826 - DNA, 618 bp, Artificial Sequence
  Description of Artificial Sequence: Synthetic coding sequence
atggcctggcagggcctggccgctgagttcctgcaggtgcctgctgtgacccgggcctacacagctgcctgtgtgctgaccacagctgctgtgcagctggagctgctgagccccttccagctgtacttcaacccccacctggtgttcaggaagttccaggtgtggaggctggtgaccaacttcctgttcttcggccccctgggcttctccttcttcttcaacatgctgtttgtgttccgctactgcaggatgctggaggagggcagcttccggggccgcacagctgactttgtgttcatgttcctgtttggaggagtgctgatgaccctgctgggcctgctgggcagcctcttcttcctgggccaggccctgatggccatgctggtgtatgtgtggagccgccgcagcccccgggtgcgggtgaacttcttcggcctgctgaccttccaggcccccttcctgccctgggccctgatgggcttcagcctgctgctgggcaacagcatcctggtggacctgctgggcattgctgtgggccacatctactacttcctggaggatgtgttccccaaccagcccggcggcaagaggctgctgcagaccccaggcttcctgtag

SEQ ID NO: 33827 - DNA, 720 bp, Artificial Sequence
  Description of Artificial Sequence: Synthetic coding sequence
atggcctggcagggcctggccgctgagttcctgcaggtgcctgctgtgacccgggcctacacagctgcctgtgtgctgaccacagctgctgtgcagctggagctgctgagccccttccagctgtacttcaacccccacctggtgttcaggaagttccaggtgtggaggctggtgaccaacttcctgttcttcggccccctgggcttctccttcttcttcaacatgctgtttgtgttccgctactgcaggatgctggaggagggcagcttccggggccgcacagctgactttgtgttcatgttcctgtttggaggagtgctgatgaccctgctgggcctgctgggcagcctcttcttcctgggccaggccctgatggccatgctggtgtatgtgtggagccgccgcagcccccgggtgcgggtgaacttcttcggcctgctgaccttccaggcccccttcctgccctgggccctgatgggcttcagcctgctgctgggcaacagcatcctggtggacctgctgggcattgctgtgggccacatctactacttcctggaggatgtgttccccaaccagcccggcggcaagaggctgctgcagaccccaggcttcctgggcctgcagagcagcaaggccccagctggcagcagcctgaccatctggacccagcagagccagggcggccctggaacagctggggagctggccgcccccagctag

SEQ ID NO: 33828 - DNA, 2838 bp, Artificial Sequence
  Description of Artificial Sequence: Synthetic coding sequence
atggccgagggccagggcggcggcggccagcgctgggactgggccggcggcggccgggctgctgaggaggaggtggtgagaagacgctgcagaagaggagaggaggcccaggtggcccagccctggccagagggcagccggggcacagctgctggcccccctgtggaggagcgcttccggcagctgcacctgaggaagcaggtgtcctacaggaaggccatcaccaagagcggcctgcagcacctggcccctcctccacccacccctggggccccctgcagcgagagcgagcggcagatccgcagcacagtggactggagcgagagcgccacctacggggagcacatctggtttgagaccaacgtgtctggggacttctgctacgtgggggagcagtactgtgtggccaggatgctgaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggacggcaagtgccgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcatgctgctgtggtgatcccccccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcacgccgagcccaaccctgaggccggcccagaagatagagatgagggcgccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccacggggagcggctgacccagtgccgggaggtggtgctgaccaccagcaaggccatccctgtgcaggtggatggagagccctgcaagctggccgccagccgcatccgcatcgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33829 - DNA, 2805 bp, Artificial Sequence
  Description of Artificial Sequence: Synthetic coding sequence
atggagcccagagatggcagccctgaggcccggagcagtgacagcgagagcgccagcgccagcagcagcggcagcgagagagatgctggccctgagccagacaaggccccccggcggctgaacaagaggcgcttccctggcctgcggctgtttggccacaggaaggccatcaccaagagcggcctgcagcacctggcccctcctccacccacccctggggccccctgcagcgagagcgagcggcagatccgcagcacagtggactggagcgagagcgccacctatggagagcacatctggtttgagaccaacgtgtctggggacttctgctacgtgggggagcagtactgtgtggccaggatgctgcagaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggacggcaagtgccgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcatgctgctgtggtgatcccccccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcacgccgagcccaaccctgaggccggcccagaagatagagatgagggcgccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccacggggagcggctgacccagtgccgggaggtggtgctgaccaccagcaaggccatccctgtgcaggtggatggagagccctgcaagctggccgccagccgcatccgcatcgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaacccctgcagccccagcggggagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33830 - DNA, 3495 bp, Artificial Sequence
  Description of Artificial Sequence: Synthetic coding sequence
atggccggggccggcggccagcaccaccccccaggagctgctgggggcgctgctgctggagctggagctgctgtgaccagcgctgctgccagcgctggccctggagaggacagcagtgacagcgaggccgagcaggagggcccccagaagctgatcaggaaggtgtccaccagcggccagatccgcaccaagaccagcatcaaggagggccagctgctgaagcagaccagcagcttccagcgctggaagaagcgctacttcaagctgcggggccgcaccctgtactatgccaaggacagcaagagcctcatctttgatgaggtggacctgagtgatgcctctgtggccgaggccagcaccaagaatgccaacaacagcttcaccatcatcacccccttccggcggctgatgctgtgtgctgaaaataggaaggagatggaggactggatcagcagcctgaagtctgtgcagacccgggagccctatgaggtggcccagttcaacgtggagcacttcagcggcatgcacaactggtacgcctgcagccacgcccggcccaccttctgcaatgtgtgccgggagagcctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgaagatggagtggccatgccccaccagtggctggagggcaacctgcctgtgtctgccaagtgtgctgtgtgtgacaagacctgtggctctgtgctgcggctgcaggactggaagtgcctgtggtgcaagaccatggtgcacacagcctgcaaggacctgtaccaccccatctgccccctgggccagtgcaaggtgtccatcatcccccccatcgccctgaacagcacagacagtgatggcttctgccgggccaccttctccttctgtgtgagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaacttccgcatcctggtgtgtggaggagatggctctgtgggctgggtgctgtctgaaattgacaagctgaacctgaacaagcagtgccagctgggcgtgctgcccctgggcactggaaatgacctggcccgggtgctgggctggggcggcagctatgatgatgacacccagctgccccagatcctggagaagctggagcgggccagcaccaagatgctggaccgctggagcatcatgacctatgagctgaagctgccccccaaggccagcctgctgcccggccccccagaggccagcgaggagttctacatgaccatctatgaagattctgtggccacccacctgaccaagatcctgaacagtgatgaacatgctgtggtgatcagcagcgccaagaccctgtgtgagaccgtgaaggactttgtggccaaggtggagaagacctatgacaagaccctggagaatgctgtggtggctgatgctgtggccagcaagtgcagcgtgctgaatgagaagctggagcagctgctgcaggccctgcacacagacagccaggccgcccctgtgctgcccggcctgagccccctcatcgtggaggaggatgctgtggagagcagcagcgaggagagcctgggggagagcaaggagcagctgggagatgatgtgaccaagcccagcagccagaaggctgtgaagccccgggagatcatgctgcgggccaacagcctgaagaaggctgtgcggcaggtgattgaggaggccggcaaggtgatggatgaccccaccgtgcacccctgtgagcccgccaaccagagcagtgactatgacagcacagaaacagatgagagcaaggaggaggccaaggatgatggagccaaggagagcatcaccgtgaagacagcccccaggagcccagatgcccgggccagctatggccacagccagacagattctgtgcccggccctgctgtggccgccagcaaggagaacctgcctgtgctgaacacccgcatcatctgccccggcctgcgggccggcctggccgccagcattgctggcagcagcatcatcaacaagatgctgctggccaacatcgacccctttggagccacccccttcattgatcctgacctggacagcgtggatggctacagcgagaagtgtgtgatgaacaactactttggaattggcctggatgccaagatcagcctggagttcaacaacaagcgggaggagcaccctgagaagtgccgcagcaggaccaagaacctgatgtggtacggcgtgctgggcacccgggagctgctgcagaggagctacaagaacctggagcagagggtgcagctggagtgtgatggccagtacatccccctgcccagcctgcagggcattgctgtgctgaacatccccagctatgctgggggcaccaacttctggggcggcaccaaggaggatgacatctttgctgcccccagctttgatgacaagatcctggaggtggtggccatctttgacagcatgcagatggctgtgtccagggtcatcaagctgcagcaccacagaattgcccagtgcaggacagtgaagatcaccatctttggagatgagggcgtgcctgtgcaggtggatggagaggcctgggtgcagcccccaggcatcatcaagatcgtgcacaagaacagagcccagatgctgacccgggaccgggcctttgagagcaccctgaagtcctgggaggacaagcagaagtgtgacagcggcaagcctgtgctgcggacccacctgtacatccaccacgccatcgacctggccacagaggaggtgtcccagatgcagctgtgcagccaggccgctgaggagctgatcacccgcatctgtgatgctgccaccatccactgcctgctggagcaggagctggcccatgctgtgaatgcctgcagccacgccctgaacaaggccaacccccgctgcccagagagcctgacccgggacacagccacagagatcgccatcaacgtgaaggccctgtacaatgaaacagagagcctgctggtgggccgggtgcccctgcagctggagagcccccatgaggagcgggtgtccaatgccctgcacagcgtggaggtggagctgcagaagctgacagagatcccctggctgtactacatcctgcaccccaatgaagatgaggagccccccatggactgcaccaagaggaacaacagaagcacagtgttcagaattgtgcccaagttcaagaaggagaaggtgcagaagcagaagaccagcagccagcccggcagcggggacacagagagcggcagctgtgaggccaacagccctggcaactag

SEQ ID NO: 33831 - DNA, 3663 bp, Artificial Sequence
  Description of Artificial Sequence: Synthetic coding sequence
atggccggggccggcggccagcaccaccccccaggagctgctgggggcgctgctgctggagctggagctgctgtgaccagcgctgctgccagcgctggccctggagaggacagcagtgacagcgaggccgagcaggagggcccccagaagctgatcaggaaggtgtccaccagcggccagatccgcaccaagaccagcatcaaggagggccagctgctgaagcagaccagcagcttccagcgctggaagaagcgctacttcaagctgcggggccgcaccctgtactatgccaaggacagcaagagcctcatctttgatgaggtggacctgagtgatgcctctgtggccgaggccagcaccaagaatgccaacaacagcttcaccatcatcacccccttccggcggctgatgctgtgtgctgaaaataggaaggagatggaggactggatcagcagcctgaagtctgtgcagacccgggagccctatgaggtggcccagttcaacgtggagcacttcagcggcatgcacaactggtacgcctgcagccacgcccggcccaccttctgcaatgtgtgccgggagagcctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgaagatggagtggccatgccccaccagtggctggagggcaacctgcctgtgtctgccaagtgtgctgtgtgtgacaagacctgtggctctgtgctgcggctgcaggactggaagtgcctgtggtgcaagaccatggtgcacacagcctgcaaggacctgtaccaccccatctgccccctgggccagtgcaaggtgtccatcatcccccccatcgccctgaacagcacagacagtgatggcttctgccgggccaccttctccttctgtgtgagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaacttccgcatcctggtgtgtggaggagatggctctgtgggctgggtgctgtctgaaattgacaagctgaacctgaacaagcagtgccagctgggcgtgctgcccctgggcactggaaatgacctggcccgggtgctgggctggggcggcagctatgatgatgacacccagctgccccagatcctggagaagctggagcgggccagcaccaagatgctggaccgctggagcatcatgacctatgagctgaagctgccccccaaggccagcctgctgcccggccccccagaggccagcgaggagttctacatgaccatctatgaagattctgtggccacccacctgaccaagatcctgaacagtgatgaacatgctgtggtgatcagcagcgccaagaccctgtgtgagaccgtgaaggactttgtggccaaggtggagaagacctatgacaagaccctggagaatgctgtggtggctgatgctgtggccagcaagtgcagcgtgctgaatgagaagctggagcagctgctgcaggccctgcacacagacagccaggccgcccctgtgctgcccggcctgagccccctcatcgtggaggaggatgctgtggagagcagcagcgaggagagcctgggggagagcaaggagcagctgggagatgatgtgaccaagcccagcagccagaaggctgtgaagccccgggagatcatgctgcgggccaacagcctgaagaaggctgtgcggcaggtgattgaggaggccggcaaggtgatggatgaccccaccgtgcacccctgtgagcccgccaaccagagcagtgactatgacagcacagaaacagatgagagcaaggaggaggccaaggatgatggagccaaggagagcatcaccgtgaagacagcccccaggagcccagatgcccgggccagctatggccacagccagacagattctgtgcccggccctgctgtggccgccagcaaggagaacctgcctgtgctgaacacccgcatcatctgccccggcctgcgggccggcctggccgccagcattgctggcagcagcatcatcaacaagatgctgctggccaacatcgacccctttggagccacccccttcattgatcctgacctggacagcgtggatggctacagcgagaagtgtgtgatgaacaactactttggaattggcctggatgccaagatcagcctggagttcaacaacaagcgggaggagcaccctgagaagtgccgcagcaggaccaagaacctgatgtggtacggcgtgctgggcacccgggagctgctgcagaggagctacaagaacctggagcagagggtgcagctggagtgtgatggccagtacatccccctgcccagcctgcagggcattgctgtgctgaacatccccagctatgctgggggcaccaacttctggggcggcaccaaggaggatgacatctttgctgcccccagctttgatgacaagatcctggaggtggtggccatctttgacagcatgcagatggctgtgtccagggtcatcaagctgcagcaccacagaattgcccagtgcaggacagtgaagatcaccatctttggagatgagggcgtgcctgtgcaggtggatggagaggcctgggtgcagcccccaggcatcatcaagatcgtgcacaagaacagagcccagatgctgacccgggaccgggcctttgagagcaccctgaagtcctgggaggacaagcagaagtgtgacagcggcaagcctgtgctgcggacccacctgtacatccaccacgccatcgacctggccacagaggaggtgtcccagatgcagctgtgcagccaggccgctgaggagctgatcacccgcatctgtgatgctgccaccatccactgcctgctggagcaggagctggcccatgctgtgaatgcctgcagccacgccctgaacaaggccaacccccgctgcccagagagcctgacccgggacacagccacagagatcgccatcaacgtgaaggccctgtacaatgaaacagagagcctgctggtgggccgggtgcccctgcagctggagagcccccatgaggagcgggtgtccaatgccctgcacagcgtggaggtggagctgcagaagctgacagagatcccctggctgtactacatcctgcaccccaatgaagatgaggagccccccatggactgcaccaagaggaacaacagaagcacagtgttcagaattgtgcccaagttcaagaaggagaaggtgcagaagcagaagaccagcagccagcctgtgcagaagtggggcacagaggaggtggccgcctggctggacctgctgaacctgggggagtacaaggacatcttcatcagacatgacatcagaggagctgagctgctgcacctggagcggcgggacctgaaggacctgggcatccccaaggtgggccacgtgaagaggatcctgcagggcatcaaggagctgggccgcagcaccccccagagcgaggtgtag

SEQ ID NO: 33832 - DNA, 3303 bp, Artificial Sequence
  Description of Artificial Sequence: Synthetic coding sequence
atgctgtgtgctgaaaataggaaggagatggaggactggatcagcagcctgaagtctgtgcagacccgggagccctatgaggtggcccagttcaacgtggagcacttcagcggcatgcacaactggtacgcctgcagccacgcccggcccaccttctgcaatgtgtgccgggagagcctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgaagatggagtggccatgccccaccagtggctggagggcaacctgcctgtgtctgccaagtgtgctgtgtgtgacaagacctgtggctctgtgctgcggctgcaggactggaagtgcctgtggtgcaagaccatggtgcacacagcctgcaaggacctgtaccaccccatctgccccctgggccagtgcaaggtgtccatcatcccccccatcgccctgaacagcacagacagtgatggcttctgccgggccaccttctccttctgtgtgagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaacttccgcatcctggtgtgtggaggagatggctctgtgggctgggtgctgtctgaaattgacaagctgaacctgaacaagcagtgccagctgggcgtgctgcccctgggcactggaaatgacctggcccgggtgctgggctggggcggcagctatgatgatgacacccagctgccccagatcctggagaagctggagcgggccagcaccaagatgctggaccgctggagcatcatgacctatgagctgaagctgccccccaaggccagcctgctgcccggccccccagaggccagcgaggagttctacatgaccatctatgaagattctgtggccacccacctgaccaagatcctgaacagtgatgaacatgctgtggtgatcagcagcgccaagaccctgtgtgagaccgtgaaggactttgtggccaaggtggagaagacctatgacaagaccctggagaatgctgtggtggctgatgctgtggccagcaagtgcagcgtgctgaatgagaagctggagcagctgctgcaggccctgcacacagacagccaggccgcccctgtgctgcccggcctgagccccctcatcgtggaggaggatgctgtggagagcagcagcgaggagagcctgggggagagcaaggagcagctgggagatgatgtgaccaagcccagcagccagaaggctgtgaagccccgggagatcatgctgcgggccaacagcctgaagaaggctgtgcggcaggtgattgaggaggccggcaaggtgatggatgaccccaccgtgcacccctgtgagcccgccaaccagagcagtgactatgacagcacagaaacagatgagagcaaggaggaggccaaggatgatggagccaaggagagcatcaccgtgaagacagcccccaggagcccagatgcccgggccagctatggccacagccagacagattctgtgcccggccctgctgtggccgccagcaaggagaacctgcctgtgctgaacacccgcatcatctgccccggcctgcgggccggcctggccgccagcattgctggcagcagcatcatcaacaagatgctgctggccaacatcgacccctttggagccacccccttcattgatcctgacctggacagcgtggatggctacagcgagaagtgtgtgatgaacaactactttggaattggcctggatgccaagatcagcctggagttcaacaacaagcgggaggagcaccctgagaagtgccgcagcaggaccaagaacctgatgtggtacggcgtgctgggcacccgggagctgctgcagaggagctacaagaacctggagcagagggtgcagctggagtgtgatggccagtacatccccctgcccagcctgcagggcattgctgtgctgaacatccccagctatgctgggggcaccaacttctggggcggcaccaaggaggatgacatctttgctgcccccagctttgatgacaagatcctggaggtggtggccatctttgacagcatgcagatggctgtgtccagggtcatcaagctgcagcaccacagaattgcccagtgcaggacagtgaagatcaccatctttggagatgagggcgtgcctgtgcaggtggatggagaggcctgggtgcagcccccaggcatcatcaagatcgtgcacaagaacagagcccagatgctgacccgggaccgggcctttgagagcaccctgaagtcctgggaggacaagcagaagtgtgacagcggcaagcctgtgctgcggacccacctgtacatccaccacgccatcgacctggccacagaggaggtgtcccagatgcagctgtgcagccaggccgctgaggagctgatcacccgcatctgtgatgctgccaccatccactgcctgctggagcaggagctggcccatgctgtgaatgcctgcagccacgccctgaacaaggccaacccccgctgcccagagagcctgacccgggacacagccacagagatcgccatcaacgtgaaggccctgtacaatgaaacagagagcctgctggtgggccgggtgcccctgcagctggagagcccccatgaggagcgggtgtccaatgccctgcacagcgtggaggtggagctgcagaagctgacagagatcccctggctgtactacatcctgcaccccaatgaagatgaggagccccccatggactgcaccaagaggaacaacagaagcacagtgttcagaattgtgcccaagttcaagaaggagaaggtgcagaagcagaagaccagcagccagcctgtgcagaagtggggcacagaggaggtggccgcctggctggacctgctgaacctgggggagtacaaggacatcttcatcagacatgacatcagaggagctgagctgctgcacctggagcggcgggacctgaagaacacagtgggggagaagagggacaccaaggaaaatggcaagcacatggacctgggcatccccaaggtgggccacgtgaagaggatcctgcagggcatcaaggagctgggccgcagcaccccccagagcgaggtgtag

SEQ ID NO: 33833 - DNA, 3255 bp, Artificial Sequence
  Description of Artificial Sequence: Synthetic coding sequence
atgctgtgtgctgaaaataggaaggagatggaggactggatcagcagcctgaagtctgtgcagacccgggagccctatgaggtggcccagttcaacgtggagcacttcagcggcatgcacaactggtacgcctgcagccacgcccggcccaccttctgcaatgtgtgccgggagagcctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgaagatggagtggccatgccccaccagtggctggagggcaacctgcctgtgtctgccaagtgtgctgtgtgtgacaagacctgtggctctgtgctgcggctgcaggactggaagtgcctgtggtgcaagaccatggtgcacacagcctgcaaggacctgtaccaccccatctgccccctgggccagtgcaaggtgtccatcatcccccccatcgccctgaacagcacagacagtgatggcttctgccgggccaccttctccttctgtgtgagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaacttccgcatcctggtgtgtggaggagatggctctgtgggctgggtgctgtctgaaattgacaagctgaacctgaacaagcagtgccagctgggcgtgctgcccctgggcactggaaatgacctggcccgggtgctgggctggggcggcagctatgatgatgacacccagctgccccagatcctggagaagctggagcgggccagcaccaagatgctggaccgctggagcatcatgacctatgagctgaagctgccccccaaggccagcctgctgcccggccccccagaggccagcgaggagttctacatgaccatctatgaagattctgtggccacccacctgaccaagatcctgaacagtgatgaacatgctgtggtgatcagcagcgccaagaccctgtgtgagaccgtgaaggactttgtggccaaggtggagaagacctatgacaagaccctggagaatgctgtggtggctgatgctgtggccagcaagtgcagcgtgctgaatgagaagctggagcagctgctgcaggccctgcacacagacagccaggccgcccctgtgctgcccggcctgagccccctcatcgtggaggaggatgctgtggagagcagcagcgaggagagcctgggggagagcaaggagcagctgggagatgatgtgaccaagcccagcagccagaaggctgtgaagccccgggagatcatgctgcgggccaacagcctgaagaaggctgtgcggcaggtgattgaggaggccggcaaggtgatggatgaccccaccgtgcacccctgtgagcccgccaaccagagcagtgactatgacagcacagaaacagatgagagcaaggaggaggccaaggatgatggagccaaggagagcatcaccgtgaagacagcccccaggagcccagatgcccgggccagctatggccacagccagacagattctgtgcccggccctgctgtggccgccagcaaggagaacctgcctgtgctgaacacccgcatcatctgccccggcctgcgggccggcctggccgccagcattgctggcagcagcatcatcaacaagatgctgctggccaacatcgacccctttggagccacccccttcattgatcctgacctggacagcgtggatggctacagcgagaagtgtgtgatgaacaactactttggaattggcctggatgccaagatcagcctggagttcaacaacaagcgggaggagcaccctgagaagtgccgcagcaggaccaagaacctgatgtggtacggcgtgctgggcacccgggagctgctgcagaggagctacaagaacctggagcagagggtgcagctggagtgtgatggccagtacatccccctgcccagcctgcagggcattgctgtgctgaacatccccagctatgctgggggcaccaacttctggggcggcaccaaggaggatgacatctttgctgcccccagctttgatgacaagatcctggaggtggtggccatctttgacagcatgcagatggctgtgtccagggtcatcaagctgcagcaccacagaattgcccagtgcaggacagtgaagatcaccatctttggagatgagggcgtgcctgtgcaggtggatggagaggcctgggtgcagcccccaggcatcatcaagatcgtgcacaagaacagagcccagatgctgacccgggaccgggcctttgagagcaccctgaagtcctgggaggacaagcagaagtgtgacagcggcaagcctgtgctgcggacccacctgtacatccaccacgccatcgacctggccacagaggaggtgtcccagatgcagctgtgcagccaggccgctgaggagctgatcacccgcatctgtgatgctgccaccatccactgcctgctggagcaggagctggcccatgctgtgaatgcctgcagccacgccctgaacaaggccaacccccgctgcccagagagcctgacccgggacacagccacagagatcgccatcaacgtgaaggccctgtacaatgaaacagagagcctgctggtgggccgggtgcccctgcagctggagagcccccatgaggagcgggtgtccaatgccctgcacagcgtggaggtggagctgcagaagctgacagagatcccctggctgtactacatcctgcaccccaatgaagatgaggagccccccatggactgcaccaagaggaacaacagaagcacagtgttcagaattgtgcccaagttcaagaaggagaaggtgcagaagcagaagaccagcagccagcctgtgcagaagtggggcacagaggaggtggccgcctggctggacctgctgaacctgggggagtacaaggacatcttcatcagacatgacatcagaggagctgagctgctgcacctggagcggcgggacctgaaggacctgggcatccccaaggtgggccacgtgaagaggatcctgcagggcatcaaggagctgggccgcagcaccccccagagcgaggtgtag

SEQ ID NO: 33834 - DNA, 2760 bp, Artificial Sequence
  Description of Artificial Sequence: Synthetic coding sequence
atgtggaacatcagccagggctgcaccaccggcaccccagcccccaccccagaccccccatctgtgacctgtgccgagagggtcttcctggagagcccccccatggcctgcccagccaaggtgcacacagcctgcaaggacctgtaccaccccatctgccccctgggccagtgcaaggtgtccatcatcccccccatcgccctgaacagcacagacagtgatggcttctgccgggccaccttctccttctgtgtgagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaacttccgcatcctggtgtgtggaggagatggctctgtgggctgggtgctgtctgaaattgacaagctgaacctgaacaagcagtgccagctgggcgtgctgcccctgggcactggaaatgacctggcccgggtgctgggctggggcggcagctatgatgatgacacccagctgccccagatcctggagaagctggagcgggccagcaccaagatgctggaccgctggagcatcatgacctatgagctgaagctgccccccaaggccagcctgctgcccggccccccagaggccagcgaggagttctacatgaccatctatgaggacagcgtggccacccacctgaccaagatcctgaacagtgatgagcacgctgtggtgatcagcagcgccaagaccctgtgtgaaacagtgaaggactttgtggccaaggtggagaagacctatgacaagaccctggagaatgctgtggtggctgatgctgtggccagcaaatgttctgtgctgaatgagaagctggagcagctgctgcaggccctgcacacagacagccaggccgcccctgtgctgcccggcctgagccccctgattgtggaggaggatgctgtggagagcagcagcgaggagagcctgggggagagcaaggagcagctgggagatgatgtgaccaagcccagcagccagaaggctgtgaagccccgggagatcatgctgcgggccaacagcctgaagaaggctgtgcggcaggtgattgaggaggccggcaaggtgatggatgaccccaccgtgcacccctgtgagcccgccaaccagagcagtgactatgacagcacagaaacagatgagagcaaggaggaggccaaggatgatggagccaaggagagcatcaccgtgaagacagcccccaggagcccagatgcccgggccagctatggccacagccagacagacagcgtgcccggccctgctgtggccgccagcaaagaaaacctgcctgtgctgaacacccgcatcatctgccccggcctgcgggccggcctggccgccagcattgctggcagcagcatcatcaacaagatgctgctggccaacatcgacccctttggagccacccccttcatcgaccctgacctggacagcgtggatggctacagcgagaagtgtgtgatgaacaactacttcggcatcggcctggatgccaagatcagcctggagttcaacaacaagcgggaggagcaccctgagaagtgccgcagcaggaccaagaacctgatgtggtatggagtgctgggcacccgggagctgctgcagaggagctacaagaacctggagcagagggtgcagctggagtgtgatggccagtacatccccctgcccagcctgcagggcattgctgtgctgaacatccccagctatgccggcggcaccaacttctggggcggcaccaaggaggatgacatctttgctgcccccagctttgatgacaagatcctggaggtggtggccatctttgacagcatgcagatggctgtgtccagggtcatcaagctgcagcaccaccgcatcgcccagtgcaggacagtgaagatcaccatctttggagatgaaggagtgcctgtgcaggtggatggagaggcctgggtgcagcccccaggcatcatcaagatcgtgcacaagaacagagcccagatgctgacccgggaccgggcctttgagagcaccctgaagtcctgggaggacaagcagaagtgtgacagcggcaagcctgtgctgcggacccacctgtacatccaccacgccatcgacctggccacagaggaggtgtcccagatgcagctgtgcagccaggccgctgaggagctgatcacccgcatctgtgatgctgccaccatccactgcctgctggagcaggagctggcccatgctgtgaatgcctgcagccacgccctgaacaaggccaacccccgctgcccagagagcctgacccgggacacagccacagaaattgccatcaacgtgaaggccctgtacaatgaaacagagagcctgctggtgggccgggtgcccctgcagctggagagcccccatgaggagcgggtgtccaatgccctgcacagcgtggaggtggagctgcagaagctgacagagatcccctggctgtactacatcctgcaccccaatgaagatgaggagccccccatggactgcaccaagaggaacaacagaagcaccgtcttccgcatcgtgcccaagttcaagaaggagaaggtgcagaagcagaagaccagcagccagcccggcagcggggacacagaaagtggcagctgtgaggccaacagccctggcaactag

SEQ ID NO: 33835 - DNA, 3495 bp, Artificial Sequence; identical to SEQ ID NO: 33830
  Description of Artificial Sequence: Synthetic coding sequence

SEQ ID NO: 33836 - DNA, 2721 bp, Artificial Sequence
  Description of Artificial Sequence: Synthetic coding sequence
atggagcccagagatggcagccctgaggcccggagcagtgacagcgagagcgccagcgccagcagcagcggcagcgagagagatgctggccctgagccagacaaggccccccggcggctgaacaagaggcgcttccctggcctgcggctgtttggccacaggaaggccatcaccaagagcggcctgcagcacctggcccctcctccacccacccctggggccccctgcagcgagagcgagcggcagatccgcagcacagtggactggagcgagagcgccacctatggagagcacatctggtttgagaccaacgtgtctggggacttctgctacgtgggggagcagtactgtgtggccaggatgctgcagaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcacgccgctgtggtgattcctcccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcatgctgagcccaaccctgaggccggccctgaggacagagatgaaggagccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccatggagagcggctgacccagtgccgggaggtggtgctgaccaccagcaaggccatccctgtgcaggtggatggagagccctgcaagctggccgccagccgcatcagaattgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagagatcgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaagctgccaagagaaatgacttctgcaagctgcaggagctgcaccgggccggcggggacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33837 - DNA, 2688 bp, Artificial Sequence
  Description of Artificial Sequence: Synthetic coding sequence
atgtggagataccgctcctgggatgtgccccagatccccagcgaggccccccagacccagaaggccatcaccaagagcggcctgcagcacctggcccctcctccacccacccctggggccccctgcagcgagagcgagcggcagatccgcagcacagtggactggagcgagagcgccacctatggagagcacatctggtttgagaccaacgtgtctggggacttctgctacgtgggggagcagtactgtgtggccaggatgctgcagaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggacggcaagtgccgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcatgctgctgtggtgatcccccccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcacgccgagcccaaccctgaggccggcccagaagatagagatgagggcgccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccacggggagcggctgacccagtgccgggaggtggtgctgaccaccagcaaggccatccctgtgcaggtggatggagagccctgcaagctggccgccagccgcatccgcatcgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33838 - DNA, 2790 bp, Artificial Sequence
  Description of Artificial Sequence: Synthetic coding sequence
atggagcccagagatggcagccctgaggcccggagcagtgacagcgagagcgccagcgccagcagcagcggcagcgagagagatgctggccctgagccagacaaggccccccggcggctgaacaagaggcgcttccctggcctgcggctgtttggccacaggaaggccatcaccaagagcggcctgcagcacctggcccctcctccacccacccctggggccccctgcagcgagagcgagcggcagatccgcagcacagtggactggagcgagagcgccacctatggagagcacatctggtttgagaccaacgtgtctggggacttctgctacgtgggggagcagtactgtgtggccaggatgctgcagaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggacggcaagtgccgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcatgctgctgtggtgatcccccccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcacgccgagcccaaccctgaggccggcccagaagatagagatgagggcgccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccacggggagcggctgacccagtgccgggaggtggtgctgaccaccagcaaggccatccctgtgcaggtggatggagagccctgcaagctggccgccagccgcatccgcatcgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33839 - DNA, 3354 bp, Artificial Sequence
  Description of Artificial Sequence: Synthetic coding sequence
atggagaccttcttccgccgccacttccggggcaaggtgcccggccctggagagggccagcagaggcccagctctgtgggcctgcccaccgggaaggccaggagaagaagccctgctggccaggccagcagcagcctggcccagaggcggcgcagcagcgcccagctgcagggctgcctgctgagctgtggggtgcgggcccagggcagcagcagaagaagaagcagcacagtgccccccagctgcaacccccgcttcatcgtggacaaggtgctgaccccccagcccaccaccgtgggcgcccagctgctgggcgcccccctgctgctgaccggcctggtgggcatgaatgaggaggagggcgtgcaggaggatgtggtggccgaggccagcagcgccatccagcccggcaccaagaccccaggccccccaccacccaggggggcccagcccctgctgcccctgccccgctacctgcggcgggccagcagccacctgctgcctgcagatgctgtgtatgaccacgccctgtggggcctgcacggctactacagaaggctgagccagaggcggcccagcggccagcaccctggccctgggggccggcgggccagcggcaccacagctggcaccatgctgcccaccagggtgcggcccctgagcagaagacggcaggtggccctgcggaggaaggctgctggcccccaggcctggagcgccctgctggccaaggccatcaccaagagcggcctgcagcacctggcccctcctccacccacccctggggccccctgcagcgagagcgagcggcagatccgcagcacagtggactggagcgagagcgccacctacggggagcacatctggtttgagaccaacgtgtctggggacttctgctacgtgggggagcagtactgtgtggccaggatgctgaagtctgtgtccaggaggaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggacggcaagtgccgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcatgctgctgtggtgatcccccccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcacgccgagcccaaccctgaggccggcccagaagatagagatgagggcgccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccacggggagcggctgacccagtgccgggaggtggtgctgaccaccagcaaggccatccctgtgcaggtggatggagagccctgcaagctggccgccagccgcatccgcatcgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33840 - DNA, 2787 bp, Artificial Sequence
  Description of Artificial Sequence: Synthetic coding sequence
atggagcccagagatggcagccctgaggcccggagcagtgacagcgagagcgccagcgccagcagcagcggcagcgagagagatgctggccctgagccagacaaggccccccggcggctgaacaagaggcgcttccctggcctgcggctgtttggccacaggaaggccatcaccaagagcggcctgcagcacctggcccctcctccacccacccctggggccccctgcagcgagagcgagcggcagatccgcagcacagtggactggagcgagagcgccacctatggagagcacatctggtttgagaccaacgtgtctggggacttctgctacgtgggggagcagtactgtgtggccaggatgctgaagtctgtgtccagaagaaaatgtgccgcctgcaagatcgtggtgcacaccccctgcatcgagcagctggagaagatcaacttccgctgcaagcccagcttccgggagagcggcagcagaaatgtgcgggagcccacctttgtgcgccaccactgggtgcacagaagacggcaggatggaaaatgtcgccactgtgggaagggcttccagcagaagttcaccttccacagcaaggagatcgtggccatcagctgctcctggtgcaagcaggcctaccacagcaaggtgtcctgcttcatgctgcagcagatcgaggagccctgcagcctgggcgtgcacgccgctgtggtgattcctcccacctggatcctgcgggcccggcggccccagaacaccctgaaggccagcaagaagaagaagagggccagcttcaagaggaagagcagcaagaagggccctgaggagggccgctggaggcccttcatcatccggcccacccccagccccctgatgaagcccctgctggtgtttgtgaaccccaagagcggcggcaaccagggcgccaagatcatccagagcttcctgtggtacctgaacccccggcaggtgtttgacctgagccagggcggccccaaggaggccctggagatgtacaggaaggtgcacaacctgcgcatcctggcctgtggaggagatggcaccgtgggctggatcctgagcaccctggaccagctgcggctgaagcccccacctcctgtggccatcctgcccctgggcactggaaatgacctggcccggaccctgaactggggcggcggctacacagatgagcctgtgtccaagatcctgagccacgtggaggagggcaatgtggtgcagctggaccgctgggacctgcatgctgagcccaaccctgaggccggccctgaggacagagatgaaggagccacagaccggctgcccctggatgtgttcaacaactacttcagcctgggctttgatgcccacgtgaccctggagttccacgagagccgggaggccaaccctgagaagttcaacagccgcttcaggaacaagatgttttatgccggcacagccttcagtgacttcctgatgggcagcagcaaggacctggccaagcacatccgggtggtgtgtgatggcatggacctgacccccaagatccaggacctgaagccccagtgtgtggtgttcctgaacatcccccgctactgtgccggcaccatgccctggggccaccctggagagcaccacgactttgagccccagagacatgatgatggctacctggaggtgattggcttcaccatgaccagcctggccgccctgcaggtgggcggccatggagagcggctgacccagtgccgggaggtggtgctgaccaccagcaaggccatccctgtgcaggtggatggagagccctgcaagctggccgccagccgcatcagaattgccctgaggaaccaggccaccatggtgcagaaggccaagagaagatctgctgcccccctgcacagcgaccagcagcctgtgcctgagcagctgcgcatccaggtgtcccgggtgtccatgcatgactatgaggccctgcactatgacaaggagcagctgaaggaggcctctgtgcccctgggcaccgtggtggtgcctggggacagcgacctggagctgtgccgggcccacatcgagcggctgcagcaggagccagatggagctggggccaagagccccacctgccagaagctgagccccaagtggtgcttcctggatgccaccacagccagccgcttctacagaattgaccgggcccaggagcacctgaactacgtgacagagatcgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaagctgccaagagaaatgacttctgcaagctgcaggagctgcaccgggccggcggggacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33841 - DNA, 846 bp, Artificial Sequence
  Description of Artificial Sequence: Synthetic coding sequence
atggagcccagagatggcagccctgaggcccggagcagtgacagcgagagcgccagcgccagcagcagcggcagcgagagagatgctggccctgagccagacaaggccccccggcggctgaacaagaggcgcttccctggcctgcggctgtttggccacagcaagagcaagagccccacctgccagaagctgagccccaagtggtgcttcctggatgccaccacagccagccgcttctacagaattgaccgggcccaggagcacctgaactacgtgacagaaattgcccaggatgagatctacatcctggaccctgagctgctgggcgccagcgcccggccagacctgcccacccccaccagccccctgcccaccagcccctgcagccccacccccaggagcctgcagggagatgctgccccaccccagggcgaggagctgattgaggccgccaagagaaatgacttctgcaagctgcaggagctgcacagagctggaggagacctgatgcacagagatgagcagagcaggaccctgctgcaccacgctgtgtccacaggcagcaaggatgtggtgcgctacctgctggaccacgcccctcctgagatcctggatgctgtggaggagaatggagagacctgcctgcaccaggccgccgccctgggccagaggaccatctgccactacatcgtggaggccggggccagcctgatgaagacagaccagcagggcgacaccccccggcagagagctgagaaggcccaggacacagagctggccgcctacctggagaaccggcagcactaccagatgatccagcgggaggaccaggagacagctgtgtag

SEQ ID NO: 33842 - DNA, 1014 bp, Artificial Sequence
  Description of Artificial Sequence: Synthetic coding sequence
atggccttcttcagccggctgaacctgcaggagggcctgcagaccttctttgtgctgcagtggatccctgtgtacatcttcctgggcgccatccccatcctgctgatcccctacttcctgctcttcagcaagttctggcccctggccgtgctgagcctggcctggctgacctatgactggaacacccacagccagggcggccgccgcagcgcctgggtgaggaactggaccctgtggaagtacttcaggaactacttccctgtgaagctggtgaagacccatgacctgagccccaagcacaactacatcatcgccaaccacccccacggcatcctgagctttggagtcttcatcaactttgccacagaggccactggaattgcccgcatcttccccagcatcaccccatttgtgggcaccctggagcgcatcttctggatccccatcgtgcgggagtatgtgatgtccatgggcgtgtgccctgtgagcagcagcgccctgaagtacctgctgacccagaagggcagcggaaatgctgtggtgattgtggtgggcggcgctgctgaggccctgctgtgcaggcctggggccagcaccctcttcctgaagcagaggaagggctttgtgaagatggccctgcagacaggagcctacctggtgcccagctacagctttggagaaaatgaggtgttcaaccaggagaccttccctgagggcacctggctgcggctcttccagaagaccttccaggacaccttcaagaagatcctgggcctgaacttctgcaccttccacggccggggcttcacccggggctcctggggcttcctgcccttcaaccggcccatcaccaccgtggtgggggagcccctgcccatcccccgcatcaagaggcccaaccagaagacagtggacaagtaccacgccctgtacatcagcgccctgaggaagctgtttgaccagcacaaggtggagtatggcctgcctgagacccaggagctgaccatcacctag

SEQ ID NO: 33843 - DNA, 267 bp, Artificial Sequence
  Description of Artificial Sequence: Synthetic coding sequence
atgcctgcctttgctgagtttgagaaggctgctgaggaggtgcgccacctgaagaccaagcccagtgatgaggagatgctgttcatctacggccactacaagcaggccaccgtgggggacatcaacacagagcggcccggcatgctggacttcaccgggaaggccaagtgggatgcctggaatgagctgaagggcaccagcaaagaagatgccatgaaggcctacatcaacaaggtggaggagctgaagaagaagtatggcatctag

SEQ ID NO: 33844 - DNA, 315 bp, Artificial Sequence
  Description of Artificial Sequence: Synthetic coding sequence
atgtggggagacctgtggctgctgcccccagccagcgccaaccctggcactggaacagaagctgagtttgagaaggctgctgaggaggtgcgccacctgaagaccaagcccagtgatgaggagatgctgttcatctacggccactacaagcaggccaccgtgggggacatcaacacagagcggcccggcatgctggacttcaccgggaaggccaagtgggatgcctggaatgagctgaagggcaccagcaaagaagatgccatgaaggcctacatcaacaaggtggaggagctgaagaagaagtatggcatctag

SEQ ID NO: 33845 - DNA, 264 bp, Artificial Sequence
  Description of Artificial Sequence: Synthetic coding sequence
atgagccaggccgagtttgagaaggctgctgaggaggtgcgccacctgaagaccaagcccagtgatgaggagatgctgttcatctacggccactacaagcaggccaccgtgggggacatcaacacagagaggcctggcatgctggacttcaccgggaaggccaagtgggatgcctggaatgagctgaagggcaccagcaaggaggatgccatgaaggcctacatcaacaaggtggaggagctgaagaagaagtatggcatctag

SEQ ID NO: 33846 - DNA, 315 bp, Artificial Sequence; identical to SEQ ID NO: 33844
  Description of Artificial Sequence: Synthetic coding sequence

SEQ ID NO: 33847 - DNA, 390 bp, Artificial Sequence
  Description of Artificial Sequence: Synthetic coding sequence
atgagccagcaccgggccggccggcggggcggcgtgggcaagaggggcgtgcggggccgggagctgggcggccagggcaagtacggggccggctgcagtgaatgtggcaccaggagaattgctgcccggggggaggccgagtttgagaaggctgctgaggaggtgcgccacctgaagaccaagcccagtgatgaggagatgctgttcatctacggccactacaagcaggccaccgtgggggacatcaacacagagaggcctggcatgctggacttcaccgggaaggccaagtgggatgcctggaatgagctgaagggcaccagcaaggaggatgccatgaaggcctacatcaacaaggtggaggagctgaagaagaagtatggcatctag

SEQ ID NO: 33848 - DNA, 315 bp, Artificial Sequence; identical to SEQ ID NO: 33844
  Description of Artificial Sequence: Synthetic coding sequence

SEQ ID NO: 33849 - DNA, 447 bp, Artificial Sequence
  Description of Artificial Sequence: Synthetic coding sequence
atggagcgctggggcaagggcctgcacggcctggaggagcggggggacagcgtgcccatccccaagcacagagctggaagaagaggaggagtgggcaagaggggcgtgcggggccgggagctgggcggccagggcaagtatggagctggctgcagtgaatgtggcaccaggagaattgctgcccggggggaggccgagtttgagaaggctgctgaggaggtgcgccacctgaagaccaagcccagtgatgaggagatgctgttcatctacggccactacaagcaggccaccgtgggggacatcaacacagagcggcccggcatgctggacttcaccgggaaggccaagtgggatgcctggaatgagctgaagggcaccagcaaagaagatgccatgaaggcctacatcaacaaggtggaggagctgaagaagaagtatggcatctag

SEQ ID NO: 33850 - DNA, 564 bp, Artificial Sequence
  Description of Artificial Sequence: Synthetic coding sequence
atgttcctgctgctgaactgcatcgtggccgtgtcccagaacatgggcatcggcaagaatggagacctgccccggccccccctgagaaatgagttccgctacttccagaggatgaccaccaccagctctgtggagggcaagcagaacctggtgatcatgggcaggaagacctggttcagcatccctgagaagaaccggcccctgaaggaccgcatcaacctggtgctgagccgggagctgaaggagcccccccagggcgcccacttcctggcccggagcctggatgatgccctgaagctgacagagaggcctgagctggccaacaaggtggacatgatctggatcgtgggcggcagctctgtgtacaaggaggccatgaaccacctgggccacctgaagctgtttgtgacccgcatcatgcaggactttgaaagtgacaccttcttcagcgagattgacctggagaagtacaagctgctgcctgagtacccaggagtgctgagtgatgtgcaggagggcaagcacatcaagtacaagtttgaggtgtgtgagaaggatgactag

SEQ ID NO: 33851 - DNA, 564 bp, Artificial Sequence; identical to SEQ ID NO: 33850
  Description of Artificial Sequence: Synthetic coding sequence

SEQ ID NO: 33852 - DNA, 564 bp, Artificial Sequence; identical to SEQ ID NO: 33850
  Description of Artificial Sequence: Synthetic coding sequence

SEQ ID NO: 33853 - DNA, 345 bp, Artificial Sequence
  Description of Artificial Sequence: Synthetic coding sequence
atgttcctgctgctgaactgcatcgtggccgtgtcccagaacatgggcatcggcaagaatggagacctgccccggccccccctgagaaatgagttccgctacttccagaggatgaccaccaccagctctgtggagggcaagcagaacctggtgatcatgggcaggaagacctggttcagcatccctgagaagaaccggcccctgaaggaccgcatcaacctggtgctgagccgggagctgaaggagcccccccagggcgcccacttcctggcccggagcctggatgatgccctgaagctgacagagaggcctgagctggccaacaaggtggacatgatctggtag

SEQ ID NO: 33854 - DNA, 597 bp, Artificial Sequence
  Description of Artificial Sequence: Synthetic coding sequence
atgcctgagcagagcaatgactacagagtggtggtgtttggagctggaggagtgggcaagagcagcctggtgctgcgctttgtgaagggcaccttccgggacacctacatccccaccatcgaggacacctaccggcaggtgatcagctgtgacaagtctgtgtgcaccctgcagatcacagacaccaccggcagccaccagtttcctgccatgcagaggctgagcatcagcaagggccacgccttcatcctggtgttttctgtgaccagcaagcagagcctggaggagctgggccccatctacaagctgattgtgcagatcaagggctctgtggaggacatccctgtgatgctggtgggcaacaagtgtgatgagacccagcgggaggtggacacccgggaggcccaggccgtggcccaggagtggaagtgtgccttcatggagaccagcgccaagatgaactacaacgtgaaggagctgttccaggagctgctgaccctggagaccaggaggaacatgagcctgaacattgatggcaagaggtctgggaagcagaagaggacagacagagtgaagggcaagtgcaccctgatgtag

SEQ ID NO: 33855 - DNA, 600 bp, Artificial Sequence
  Description of Artificial Sequence: Synthetic coding sequence
atgcctgagcagagcaatgactacagagtggccgtgtttggagctggaggagtgggcaagagcagcctggtgctgcgctttgtgaagggcaccttccgggagagctacatccccaccgtggaggacacctaccggcaggtgatcagctgtgacaagagcatctgcaccctgcagatcacagacaccaccggcagccaccagtttcctgccatgcagaggctgagcatcagcaagggccacgccttcatcctggtgtacagcatcaccagccggcagagcctggaggagctgaagcccatctatgagcagatctgtgagatcaagggagatgtggagagcatccccatcatgctggtgggcaacaagtgtgatgagagccccagccgggaggtgcagagcagcgaggccgaggccctggcccggacctggaagtgtgccttcatggagaccagcgccaagctgaaccacaacgtgaaggagctgttccaggagctgctgaacctggagaagagaagaacagtgtccctgcagattgatggcaagaagagcaagcagcagaagaggaaggagaagctgaagggcaaatgtgtgatcatgtag

SEQ ID NO: 33856 - DNA, 690 bp, Artificial Sequence
  Description of Artificial Sequence: Synthetic coding sequence
atgggaaatgccagctttggcagcaaggagcagaagctgctgaagaggctgcggctgctgcctgccctgctgatcctgcgggccttcaagccccacaggaagatccgggactacagagtggtggtggtgggcacagctggggtgggcaagagcaccctgctgcacaagtgggccagcggcaacttcagacatgagtacctgcccaccatcgagaacacctactgccagctgctgggctgcagccacggcgtgctgagcctgcacatcacagacagcaagtctggagatggcaacagagccctgcagagacatgtgattgcccggggccacgcctttgtgctggtgtacagcgtgaccaagaaggagaccctggaggagctgaaggccttctatgagctgatctgcaagatcaagggcaacaacctgcacaagttccccatcgtgctggtgggcaacaagagtgatgacacccaccgggaggtggccctgaatgatggagccacctgtgccatggagtggaactgtgccttcatggagatcagcgccaagacagatgtgaatgtgcaggagctgttccacatgctgctgaactacaagaagaagcccaccaccggcctgcaggagcctgagaagaagagccagatgcccaacaccacagagaagctgctggacaagtgcatcatcatgtag

SEQ ID NO: 33857 - DNA, 690 bp, Artificial Sequence; identical to SEQ ID NO: 33856
  Description of Artificial Sequence: Synthetic coding sequence

SEQ ID NO: 33858 - DNA, 501 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctag

SEQ ID NO: 33859 - DNA, 420 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggagtag

SEQ ID NO: 33860 - DNA, 756 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccctag

SEQ ID NO: 33861 - DNA, 420 bp, Artificial Sequence; identical to SEQ ID NO: 33859
  Description of Artificial Sequence: Synthetic coding sequence

SEQ ID NO: 33862 - DNA, 756 bp, Artificial Sequence; identical to SEQ ID NO: 33860
  Description of Artificial Sequence: Synthetic coding sequence

SEQ ID NO: 33863 - DNA, 420 bp, Artificial Sequence; identical to SEQ ID NO: 33859
  Description of Artificial Sequence: Synthetic coding sequence

SEQ ID NO: 33864 - DNA, 756 bp, Artificial Sequence; identical to SEQ ID NO: 33860
  Description of Artificial Sequence: Synthetic coding sequence

SEQ ID NO: 33865 - DNA, 756 bp, Artificial Sequence; identical to SEQ ID NO: 33860
  Description of Artificial Sequence: Synthetic coding sequence

SEQ ID NO: 33866 - DNA, 420 bp, Artificial Sequence; identical to SEQ ID NO: 33859
  Description of Artificial Sequence: Synthetic coding sequence

SEQ ID NO: 33867 - DNA, 192 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagcaggtag

SEQ ID NO: 33868 - DNA, 756 bp, Artificial Sequence; identical to SEQ ID NO: 33860
  Description of Artificial Sequence: Synthetic coding sequence

SEQ ID NO: 33869 - DNA, 420 bp, Artificial Sequence; identical to SEQ ID NO: 33859
  Description of Artificial Sequence: Synthetic coding sequence

SEQ ID NO: 33870 - DNA, 420 bp, Artificial Sequence; identical to SEQ ID NO: 33859
  Description of Artificial Sequence: Synthetic coding sequence

SEQ ID NO: 33871 - DNA, 192 bp, Artificial Sequence; identical to SEQ ID NO: 33867
  Description of Artificial Sequence: Synthetic coding sequence

SEQ ID NO: 33872 - DNA, 630 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtactag

SEQ ID NO: 33873 - DNA, 420 bp, Artificial Sequence; identical to SEQ ID NO: 33859
  Description of Artificial Sequence: Synthetic coding sequence

SEQ ID NO: 33874 - DNA, 420 bp, Artificial Sequence; identical to SEQ ID NO: 33859
  Description of Artificial Sequence: Synthetic coding sequence

SEQ ID NO: 33875 - DNA, 420 bp, Artificial Sequence; identical to SEQ ID NO: 33859
  Description of Artificial Sequence: Synthetic coding sequence

SEQ ID NO: 33876 - DNA, 144 bp, Artificial Sequence
  Description of Artificial Sequence: Synthetic coding sequence
tctgaggccgtgtacctgaatgacagcacctatgatggccacacagtgggcggcctgcagtatggaggcctgggccagctggctgatggagtggtgggcctggatgacttcaggaagagccaggagctgcgggtgtggccctag

SEQ ID NO: 33877 - DNA, 444 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagacccctag

SEQ ID NO: 33878 - DNA, 420 bp, Artificial Sequence; identical to SEQ ID NO: 33859
  Description of Artificial Sequence: Synthetic coding sequence

SEQ ID NO: 33879 - DNA, 756 bp, Artificial Sequence
  Description of Artificial Sequence: Synthetic coding sequence
atgccccacctggccagcctcttcaccgccagcagccgctgctgcccccaccccctgcggcctgagggcagcggggccatgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagaggagagtggctgtccttcctgggcatctgcttcctgagccggggcctggagggcggggagtgtggggagtgggccagccgcatccccagccctgctgggaagctgagcctgtag

SEQ ID NO: 33880 - DNA, 1620 bp, Artificial Sequence
  Description of Artificial Sequence: Synthetic coding sequence
atggtgcctggggcccggggcggcggggccctggcccgggctgctggccggggcctgctggccctgctgctggccgtgtctgcccccctgcggctgcaggccgaggagctgggagatggctgcggccacctggtgacctaccaggacagcggcaccatgaccagcaagaactacccaggcacctaccccaaccacacagtgtgtgagaagaccatcaccgtgcccaagggcaagaggctcatcctgcggctgggggacctggacatcgagagccagacctgtgccagtgactacctgctcttcaccagcagcagtgaccagtatggcccctactgcggctccatgacagtgcccaaggagctgctgctgaacaccagcgaggtgacagtgcgctttgagagcggcagccacatcagcggccggggcttcctgctgacctacgccagcagtgaccacccagacctgatcacctgcctggagcgggccagccactacctgaagacagagtacagcaagttctgcccagctggctgcagagatgtggccggggacatcagcggcaacatggtggatggctacagagacaccagcctgctgtgcaaggccgccatccacgccggcatcatcgcagatgagctgggcggccagatctctgtgctgcagaggaagggcatcagccgctatgagggcatcctggccaacggggtgctgagcagagatggcagcctgagtgacaagcgcttcctgttcaccagcaatggctgcagccgcagcctgagctttgagccagatggccagatccgggccagcagctcctggcagagcgtgaatgaaagtggggaccaggtgcactggagccctggccaggcccggctgcaggaccagggccccagctgggccagcggggacagcagcaacaaccacaagccccgggagtggctggagattgacctgggggagaagaagaagatcaccggcatccgcaccaccggcagcacccagagcaacttcaacttctacgtgaagagctttgtgatgaacttcaagaacaacaacagcaagtggaagacctacaagggcatcgtgaacaatgaggagaaggtgttccagggcaacagcaacttccgggaccctgtgcagaacaacttcatcccccccatcgtggcccgctacgtgcgggtggtgccccagacctggcaccagagaattgccctgaaggtggagctgattggctgccagatcacccagggcaatgacagcctggtgtggaggaagaccagccagagcacctctgtgtccaccaagaaggaggatgagaccatcacccggcccatccccagcgaggagaccagcacaggcatcaacatcaccaccgtggccatccccctggtgctgctggtggtgctggtgtttgctggcatgggcatctttgctgccttcaggaagaagaagaagaagggcagcccctacggcagcgctgaggcccagaagacagactgctggaagcagatcaagtacccctttgcccggcaccagagcgctgagttcaccatctcctatgacaatgagaaggagatgacccagaagctggacctgatcaccagtgacatggccggctag

SEQ ID NO: 33881 - DNA, 2148 bp, Artificial Sequence
  Description of Artificial Sequence: Synthetic coding sequence
atggtgcctggggcccggggcggcggggccctggcccgggctgctggccggggcctgctggccctgctgctggccgtgtctgcccccctgcggctgcaggccgaggagctgggagatggctgcggccacctggtgacctaccaggacagcggcaccatgaccagcaagaactacccaggcacctaccccaaccacacagtgtgtgagaagaccatcaccgtgcccaagggcaagaggctcatcctgcggctgggggacctggacatcgagagccagacctgtgccagtgactacctgctcttcaccagcagcagtgaccagtatggcccctactgcggctccatgacagtgcccaaggagctgctgctgaacaccagcgaggtgacagtgcgctttgagagcggcagccacatcagcggccggggcttcctgctgacctacgccagcagtgaccacccagacctgatcacctgcctggagcgggccagccactacctgaagacagagtacagcaagttctgcccagctggctgcagagatgtggccggggacatcagcggcaacatggtggatggctacagagacaccagcctgctgtgcaaggccgccatccacgccggcatcatcgcagatgagctgggcggccagatctctgtgctgcagaggaagggcatcagccgctatgagggcatcctggccaacggggtgctgagcagagatggcagcctgagtgacaagcgcttcctgttcaccagcaatggctgcagccgcagcctgagctttgagccagatggccagatccgggccagcagctcctggcagagcgtgaatgaaagtggggaccaggtgcactggagccctggccaggcccggctgcaggaccagggccccagctgggccagcggggacagcagcaacaaccacaagccccgggagtggctggagattgacctgggggagaagaagaagatcaccggcatccgcaccaccggcagcacccagagcaacttcaacttctacgtgaagagctttgtgatgaacttcaagaacaacaacagcaagtggaagacctacaagggcatcgtgaacaatgaggagaaggtgttccagggcaacagcaacttccgggaccctgtgcagaacaacttcatcccccccatcgtggcccgctacgtgcgggtggtgccccagacctggcaccagagaattgccctgaaggtggagctgattggctgccagatcacccagggcaatgacagcctggtgtggaggaagaccagccagagcacctctgtgtccaccaagaaggaggatgagaccatcacccggcccatccccagcgaggagaccagcacaggcatcaacatcaccaccgtggccatccccctggtgctgctggtggtgctggtgtttgctggcatgggcatctttgctgccttcaggaagaagaagaagaagggcagcccctacggcagcgctgaggcccagaagacagactgctggaagcagatcaagtacccctttgcccggcaccagagcgctgagttcaccatctcctatgacaatgagaaggagatgacccagaagctggacctgatcaccagtgacatggctgactaccagcagcccctgatgattggcaccggcaccgtgaccaggaagggcagcaccttccggcccatggacacagatgctgaggaggccggcgtgtccacagatgctgggggccactatgactgcccccagagagctggaagacatgaatatgccctgcccctggcccctcctgagccagaatatgccacccccatcgtggagcggcacgtgctgcgggcccacaccttcagcgcccagagcggctacagagtgcccggcccccagcccggccacaagcacagcctgagcagcggcggcttcagccctgtggccggcgtgggcgcccaggatggagactaccagaggccccacagcgcccagcctgctgaccggggctatgaccggcccaaggctgtgtctgccctggccacagagagcggccacccagacagccagaagccacccacccaccctggcaccagtgacagctacagcgccccccgggactgcctgacccccctgaaccagacagccatgacagccctgctgtag

SEQ ID NO: 33882 - DNA, 1551 bp, Artificial Sequence
  Description of Artificial Sequence: Synthetic coding sequence
atggtgcctggggcccggggcggcggggccctggcccgggctgctggccggggcctgctggccctgctgctggccgtgtctgcccccctgcggctgcaggccgaggagctgggagatggctgcggccacctggtgacctaccaggacagcggcaccatgaccagcaagaactacccaggcacctaccccaaccacacagtgtgtgagaagaccatcaccgtgcccaagggcaagaggctcatcctgcggctgggggacctggacatcgagagccagacctgtgccagtgactacctgctcttcaccagcagcagtgaccagtatggcccctactgcggctccatgacagtgcccaaggagctgctgctgaacaccagcgaggtgacagtgcgctttgagagcggcagccacatcagcggccggggcttcctgctgacctacgccagcagtgaccacccagacctgatcacctgcctggagcgggccagccactacctgaagacagagtacagcaagttctgcccagctggctgcagagatgtggccggggacatcagcggcaacatggtggatggctacagagacaccagcctgctgtgcaaggccgccatccacgccggcatcatcgcagatgagctgggcggccagatctctgtgctgcagaggaagggcatcagccgctatgagggcatcctggccaacggggtgctgagcagagatggcagcctgagtgacaagcgcttcctgttcaccagcaatggcatcaacatcaccaccgtggccatccccctggtgctgctggtggtgctggtgtttgctggcatgggcatctttgctgccttcaggaagaagaagaagaagggcagcccctacggcagcgctgaggcccagaagacagactgctggaagcagatcaagtacccctttgcccggcaccagagcgctgagttcaccatctcctatgacaatgagaaggagatgacccagaagctggacctgatcaccagtgacatggctgactaccagcagcccctgatgattggaactggaacagtgaccaggaagggcagcaccttccggcccatggacacagatgctgaggaggccggcgtgtccacagatgctgggggccactatgactgcccccagagagctggaagacatgaatatgccctgcccctggcccctcctgagccagaatatgccacccccatcgtggagagacatgtgctgcgggcccacaccttcagcgcccagagcggctacagagtgcccggcccccagcccggccacaagcacagcctgagcagcggcggcttcagccctgtggccggcgtgggcgcccaggatggagactaccagaggccccacagcgcccagcctgctgaccggggctatgaccggcccaaggctgtgtctgccctggccacagaaagtggccacccagacagccagaagccacccacccaccctggcaccagtgacagctacagcgccccccgggactgcctgacccccctgaaccagacagccatgacagccctgctgtag

SEQ ID NO: 33883 - DNA, 618 bp, Artificial Sequence
  Description of Artificial Sequence: Synthetic coding sequence
atgaacttcaagaacaacaacagcaagtggaagacctacaagggcatcgtgaacaatgaggagaaggtgttccagggcaacagcaacttccgggaccctgtgcagaacaacttcatcccccccatcgtggcccgctacgtgcgggtggtgccccagacctggcaccagagaattgccctgaaggtggagctgattggctgccagatcacccagggcaatgacagcctggtgtggaggaagaccagccagagcacctctgtgtccaccaagaaggaggatgagaccatcacccggcccatccccagcgaggagaccagcacaggcatcaacatcaccaccgtggccatccccctggtgctgctggtggtgctggtgtttgctggcatgggcatctttgctgccttcaggaagaagaagaagaagggcagcccctacggcagcgctgaggcccagaagacagactgctggaagcagatcaagtacccctttgcccggcaccagagcgctgagttcaccatctcctatgacaatgagaaggagatgacccagaagctggacctgatcaccagtgacatggccgccagccctgagcctgtgtctgagcccctgcccccatag

SEQ ID NO: 33884 - DNA, 2328 bp, Artificial Sequence
  Description of Artificial Sequence: Synthetic coding sequence
atggccagcagagctgtggtgcgggcccggcgctgcccccagtgcccccaggtgcgggctgctgctgctgccccagcctgggccgccctgcccctgagccgcagcctgcccccctgcagcaacagcagcagcttctccatgcccctcttcctgctgctgctgctggtgctgctgctgctgctggaggatgctggggcccagcagggagatggctgcggccacacagtgctgggccctgagagcggcaccctgaccagcatcaactacccccagacctaccccaacagcacagtgtgtgagtgggagatccgggtgaagatgggagagcgggtgcgcatcaagtttggagactttgatattgaagattctgacagctgccacttcaactacctgcgcatctacaatggaattggagtgtccaggacagagatcggcaagtactgcggcctgggcctgcagatgaaccacagcattgagagcaaaggaaatgagatcaccctgctcttcatgagcggcatccacgtgtctggccggggcttcctggccagctacagcgtgattgacaagcaggacctgatcacctgcctggacacagccagcaacttcctggagcctgagttcagcaagtactgcccagctggctgcctgctgccctttgctgagatcagcggcaccatcccccacggctacagagacagcagccccctgtgcatggccggcgtgcatgctggggtggtgagcaacaccctgggcggccagatctctgtggtgatcagcaagggcatcccctactatgagagcagcctggccaacaacgtgacctctgtggtgggccacctgagcaccagcctcttcaccttcaagaccagcggctgctacggcaccctgggcatggagagcggcgtgattgctgacccccagatcacagccagctctgtgctggagtggacagaccacacaggccaggagaacagctggaagcccaagaaggcccggctgaagaagccaggccccccctgggccgcctttgccacagatgagtaccagtggctgcagattgacctgaacaaggagaagaagatcaccggcatcatcaccaccggcagcaccatggtggagcacaactactacgtgtctgcctaccgcatcctgtacagtgatgatggccagaagtggacagtgtaccgggagcccggggtggagcaggacaagatcttccagggcaacaaggactaccaccaggatgtgaggaacaacttcctgccccccatcatcgcccgcttcatccgggtgaaccccacccagtggcagcagaagatcgccatgaagatggagctgctgggctgccagttcatccccaagggccggccccccaagctgacccagcccccacctccaagaaacagcaatgacctgaagaacaccacagccccacccaagatcgccaagggccgggcccccaagttcacccagcccctgcagcccaggagcagcaatgagttccctgcccagacagagcagaccacagccagcccagacatccggaacaccaccgtgacccccaacgtgaccaaggatgtggccctggccgctgtgctggtgcctgtgctggtgatggtgctgaccaccctcatcctgatcctggtgtgtgcctggcactggaggaacaggaagaagaagacagagggcacctatgacctgccctactgggacagagctggctggtggaagggcatgaagcagttcctgcctgccaaggctgtggaccacgaggagacccctgtgcgctacagcagcagcgaggtgaaccacctgagcccccgggaggtgaccaccgtgctgcaggccgacagcgcagaatatgcccagcccctggtgggcggcatcgtgggcaccctgcaccagaggagcaccttcaagccagaggagggcaaggaggccggctacgccgacctggacccctacaacagccctggccaggaggtgtaccacgcctatgcagagcccctgcccatcactggaccagaatatgccacccccatcatcatggacatgagcggccaccccaccacctctgtgggccagcccagcaccagcaccttcaaggccaccggcaaccagcccccacccctggtgggcacctacaacaccctgctgagcaggacagacagctgcagcagcgcccaggcccagtatgacacccccaaggccggcaagccaggcctgcctgccccagatgagctggtgtaccaggtgccccagagcacccaggaggtgtctggggccggcagagatggagaatgtgatgtgttcaaggagatcctgtag

SEQ ID NO: 33885 - DNA, 2370 bp, Artificial Sequence
  Description of Artificial Sequence: Synthetic coding sequence
atggccagcagagctgtggtgcgggcccggcgctgcccccagtgcccccaggtgcgggctgctgctgctgccccagcctgggccgccctgcccctgagccgcagcctgcccccctgcagcaacagcagcagcttctccatgcccctcttcctgctgctgctgctggtgctgctgctgctgctggaggatgctggggcccagcagggagatggctgcggccacacagtgctgggccctgagagcggcaccctgaccagcatcaactacccccagacctaccccaacagcacagtgtgtgagtgggagatccgggtgaagatgggagagcgggtgcgcatcaagtttggagactttgatattgaagattctgacagctgccacttcaactacctgcgcatctacaatggaattggagtgtccaggacagagatcggcaagtactgcggcctgggcctgcagatgaaccacagcattgagagcaaaggaaatgagatcaccctgctcttcatgagcggcatccacgtgtctggccggggcttcctggccagctacagcgtgattgacaagcaggacctgatcacctgcctggacacagccagcaacttcctggagcctgagttcagcaagtactgcccagctggctgcctgctgccctttgctgagatcagcggcaccatcccccacggctacagagacagcagccccctgtgcatggccggcgtgcatgctggggtggtgagcaacaccctgggcggccagatctctgtggtgatcagcaagggcatcccctactatgagagcagcctggccaacaacgtgacctctgtggtgggccacctgagcaccagcctcttcaccttcaagaccagcggctgctacggcaccctgggcatggagagcggcgtgattgctgacccccagatcacagccagctctgtgctggagtggacagaccacacaggccaggagaacagctggaagcccaagaaggcccggctgaagaagccaggccccccctgggccgcctttgccacagatgagtaccagtggctgcagattgacctgaacaaggagaagaagatcaccggcatcatcaccaccggcagcaccatggtggagcacaactactacgtgtctgcctaccgcatcctgtacagtgatgatggccagaagtggacagtgtaccgggagcccggggtggagcaggacaagatcttccagggcaacaaggactaccaccaggatgtgaggaacaacttcctgccccccatcatcgcccgcttcatccgggtgaaccccacccagtggcagcagaagatcgccatgaagatggagctgctgggctgccagttcatccccaagggccggccccccaagctgacccagcccccacctccaagaaacagcaatgacctgaagaacaccacagccccacccaagatcgccaagggccgggcccccaagttcacccagcccctgcagcccaggagcagcaatgagttccctgcccagacagagcagaccacagccagcccagacatccggaacaccaccgtgacccccaacgtgaccaaggatgtggccctggccgctgtgctggtgcctgtgctggtgatggtgctgaccaccctcatcctgatcctggtgtgtgcctggcactggaggaacaggaagaagaagacagagggcacctatgacctgccctactgggacagagctggcttctacctgatggtgtccctggcctgccgccacaatgaaggctggtggaagggcatgaagcagttcctgcctgccaaggctgtggaccacgaggagacccctgtgcgctacagcagcagcgaggtgaaccacctgagcccccgggaggtgaccaccgtgctgcaggccgacagcgcagaatatgcccagcccctggtgggcggcatcgtgggcaccctgcaccagaggagcaccttcaagccagaggagggcaaggaggccggctacgccgacctggacccctacaacagccctggccaggaggtgtaccacgcctatgcagagcccctgcccatcactggaccagaatatgccacccccatcatcatggacatgagcggccaccccaccacctctgtgggccagcccagcaccagcaccttcaaggccaccggcaaccagcccccacccctggtgggcacctacaacaccctgctgagcaggacagacagctgcagcagcgcccaggcccagtatgacacccccaaggccggcaagccaggcctgcctgccccagatgagctggtgtaccaggtgccccagagcacccaggaggtgtctggggccggcagagatggagaatgtgatgtgttcaaggagatcctgtag

SEQ ID NO: 33886 - DNA, 1140 bp, Artificial Sequence
  Description of Artificial Sequence: Synthetic coding sequence
atgcccctcttcctgctgctgctgctggtgctgctgctgctgctggaggatgctggggcccagcagggagatggctgcggccacacagtgctgggccctgagagcggcaccctgaccagcatcaactacccccagacctaccccaacagcacagtgtgtgagtgggagatccgggtgaagatgggagagcgggtgcgcatcaagtttggagactttgatattgaagattctgacagctgccacttcaactacctgcgcatctacaatggaattggagtgtccaggacagagatcggcaagtactgcggcctgggcctgcagatgaaccacagcattgagagcaaaggaaatgagatcaccctgctcttcatgagcggcatccacgtgtctggccggggcttcctggccagctacagcgtgattgacaagcagggcagcaactacctgtttggccactgcatccagttctggaacctgagcagcggcaagtactgcccagctggctgcctgctgccctttgctgagatcagcggcaccatcccccacggctacagagacagcagccccctgtgcatggccggcgtgcatgctggggtggtgagcaacaccctgggcggccagatctctgtggtgatcagcaagggcatcccctactatgagagcagcctggccaacaacgtgacctctgtggtgtctgtgtccctgctgatggtgttcatcctcttctttgtgtctggctgctacggcaccctgggcatggagagcggggaccggggcagcagcaacaacagcatcgtgctggagtggacagaccacacaggccaggagaacagctggaagcccaagaagcaggccgagaagacctggacagccctgggctttgccacagatgagtaccagtggctgcagattgacctgaacaaggagaagaagatcaccggcatcatcaccaccggcagcaccatggtgaccatcaccatgtgcctgcccacagagagctgcaccgtgatgatgggcagaaatggcctgtgcacagagagcctggtggagcaggacaagatcttccagggcaacaaggactaccaccaggatgtgaggaacaacttcctgccccccatcatcgcccgcttcatcagatag

SEQ ID NO: 33887 - DNA, 1884 bp, Artificial Sequence
  Description of Artificial Sequence: Synthetic coding sequence
atgaacctgatcttccacaaggacatcctgtttggcatcccagccaacaaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggtggagcagtgccgcttctgcatggtgcacctgaagacctgcaccaacacaggccagagcaagtag

SEQ ID NO: 33888 - DNA, 2082 bp, Artificial Sequence
  Description of Artificial Sequence: Synthetic coding sequence
atgattgacctcttcaaggccgagtgggtgtcctctgtgtgtgtgcaggtgtccagaaatggccgcacagaccaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcactggagtcatcaagctgagcagcgctgtggaggtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33889 - DNA, 2052 bp, Artificial Sequence
  Description of Artificial Sequence: Synthetic coding sequence
atgattgacctcttcaaggccgagtgggtgtcctctgtgtgtgtgcaggtgtccagaaatggccgcacagaccaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33890 - DNA, 2790 bp, Artificial Sequence
  Description of Artificial Sequence: Synthetic coding sequence
atgaagggcctgagcggcagccgcagccaccaccacggcgtgacctgtgacagcgcctgtgacagcctgagccaccacagcgacaggaagccctacctgctgagccctgtggagcaccaccctgctgaccacccctactacacccagaggaacagcttccaggccgagtgtgtgggccccttcagtgaccccctggccagcagcaccttcccccggcggcactacaccagccagcaggagctgaaggatgaatgtgccctggtgcccaggaccctggccaccaaggccaaccgcatcccagccaacctgctggaccagtttgagcggcagctgcccctgagcagagatggctaccacaccctgcagtacaagaggacagctgtggagcacagaagtgacagccctggccgcatccgccacctggtgcacagcgtgcagaagctgttcaccaagagccacagcctggagggccccagcaagggctctgtgaatggaggcaaggccagcccagatgaggcccaggccgcccgctatggcaagaggagcaagagcaaggagaggagagctgagcccaaggcccggcccagcaccagccctggctggtggagcagtgatgacaacctggatggagacatgtgcatctaccacgcccccagcggcgtgatgaccatgggccgctgcccagacagaagtgccagccagtacttcctggaggcctacaacaccatcagcgagcaggccgtgaaggccagccgcagcaacaatgatgtgaagtgcagcacctgtgccaacctgcctgtgtccctggacacccccctgctgaagaagagcgcctggagcagcaccctgactgtgtcccgggcccgggaggtgtaccagaaggcctctgtgaacatggaccaggccatggtgaagtctgagagctgccagcaggagaggagctgccagtacctgcaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggtggagcagtgccgcttctgcatggtgcacctgaagacctgcaccaacacaggccagagcaagtag

SEQ ID NO: 33891 - DNA, 2934 bp, Artificial Sequence
  Description of Artificial Sequence: Synthetic coding sequence
atgaagggcctgagcggcagccgcagccaccaccacggcgtgacctgtgacagcgcctgtgacagcctgagccaccacagcgacaggaagccctacctgctgagccctgtggagcaccaccctgctgaccacccctactacacccagaggaacagcttccaggccgagtgtgtgggccccttcagtgaccccctggccagcagcaccttcccccggcggcactacaccagccagcaggagctgaaggatgaatgtgccctggtgcccaggaccctggccaccaaggccaaccgcatcccagccaacctgctggaccagtttgagcggcagctgcccctgagcagagatggctaccacaccctgcagtacaagaggacagctgtggagcacagaagtgacagccctggccgcatccgccacctggtgcacagcgtgcagaagctgttcaccaagagccacagcctggagggccccagcaagggctctgtgaatggaggcaaggccagcccagatgaggcccaggccgcccgctatggcaagaggagcaagagcaaggagaggagagctgagcccaaggcccggcccagcaccagccctggctggtggagcagtgatgacaacctggatggagacatgtgcatctaccacgcccccagcggcgtgatgaccatgggccgctgcccagacagaagtgccagccagtacttcctggaggcctacaacaccatcagcgagcaggccgtgaaggccagccgcagcaacaatgatgtgaagtgcagcacctgtgccaacctgcctgtgtccctggacacccccctgctgaagaagagcgcctggagcagcaccctgactgtgtcccgggcccgggaggtgtaccagaaggcctctgtgaacatggaccaggccatggtgaagtctgagagctgccagcaggagaggagctgccagtacctgcaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33892 - DNA, 2028 bp, Artificial Sequence
  Description of Artificial Sequence: Synthetic coding sequence
atgaacctgatcttccacaaggacatcctgtttggcatcccagccaacaaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33893 - DNA, 2790 bp, Artificial Sequence; identical to SEQ ID NO: 33890
  Description of Artificial Sequence: Synthetic coding sequence

SEQ ID NO: 33894 - DNA, 1986 bp, Artificial Sequence
  Description of Artificial Sequence: Synthetic coding sequence
atggacctgaagaccctgaagctgttcaacagccagctgcgctgtggctggctgctgtacatctggaacaaggccttcatggcccacctgcgggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33895 - DNA, 2058 bp, Artificial Sequence
  Description of Artificial Sequence: Synthetic coding sequence
atgaacctgatcttccacaaggacatcctgtttggcatcccagccaacaaggtgccccaggatgagtggacaggctacaccccccggggcaaggatgatgagatcccctgcaggaggatgaggagcggcagctacatcaaggccatgggagatgaggacagcggggacagcgacaccagccccaagcccagccccaaggtggccgcccggcgggagagctacctgaaggccacccagcccagcctgacagagctgaccaccctgaagatcagcaatgagcacagccccaagctgcagatccgcagccacagctacctgcgggctgtgtctgaggtgtccatcaacagaagcctggacagcctggaccctgctggcctgctgaccagccccaagttccgcagcagaaatgaaagctacatgagggccatgagcaccatcagccaggtgtctgagatggaggtgaatggccagtttgagagcgtgtgtgagagcgtcttcagcgagctggagagccaggccgtggaggccctggacctgcccatgcctggctgcttcaggatgaggagccacagctatgtgcgggccatcgagaagggctgcagccaggatgatgaatgtgtgtccctgcggagcagcagcccccccaggaccaccaccaccgtgaggaccatccagagcagcactggagtcatcaagctgagcagcgctgtggaggtgagcagctgcatcaccacctacaagaagaccccacctcctgtgccccccaggaccaccaccaagcccttcatcagcatcacagcccagagcagcacagaaagtgcccaggatgcctacatggatggccagggccagagaggagacatcatcagccagagcggcctgagcaacagcacagagagcctggacagcatgaaggccctgacagctgccattgaagctgccaatgcccagatccacggccctgccagccagcacatgggcaacaacacagccaccgtgaccaccaccaccaccatcgccaccgtgaccacagaggacaggaagaaggaccacttcaagaagaaccgctgcctgagcatcggcatccaggtggatgatgctgaggagccagacaagacaggagagaacaaggcccccagcaagttccagagcgtgggcgtgcaggtggaggaggagaagtgcttccgccgcttcaccaggagcaacagcgtgaccacagctgtgcaggccgacctggacttccatgacaacctggagaacagcctggagagcattgaggacaacagctgccccggccccatggcccggcagttcagcagagatgccagcaccagcacagtgtccatccagggcagcggcaaccactaccacgcctgtgccgcagatgatgactttgacacagactttgaccccagcatcctgcccccaccagacccctggattgacagcatcacagaggaccccctggaggccgtgcagaggtctgtgtgccacagagatggccactggttcctgaagctgctgcaggccgagcgggacaggatggagggctggtgccagcagatggagcgggaggagcgggagaacaacctgcctgaggacatcctgggcaagatcagaacagctgtgggcagcgcccagctgctgatggcccagaagttctaccagttccgggagctgtgtgaggagaacctgaaccccaatgcccacccccggcccaccagccaggacctggccggcttctgggacatgctgcagctgagcattgagaacatctccatgaagtttgatgagctgcaccagctgaaggccaacaactggaagcagatggaccccctggacaagaaggagcggcgggcccctcctcctgtgcccaagaagccagccaagggccctgcccccctcatccgggagaggagcctggagagcagccagaggcaggaggccaggaagaggctgatggccgccaagagagctgcctctgtgcggcagaacagcgccacagagagcgctgagagcattgagatctacatccctgaggcccagacccggctgtag

SEQ ID NO: 33896 - DNA, 2196 bp, Artificial Sequence
  Description of Artificial Sequence: Synthetic coding sequence
atgggcagcgagaaggacagcgagagccccaggagcaccagcctgcatgctgctgccccagaccccaagtgccgcagcggcggcagaagaagaaggctgaccctgcacagcgtcttcagcgccagcgcccggggccggcgggcccgggccaagccccaggccgagcccccacctcctgctgcccagcccccaccagccccagccccagctgctgcccagggccccccacctgaggccctgcctgctgagcctgctgctgaggccgaggccgaggccgctgctgctgctgctgagcccggctttgatgatgaggaggccgctgagggcggcggccctggagctgaggaggtggagtgccccctgtgcctggtgcggctgcccccagagcgggccccccggctgctgagctgcccccacaggagctgccgggactgcctgcggcactacctgcggctggagatcagcgagagccgggtgcccatcagctgcccagaatgttctgagcggctgaacccccatgacatccggctgctgctggccgacccccccctgatgcacaagtatgaggagttcatgctgcggcgctacctggccagtgaccctgactgccgctggtgcccagccccagactgtggctacgccgtcatcgcctacggctgtgccagctgccccaagctgacctgtgagcgggagggctgccagacagagttctgctaccactgcaagcagatctggcaccccaaccagacctgtgacatggcccggcagcagagggcccagaccctgcgggtgaggaccaagcacaccagcggcctgtcctatggccaggagagcggcccagatgacatcaagccctgcccccgctgcagcgcctacatcatcaagatgaatgatggcagctgcaaccacatgacctgtgctgtgtgtggctgtgagttctgctggctgtgcatgaaggagatcagtgacctgcactacctgagccccagcggctgcaccttctggggcaagaagccctggagcaggaagaagaagatcctgtggcagctgggcaccctcatcggggcccctgtgggcatcagcctgattgctggcatcgccatcccagccatggtgattggcatccctgtgtatgtgggcaggaagatccacagccgctatgagggcaggaagaccagcaagcacaagaggaacctggccatcaccggcggcgtgaccctgagcgtcatcgccagccctgtgattgctgctgtgtctgtgggcatcggcgtgcccatcatgctggcctacgtgtatggagtggtgcccatcagcctgtgccggggcggcggctgcggcgtgtccacagccaatggaaaaggagtgaagattgaatttgatgaagatgatggccccatcaccgtggctgatgcctggagggccctgaagaaccccagcatcggggagagcagcattgagggcctgacctctgtgctgagcaccagcggcagccccacagatggcctgtctgtgatgcagggcccctacagcgagacagccagctttgctgccctgagcggcggcaccctgagcggcggcatcctgagcagcggcaagggcaagtacagccggctggaggtgcaggctgatgtgcagaaggagatcttccccaaggacacagccagcctgggcgccatcagtgacaatgccagcacccgggccatggccggcagcatcatcagcagctacaacccccaggaccgggagtgcaacaacatggagatccaggtggacatcgaggccaagcccagccactaccagctggtgtctggcagcagcacagaggacagcctgcacgtgcacgcccagatggctgaaaatgaggaggagggcagcggcggcggcggcagcgaggaggaccccccctgccgccaccagagctgtgagcagaaggactgcctggccagcaagccctgggacatcagcctggcccagcctgagagcatccgcagtgacctggagagcagtgatgcccagagtgatgatgtgcctgacatcaccagtgatgaatgtggcagccccaggagccacacagctgcctgccccagcaccccccgggcccagggcgcccccagccccagcgcccacatgaacctgagcgccctggccgagggccagacagtgctgaagccagagggcggggaggcccgggtgtag

SEQ ID NO: 33897 - DNA, 2940 bp, Artificial Sequence
  Description of Artificial Sequence: Synthetic coding sequence
atgaggggctaccatggagaccggggcagccaccccaggcctgccaggtttgctgaccagcagcacatggatgtgggccctgctgcccgggccccctacctgctgggcagccgggaggccttcagcacagagccccgcttctgtgccccccgggccggcctgggccacatcagccctgagggccccctgagcctgtctgagggccccagcgtgggccctgagggcggccctgctggggccggcgtgggcggcggcagcagcaccttccccaggatgtacccaggccagggcccctttgacacctgtgaggactgtgtgggccacccccagggcaagggggccccccggctgccccccaccctgctggaccagtttgagaagcagctgcctgtgcagcaggacggcttccacaccctgccctaccagaggggccctgctggggccggccctggccctgcccctggcaccggcacagcccctgagcccaggtctgagagccccagccgcatccgccacctggtgcacagcgtgcagaagctgtttgccaagagccacagcctggaggcccctgggaagagggactacaacggccccaaggccgagggccggggcggcagcggcggggacagctacccaggccctggcagcggcggcccccacaccagccaccaccaccaccaccaccaccaccaccaccaccaccagagccgccacggcaagaggagcaagagcaaggacagaaaaggagatggccgccaccaggccaagagcacaggctggtggagcagtgatgacaacctggacagcgacagcggcttcctggccggcggccggcccccaggagagcccggcggccccttctgcctggagggcccagatggcagctacagagacctgtccttcaagggccgcagcggcggcagcgagggccgctgcctggcctgcaccggcatgtccatgagcctggatggccagagcgtgaagaggtctgcctggcacaccatgatggtgtcccagggcagagatggctacccaggagctggccctgggaagggcctgctgggccctgagaccaaggccaaggcccggacctaccactacctgcaggtgccccaggatgactggggcggctaccccaccggcggcaaggatggagagatcccctgcaggaggatgaggagcggcagctacatcaaggccatgggagatgaggagagcggggacagtgatggcagccccaagaccagccccaaggctgtggcccggcgcttcaccaccaggaggagcagctctgtggaccaggcccgcatcaactgctgcgtgcccccacgcatccaccccaggagcagcatccctggctacagccgcagcctgaccaccggccagctgagtgatgagctgaaccagcagctggaggccgtgtgtggctctgtgtttggagagctggagagccaggccgtggatgccctggacctgcccggctgcttcaggatgaggagccacagctacctgcgggccatccaggccggctgcagccaggatgatgactgcctgcccctgctggccaccccagctgctgtgtctggccggcccggcagcagcttcaacttcaggaaggcccccccacccatccccccaggcagccaggccccaccccgcatcagcatcacagcccagagcagcacagacagcgcccacgagagcttcaccgctgctgagggccctgcccggcgctgcagcagcgcagatggcctggatggccctgccatgggcgcccggaccctggagctggcccctgtgcccccccgggccagccccaagccacccaccctcatcatcaagaccatccctggccgggaggagctgcggagcctggcccggcagaggaagtggaggcccagcattggagtgcaggtggagaccatcagtgacagcgacacagagaacagaagccggcgggagttccacagcattggagtgcaggtggaggaggacaagagaagagcccgcttcaagaggagcaacagcgtgacagctggggtgcaggccgacctggagctggagggcctggccggcctggccaccgtggccacagaggacaaggccctgcagtttggccgctccttccagagacatgccagcgagccccagcccggcccccgggcccccacctacagcgtcttcagaacagtgcacacccagggccagtgggcctaccgggagggctaccccctgccctatgagcccccagccacagatggcagccctggccctgccccagcccccaccccaggccctggggccggccggcgggacagctggattgagcggggcagccgcagcctgcctgattctggccgggccagcccctgccccagagatggagagtggttcatcaagatgctgcgggcagaggtggagaagctggagcactggtgccagcagatggagcgggaggctgaagattatgagctgcctgaggagatcctggagaagatccgctctgctgtgggcagcacccagctgctgctgagccagaaggtgcagcagttcttccggctgtgccagcagagcatggaccccacagccttccctgtgcccaccttccaggacctggccggcttctgggacctgctgcagctgagcattgaagatgtgaccctgaagttcctggagctgcagcagctgaaggccaacagctggaagctgctggagcccaaggaggagaagaaggtgcccccacccatccccaagaagcccctgcggggccggggcgtgcctgtgaaggagaggagcctggacagcgtggaccggcagaggcaggaggccaggaagaggctgctggccgccaagagagctgccagcttccgccacagcagcgccacagagagcgctgacagcattgagatctacatccctgaggcccagacccggctgtag

SEQ ID NO: 33898 - DNA, 798 bp, Artificial Sequence
  Description of Artificial Sequence: Synthetic coding sequence
atgtccatgagcctggatggccagagcgtgaagaggtctgcctggcacaccatgatggtgtcccagggcagagatggctacccaggggccggccctgggaagggcctgctgggccctgagaccaaggccaaggcccggacctaccactacctgcaggtgccccaggatgactggggcggctaccccactggaggcaaggatggagagatcccctgcaggaggatgaggagcggcagctacatcaaggccatgggagatgaggagagcggggacagtgatggcagccccaagaccagccccaaggctgtggcccggcgcttcaccacccggcgcagcagctctgtggaccaggcccgcatcaactgctgcgtgcccccacgcatccaccccaggagcagcatccctggctacagccgcagcctgaccaccggccagctgagtgatgagctgaaccagcagatggagcgggaggctgaagattatgagctgcctgaggagatcctggagaagatccgctctgctgtgggcagcacccagctgctgctgagccagaaggtgcagcagttcttccggctgtgccagcagagcatggaccccacagccttccctgtgcccaccttccaggacctggccggcttctgggacctgctgcagctgagcattgaagatgtgaccctgaagttcctggagctgcagcagctgaaggccaacagctggaagctgctggagcccaaggaggagaagaaggtgcccccacccatccccacccggcccccaggccccagccacagcaggtag

SEQ ID NO: 33899 - DNA, 2211 bp, Artificial Sequence
  Description of Artificial Sequence: Synthetic coding sequence
atggccggcagcagcactggaggcggcggcgtgggggagaccaaggtgatctaccacctggatgaggaggagaccccctacctggtgaagatccctgtgcctgctgagcgcatcaccctgggggacttcaagtctgtgctgcagaggcctgctggggccaagtacttcttcaagtccatggaccaggactttggagtggtgaaggaggagatcagtgatgacaatgcccggctgccctgcttcaacggccgggtggtgtcctggctggtgtccagtgacaacccccagcctgagatggcccctcctgtgcatgagcccagggctgagctggcccccccagccccacccctgccccccctgcccccagagaggaccagcggcatcggggacagcaggcctccttccttccaccccaacgtgagcagcagccatgagaacctggagcctgagacagaaacagaatctgtggtgtccctgcggcgggagcggccccggcggcgggacagcagcgagcacggggccggcggccacaggactggaggccccagccggctggagcggcacctggccggctatgagagcagcagcaccctgatgaccagcgagctggagagcaccagcctgggggacagtgatgaggaggacaccatgagccgcttcagcagcagcacagagcagagcagcgccagccggctgctgaagaggcacagaagaagaaggaagcagaggcctccccggctggagaggaccagcagcttcagctctgtgacagacagcaccatgagcctgaacatcatcaccgtgaccctgaacatggagaagtacaacttcctgggcatcagcatcgtgggccagagcaatgaaagaggagatggcggcatctacatcggcagcatcatgaagggcggcgctgtggccgcagatggaagaattgagcccggggacatgctgctgcaggtgaatgacatgaactttgagaacatgagcaatgatgatgctgtgcgggtgctgcgggacatcgtgcacaagccaggccccatcgtgctgactgtggccaagtgctgggaccccagcccccaggcctacttcaccctgcccagaaatgagcccatccagcccatcgaccctgctgcctgggtgagccacagcgctgccctgaccggcaccttccctgcctacccaggcagcagctccatgagcaccatcaccagcggcagcagcctgcctgatggctgtgagggccggggcctgtctgtgcacacagacatggcctctgtgaccaaggccatggccgcccctgagagcggcctggaggtgcgggacaggatgtggctgaagatcaccatccccaatgccttcctgggcagtgatgtggtggactggctgtaccaccacgtggagggcttccctgagcggcgggaggccaggaaatatgccagcggcctgctgaaggccggcctcatccgccacacagtgaacaagatcaccttcagcgagcagtgctactacgtgtttggagacctgagcggcggctgtgagagctacctggtgaacctgagcctgaatgacaatgatggcagcagcggggccagtgaccaggacaccctggcccccctgcccggggccaccccctggcccctgctgcccaccttctcctaccagtacccagccccccacccctacagcccccagcccccaccctaccacgagctgagcagctacacctacggcggcggcagcgccagcagccagcacagcgagggcagccgcagcagcggcagcaccaggagtgatggaggagctggccgcacaggccggcctgaggagcgggcccctgagagcaagagcggcagcggcagcgagagcgagcccagcagccggggcggcagcctgcggcggggcggggaggccagcggcaccagtgatggcggccccccacccagccggggcagcactggaggagcccccaacctgcgggcccaccctggcctgcacccctacggccccccacctggcatggccctgccctacaaccccatgatggtggtgatgatgcctcctcctcctcctcctgtgcccccagctgtgcagcccccaggggcccctcctgtgcgggacctgggctctgtgcccccagagctgacagccagccggcagagcttccacatggccatgggcaaccccagcgagttctttgtggatgtgatgtag

SEQ ID NO: 33900 - DNA, 4575 bp, Artificial Sequence
  Description of Artificial Sequence: Synthetic coding sequence
atggccatgagcaatggaaataatgactttgtggtgctgagcaacagcagcatcgccaccagcgctgccaaccccagccccctgaccccctgtgatggagaccacgccgcccagcagctgacccccaaggaggccaccaggaccaaggtgagccccaacggctgcctgcagctgaatggaacagtgaagagcagcttcctgcccctggacaaccagaggatgccccagatgctgccccagtgctgccacccctgcccctaccaccaccccctgaccagccacagcagccaccaggagtgccaccctgaggccggccctgctgcccccagcgccctggccagctgctgcatgcagccccacagcgagtacagcgccagcctgtgccccaaccacagccctgtgtaccagaccacctgctgcctgcagcccagccccagcttctgcctgcaccacccctggccagaccacttccagcaccagcctgtgcagcagcacatcgccaacatccggcccagccggcccttcaagctgcccaagagctatgctgccctgattgctgactggcctgtggtggtgctgggcatgtgcaccatgttcatcgtggtgtgtgccctggtgggcgtgctggtgcctgagctgcctgacttcagtgaccccctgctgggctttgagccccggggcacagccatcggccagaggctggtgacctggaacaacatggtgaagaacacaggctacaaggccaccctggccaactaccccttcaagtatgcagatgagcaggccaagagccacagagatgaccgctggagcgatgaccactatgagcgggagaagcgggaggtggactggaacttccacaaggacagcttcttctgtgatgtgcccagcgaccgctacagccgggtggtgttcaccagcagcggcggggagaccctgtggaacctgcctgccatcaagtccatgtgcaatgtggacaacagccgcatccgcagccacccccagtttggagacctgtgccagaggaccacagctgccagctgctgccccagctggaccctgggcaactacatcgccatcctgaacaacagaagcagctgccagaagatcgtggagagagatgtgagccacaccctgaagctgctgcggacctgtgccaagcactaccagaatggcaccctgggccctgactgctgggacatggccgcccggaggaaggaccagctgaagtgcaccaacgtgcccaggaagtgcaccaagtacaatgctgtgtaccagatcctgcactacctggtggacaaggacttcatgacccccaagacagctgactatgccaccccagccctgaagtacagcatgctgttcagccccacagagaagggggagagcatgatgaacatctacctggacaactttgagaactggaacagcagtgatggagtgaccaccatcactggaattgaatttggcatcaagcacagcctcttccaggactacctgctgatggacacagtgtacccagccatcgccatcgtgattgtgctgctggtgatgtgtgtgtacaccaagtccatgttcatcaccctgatgaccatgtttgccatcatcagcagcctcatcgtgtcctacttcctgtacagagtggtgttccactttgagttcttccccttcatgaacctgacagccctgatcatcctggtgggcattggagcagatgatgcctttgtgctgtgtgatgtgtggaactacaccaagtttgacaagccccatgctgagaccagcgagaccgtgtccatcaccctgcagcacgccgccctgtccatgtttgtgaccagcttcaccacagctgctgccttctacgccaactacgtgagcaacatcacagccatccgctgctttggagtgtatgccggcacagccatcctggtgaactacgtgctgatggtgacctggctgcctgctgtggtggtgctgcacgagcgctacctgctgaacatcttcacctgcttcaagaagccccagcagcagatctatgacaacaagagctgctggacagtggcctgccagaagtgccacaaggtgctgtttgccatcagcgaggccagccgcatcttctttgagaaggtgctgccctgcatcgtcatcaagttccgctacctgtggctgttctggttcctggccctgactgtgggcggggcctacatcgtgtgcatcaaccccaagatgaagctgcccagcctggagctgtctgagttccaggtgttccgcagcagccacccctttgaaagatatgatgctgagtacaagaagctgttcatgtttgagcgggtgcaccacggggaggagctgcacatgcccatcaccgtcatctggggcgtgtccccagaggacaatggaaaccccctgaaccccaagagcaagggcaagctgaccctggacagcagcttcaacatcgccagccctgccagccaggcctggatcctgcacttctgccagaagctgaggaaccagaccttcttctaccagacagatgagcaggacttcaccagctgcttcatcgagaccttcaagcagtggatggagaaccaggactgtgatgagcccgccctgtacccctgctgcagccactggagcttcccctacaagcaggagatctttgagctgtgcatcaagagggccatcatggagctggagaggagcacaggctaccacctggacagcaagaccccaggccccaggtttgacatcaatgacaccatccgggctgtggtgctggagttccagagcacctacctgttcaccctggcctatgagaagatgcaccagttctacaaggaggtggacagctggatcagcagcgagctgagcagcgcccctgagggcctgagcaatggctggtttgtgagcaacctggagttctatgacctgcaggacagcctgagtgatggcaccctcatcgccatgggcctgtctgtggccgtggccttctctgtgatgctgctgaccacctggaacatcatcatcagcctgtatgccatcatcagcattgctggcaccatctttgtgacagtgggcagcctggtgctgctgggctgggagctgaatgtgctggagagcgtgaccatctctgtggccgtgggcctgtctgtggactttgctgtgcactacggcgtggcctaccgcctggccccagaccctgaccgggagggcaaggtgatcttcagcctgagccgggtgggcagcgccatggccatggccgccctgaccacctttgtggccggggccatgatgatgcccagcacagtgctggcctacacccagctgggcaccttcatgatgctgatcatgtgcatctcctgggcctttgccaccttcttcttccagtgcatgtgccgctgcctgggcccccagggcacctgtggccagatccccctgcccaagaagctgcagtgcagcgccttcagccacgccctgagcaccagccccagcgacaagggccagagcaagacccacaccatcaatgcctaccacctggacccccggggccccaagtctgagctggagcacgagttctatgagctggagcccctggccagccacagctgcacagcccctgagaagaccacctatgaggagacccacatctgcagcgagttcttcaacagccaggccaagaacctgggcatgcctgtgcatgctgcctacaacagcgagctgagcaagagcacagaaagtgatgctggcagcgccctgctgcagccccccctggagcagcacacagtgtgccacttcttcagcctgaaccagcgctgcagctgcccagatgcctacaagcacctgaactacggcccccacagctgccagcagatgggagactgcctgtgccaccagtgcagccccaccaccagcagctttgtgcagatccagaatggagtggcccccctgaaggccacccaccaggccgtggagggctttgtgcaccccatcacccacatccaccactgcccctgcctgcagggccgggtgaagccagctggcatgcagaacagcctgcccaggaacttcttcctgcaccctgtgcagcacatccaggcccaggagaagattggcaagaccaacgtgcacagcctgcagaggagcattgaggagcacctgcccaagatggccgagcccagcagctttgtgtgccgcagcacaggcagcctgctgaagacctgctgtgaccctgagaacaagcagcgggagctgtgcaagaacagagatgtgagcaacctggagagcagcggcggcacagagaacaaggccggcggcaaggtggagctgagcctgagccagacagatgcctctgtgaacagcgagcacttcaaccagaatgagcccaaggtgctcttcaaccacctgatgggagaggccggctgccgcagctgccccaacaacagccagagctgtggccgcatcgtgcgggtgaagtgcaacagcgtggactgccagatgcccaacatggaggccaacgtgcctgctgtgctgacccacagcgagctgtctggagagagcctgctgatcaagaccctgtag

SEQ ID NO: 33901 - DNA, 555 bp, Artificial Sequence
  Description of Artificial Sequence: Synthetic coding sequence
atggccatgagcaatggaaataatgactttgtggtgctgagcaacagcagcatcgccaccagcgctgccaaccccagccccctgaccccctgtgatggagaccacgccgcccagcagctgacccccaaggaggccaccaggaccaaggtgagccccaacggctgcctgcagctgaatggaacagtgaagagcagcttcctgcccctggacaaccagaggatgccccagatgctgccccagtgctgccacccctgcccctaccaccaccccctgaccagccacagcagccaccaggagtgccaccctgaggccggccctgctgcccccagcgccctggccagctgctgcatgcagccccacagcgagtacagcgccagcctgtgccccaaccacagccctgtgtaccagaccacctgctgcctgcagcccagccccagcttctgcctgcaccacccctggccagaccacttccagcaccagcctgtgcagcagcacatcgccaacatccgcttcaccaggaagaccaagtgtgcctcctggctgctgcagatgtag

SEQ ID NO: 33902 - DNA, 4206 bp, Artificial Sequence
  Description of Artificial Sequence: Synthetic coding sequence
atggatggagacagcagcagcagcagcggcggcagcggccctgcccctggccctggccctgagggggagcagaggcctgagggggagcccctggccccagatggcggcagcccagacagcacccagaccaaggctgtgcccccagaggccagccctgagaggagctgcagcctgcacagctgccccctggaggaccccagcagcagcagcggccccccacccaccaccagcaccctgcagcctgtgggccccagcagccccctggccccagcccacttcacctacccccgggccctgcaggagtaccagggcggcagcagcctgcccggcctgggggacagagctgccctgtgcagccacggcagcagcctgagccccagccctgcccccagccagagagatggcacctggaagcccccagctgtgcagcaccacgtggtgtctgtgcggcaggagcgggccttccagatgcccaagagctacagccagctgattgctgagtggcctgtggccgtgctgatgctgtgcctggccgtcatcttcctgtgcaccctggccggcctgctgggcgcccggctgcctgacttcagcaagcccctgctgggctttgagccccgggacacagacatcggcagcaagctggtggtgtggagggccctgcaggccctgaccggccccaggaagctgctcttcctgagcccagacctggagctgaacagcagcagcagccacaacaccctgcggcctgccccccggggcagcgcccaggagagcgctgtgcggcccaggaggatggtggagcccctggaggaccggcggcaggagaacttcttctgtggccccccagagaagagctatgccaagctggtgttcatgagcaccagcagcggcagcctgtggaacctgcacgccatccacagcatgtgcaggatggagcaggaccagatccgcagccacaccagctttggagccctgtgccagaggacagctgccaaccagtgctgccccagctggagcctgggcaactacctggccgtgctgagcaacagaagcagctgcctggacaccacccaggctgatgctgcccggaccctggccctgctgcggacctgtgccctgtactaccacagcggggccctggtgcccagctgcctgggccctggccagaacaagagcccccgctgtgcccaggtgcccaccaagtgcagccagagcagcgccatctaccagctgctgcacttcctgctggaccgggacttcctgagcccccagaccacagactaccaggtgcccagcctgaagtacagcctgctcttcctgcccacccccaagggggccagcctgatggacatctacctggaccggctggccaccccctggggcctggccgacaactacacctctgtgacaggcatggacctgggcctgaagcaggagctgctgcggcacttcctggtgcaggacacagtgtaccccctgctggccctggtggccatcttcttcggcatggccctgtacctgcggagcctcttcctgaccctgatggtgctgctgggcgtgctgggcagcctgctggtggccttcttcctgtaccaggtggccttcaggatggcctacttcccctttgtgaacctggccgccctgctgctgctgagctctgtgtgtgccaaccacaccctcatcttctttgacctgtggaggctgagcaagagccagctgcccagcggcggcctggcccagagggtgggccgcaccatgcaccacttcggctacctgctgctggtgtctggcctgaccaccagcgctgccttctacgccagctacctgagccggctgcctgctgtgcgctgcctggccctcttcatgggcacagctgtgctggtgcacctggccctgaccctggtgtggctgcctgccagcgctgtgctgcacgagcgctacctggcccggggctgtgcccggcgggcccggggccgctgggagggcagcgccccccggcggctgctgctggccctgcaccggcggctgcggggcctgcggcgggctgctgctggcaccagccggctgctcttccagaggctgctgccctgtggggtcatcaagttccgctacatctggatctgctggtttgctgccctggccgccggcggggcctacatcgccggcgtgagcccccggctgcggctgcccaccctgcccccacctgggggccaggtgttccggcccagccacccctttgaaagatttgatgctgagtaccggcagctgttcctgtttgagcagctgccccagggcgagggcggccacatgcctgtggtgctggtgtggggcgtgctgcctgtggacacaggagaccccctggaccccaggagcaacagcagcctggtgcgggaccctgccttcagcgccagcggccctgaggcccagcgctggctgctggccctgtgccaccgggccaggaaccagagcttctttgacaccctgcaggagggctggcccaccctgtgctttgtggagaccctgcagcgctggatggagagccccagctgtgcccggctgggccctgacctgtgctgcggccacagcgacttcccctgggccccccagttcttcctgcactgcctgaagatgatggccctggagcagggcccagatggcacccaggacctgggcctgcgctttgatgcccacggcagcctggccgccctggtgctgcagttccagaccaacttcaggaacagcccagactacaaccagacccagctgttctacaatgaggtgagccactggctggccgctgagctgggcatggcccctcctggcctgcggcggggctggttcaccagccggctggagctgtacagcctgcagcacagcctgagcacagagcctgctgtggtgctgggcctggccctggccctggcctttgccaccctgctgctgggcacctggaatgtgcccctgagcctcttctctgtggccgctgtggccggcaccgtgctgctgactgtgggcctgctggtgctgctggagtggcagctgaacacagctgaggccctcttcctgagcgcctctgtgggcctgtctgtggacttcaccgtgaactactgcatctcctaccacctgtgcccccacccagaccggctgagccgggtggccttcagcctgcggcagaccagctgtgccacagctgtgggcgccgccgccctgtttgctgctggggtgctgatgctgcctgccaccgtgctgctgtacaggaagctgggcatcatcctgatgatggtgaagtgtgtgtcctgtggctttgccagcttcttcttccagagcctgtgctgcttcttcggccctgagaagaactgtggccagatcctgtggccctgtgcccacctgccctgggatgctggcaccggggaccctggaggagagaaggccggccggcccaggcctggctctgtgggcggcatgcctggcagctgcagcgagcagtatgagctgcagcccctggccaggagaagaagccccagctttgacaccagcacagccaccagcaagctgagccaccggcccagcgtgctgtctgaggacctgcagctgcatgatggcccctgctgcagcaggcctcctccagccccagccagcccccgggagctgctgctggaccaccaggccgtgttcagccagtgcccagccctgcagaccagcagcccctacaagcaggccggccccagccccaagacccgggcccggcaggacagccagggcgaggaggccgagcccctgcctgccagccctgaggccccagcccacagccccaaggccaaggctgctgaccccccagatggcttctgcagcagcgccagcaccctggagggcctgtctgtgtctgatgagacctgcctgagcaccagcgagcccagcgcccgggtgcctgacagcgtgggcgtgtccccagatgacctggatgacaccggccagcctgtgctggagcggggccagctgaatggcaagagggacaccctgtggctggccctgcgggagaccgtgtatgaccccagcctgcctgccagccaccacagcagcctgtcctggaagggccggggcggccctggagatggcagccctgtggtgctgcccaacagccagcctgacctgcctgatgtgtggctgcggcggcccagcacccacaccagcggctacagcagctag

SEQ ID NO: 33903 - DNA, 1416 bp, Artificial Sequence
  Description of Artificial Sequence: Synthetic coding sequence
atgggcggcacccaggtgaagtgcctgaccagccccagccccatccacagcgccaagtctgagagcatcatcacccagagcgaggagaaggctgactttgtgatcatcccagctgagggcatcgagaacagaacagagggcacagacagccccctgagccgggactggaggcctggccctggcacctacctggagacctcctgggaggagcagctgctggagcagcaggagtacctggagaaggagatggaggaggccaagaagatgatcagcggcctgcaggccctgctgctgaatggcagcctgcctgaagatgagcaggagcggcccctggccctgtgtgagcccggggtgaaccctgaggagcagctgatcatcatccagagccggctggaccagagcatggaggagaaccaggacctgaagaaggagctgctgaagtgcaagcaggaggccaggaacctgcagggcatcaaggatgccctgcagcagaggctgacccagcaggacacctctgtgctgcagctgaagcaggagctgctgcgggccaacatggacaaggatgagctgcacaaccagaatgtggacctgcagaggaagctggatgagaggaaccggctgctgggggagtacaagaaggagctgggccagaaggaccggctgctgcagcagcaccaggccaagctggaggaggccctgaggaagctgagtgatgtgtcctaccaccaggtggacctggagcgggagctggagcacaaggatgtgctgctggcccactgcatgaagcgggaggctgatgaggccaccaactacaacagccacaacagccagagcaatggcttcctgctgcccacagctgggaagggggccacctctgtgagcaacagaggcaccagtgacctgcagctggtgagagatgccctgcggagcctgaggaacagcttcagcggccatgacccccagcaccacaccatcgacagcctggagcagggcatcagcagcctgatggagcggctgcacgtgatggagacccagaagaagcaggagaggaaggtgcgggtgaagagccccaggacccaggtgggcagcgagtaccgggagagctggccacccaacagcaagctgccccacagccagagcagccccaccgtgagcagcacctgcaccaaggtgctgtacttcacagacaggagcctgacccccttcatggtgaacatccccaagaggctggaggaggtgaccctgaaggacttcaaggccgccatcgaccgggagggcaaccaccgctaccacttcaaggccctggaccctgagtttggaacagtgaaggaggagatcttccatgatgatgatgccatccctggctgggagggcaagatcgtggcctgggtggaggaggaccacggggagaactag

SEQ ID NO: 33904 - DNA, 2049 bp, Artificial Sequence
  Description of Artificial Sequence: Synthetic coding sequence
atgctggcctgcctgacccggggcaacctgctggatgtgctgcaggagggcttcaatgagcagcagctgcaggcctacgtggcctgggtgaatgcccagctgaagaagaggcctgctgtgaagcctgtgcaggacctgcggcaggacctgagagatggagtcatcctggcctacctgattgagatcgtggccggggagaagctgtctggagtgcagctgagccctggcaaccagcaggagatgaagaacaacgtggagaaggtgctgcagtttgtggccagcaagaagatccgcatgcaccagaccagcgccaaggacatcgtggatggcaacctgaagagcatcatgaggctggtgctggccctggccgcccacttcaagccaggcagcagcaggacagtgaaccagggccgggacagccgggcccccctgcagagccaccggccccactgtgccacagctgtggcccagggcgctgctgctgccctggctgatgtgtgccacgacatgagccgcagcggcagagatgtgttccgctaccggcagaggaacagctccatggatgaggagattgagaacccctactggagcgtgcgggccctggtgcagcagtatgagggccagcagaggagccccagcgagagcagctgcagcagcctgaccagccccagccccatccacagcgccaagtctgagagcatcatcacccagagcgaggagaaggctgactttgtgatcatcccagctgagggcattgaaaatagaacagagggcacagacagccccctgagccgggactggaggcctggccctggcacctacctggagacctcctgggaggagcagctgctggagcagcaggagtacctggagaaggagatggaggaggccaagaagatgatcagcggcctgcaggccctgctgctgaatggcagcctgcctgaagatgagcaggagcggcccctggccctgtgtgagcccggggtgaaccctgaggagcagctgatcatcatccagagccggctggaccagagcatggaggagaaccaggacctgaagaaggagctgctgaagtgcaagcaggaggccaggaacctgcagggcatcaaggatgccctgcagcagaggctgacccagcaggacacctctgtgctgcagctgaagcaggagctgctgcgggccaacatggacaaggatgagctgcacaaccagaatgtggacctgcagaggaagctggatgaaagaaaccggctgctgggggagtacaagaaggagctgggccagaaggaccggctgctgcagcagcaccaggccaagctggaggaggccctgaggaagctgagtgatgtgtcctaccaccaggtggacctggagcgggagctggagcacaaggatgtgctgctggcccactgcatgaagcgggaggctgatgaggccaccaactacaacagccacaacagccagagcaatggcttcctgctgcccacagctggaaaaggagccacctctgtgagcaacagaggcaccagtgacctgcagctggtgagagatgccctgcggagcctgagaaattccttcagcggccatgacccccagcaccacaccatcgacagcctggagcagggcatcagcagcctgatggagcggctgcacgtgatggagacccagaagaagcaggagaggaaggtgcgggtgaagagccccaggacccaggtgggcagcgagtaccgggagagctggccacccaacagcaagctgccccacagccagagcagccccaccgtgagcagcacctgcaccaaggtgctgtacttcacagacaggagcctgacccccttcatggtgaacatccccaagaggctggaggaggtgaccctgaaggacttcaaggccgccatcgaccgggagggcaaccaccgctaccacttcaaggccctggaccctgagtttggcaccgtgaaggaggagatcttccatgatgatgatgccatccctggctgggagggcaagatcgtggcctgggtggaggaggaccatggagaaaattag

SEQ ID NO: 33905 - DNA, 660 bp, Artificial Sequence
  Description of Artificial Sequence: Synthetic coding sequence
atgctggcctgcctgacccggggcaacctgctggatgtgctgcaggagggcttcaatgagcagcagctgcaggcctacgtggcctgggtgaatgcccagctgaagaagaggcctgctgtgaagcctgtgcaggacctgcggcaggacctgagagatggagtcatcctggcctacctgattgagatcgtggccggggagaagctgtctggagtgcagctgagccctggcaaccagcaggagatgaagaacaacgtggagaaggtgctgcagtttgtggccagcaagaagatccgcatgcaccagaccagcgccaaggacatcgtggatggcaacctgaagagcatcatgaggctggtgctggccctggccgcccacttcaagccaggcagcagcaggacagtgaaccagggccgggacagccgggcccccctgcagagccaccggccccactgtgccacagctgtggcccagggcgctgctgctgccctggctgatgtgtgccacgacatgagccgcagcggcagagatgtgttccgctaccggcagaggaacagctccatggatgaggagattgagaacccctactggagcgtgcgggccctggtgcagcagtatgagggccagcagaggagccccagcgagagcagctgcagcaggtag

SEQ ID NO: 33906 - DNA, 1140 bp, Artificial Sequence
  Description of Artificial Sequence: Synthetic coding sequence
atggagggcaacagagatgaggccgagaagtgtgtggagatcgcccgggaggccctgaatgccggcaaccgggagaaggcccagcgcttcctgcagaaggccgagaagctgtaccccctgcccagcgcccgggccctgctggagatcatcatgaagaatggcagcacagctggcaacagcccccactgcaggaagcccagcggcagcggggaccagagcaagcccaactgcaccaaggacagcaccagcggcagcggggagggcggcaagggctacaccaaggaccaggtggatggagtgctgagcatcaacaagtgcaagaactactatgaggtgctgggcgtgaccaaggatgctggagatgaggacctgaagaaggcctacaggaagctggccctgaagttccacccagacaagaaccacgcccctggggccacagatgccttcaagaagattggaaatgcctatgctgtgctgagcaaccctgagaagaggaagcagtatgacctgactggaaatgaggagcaggcctgcaaccaccagaacaacggccgcttcaacttccaccggggctgtgaggccgacatcaccccagaagatctcttcaacatcttcttcggcggcggcttccccagcggctctgtgcacagcttcagcaatggccgggccggctacagccagcagcaccagcaccgccacagcggccacgagcgggaggaggagagaggagatggcggcttcagcgtcttcatccagctgatgcccatcatcgtgctgatcctggtgtccctgctgagccagctgatggtgagcaaccccccctacagcctgtaccccaggtctggaacaggccagaccatcaagatgcagacagagaacctgggcgtggtgtactacgtgaacaaggacttcaagaatgagtacaagggcatgctgctgcagaaggtggagaagtctgtggaggaggactatgtgaccaacatccggaacaactgctggaaggagcggcagcagaagacagacatgcagtatgctgccaaggtgtacagagatgaccggctgcggaggaaggcagatgccctgtccatggacaactgcaaggagctggagcggctgaccagcctgtacaagggcggctag

SEQ ID NO: 33907 - DNA, 1014 bp, Artificial Sequence
  Description of Artificial Sequence: Synthetic coding sequence
atgggcaaggactactactgcatcctgggcattgaaaaaggagccagtgatgaggacatcaagaaggcctacaggaagcaggccctgaagttccacccagacaagaacaagagcccccaggccgaggagaagttcaaggaggtggccgaggcctatgaggtgctgagtgaccccaagaagcgggagatctatgaccagtttggagaggagggcctgaagggcggggccggcggcacagatggccagggcggcaccttccgctacaccttccatggagacccccacgccacctttgctgccttcttcggcggcagcaacccctttgagatcttcttcggccgcaggatgggcggcggccgggacagcgaggagatggagattgatggagaccccttcagcgccttcggcttctccatgaatggctacccccgggacaggaacagcgtgggccccagccggctgaagcaggacccccctgtgatccacgagctgcgggtgtccctggaggagatctacagcggctgcaccaagaggatgaagatcagcaggaagaggctgaatgctgatggccgcagctacagaagtgaggacaagatcctgaccatcgagatcaagaagggctggaaggagggcaccaagatcaccttcccccgggagggagatgagacccccaacagcatcccagctgacatcgtgttcatcatcaaggacaaggaccaccccaagttcaagagagatggcagcaacatcatctacacagccaagatcagcctgcgggaggccctgtgtggctgcagcatcaacgtgcccaccctggatggaagaaacatccccatgtctgtgaatgacatcgtgaagccaggcatgagaagacgcatcatcggctacggcctgcccttccccaagaacccagaccagagaggagacctgctgattgaatttgaggtgtccttcccagacaccatcagcagcagcagcaaggaggtgctgaggaagcacctgcctgccagctag

SEQ ID NO: 33908 - DNA, 519 bp, Artificial Sequence
  Description of Artificial Sequence: Synthetic coding sequence
atgggcaaggactactactgcatcctgggcattgaaaaaggagccagtgatgaggacatcaagaaggcctacaggaagcaggccctgaagttccacccagacaagaacaagagcccccaggccgaggagaagttcaaggaggtggccgaggcctatgaggtgctgagtgaccccaagaagcgggagatctatgaccagtttggagaggagggcctgaagggcggggccggcggcacagatggccagggcggcaccttccgctacaccttccatggagacccccacgccacctttgctgccttcttcggcggcagcaacccctttgagatcttcttcggccgcaggatgggcggcggccgggacagcgaggagatggagattgatggagaccccttcagcgccttcggcttctccatgaatggctacccccgggacaggaacagcgtgggccccagccggctgaagcaggacccccctgtgatccacgagctgcgggtgtccctggaggagatctactag

SEQ ID NO: 33909 - DNA, 1083 bp, Artificial Sequence
  Description of Artificial Sequence: Synthetic coding sequence
atgggcgcccccctgctgagccctggctggggcgctggagctgctggaagacgctggtggatgctgctggcccccctgctgcctgccctgctgctggtgcggcctgctggggccctggtggagggcctgtactgcggcacccgggactgctatgaggtgctgggcgtgagccgctctgctgggaaggccgagatcgcccgggcctaccggcagctggcccggcgctaccacccagaccgctaccggccccagcctggagatgagggccctggccgcaccccccagagcgctgaggaggccttcctgctggtggccacagcctatgagaccctgaaggatgaggagaccaggaaggactatgactacatgctggaccaccctgaggagtactacagccactactaccactactacagccggcggctggcccccaaggtggatgtgcgggtggtgatcctggtgtctgtgtgtgccatcagcgtcttccagttcttctcctggtggaacagctacaacaaggccatctcctacctggccaccgtgcccaagtaccgcatccaggccacagaaattgccaagcagcagggcctgctgaagaaggccaaggagaagggcaagaacaagaagagcaaggaggagatcagagatgaggaggagaacatcatcaagaacatcatcaagagcaagattgacatcaagggcggctaccagaagccccagatctgtgacctgctgctcttccagatcatcctggcccccttccacctgtgcagctacatcgtgtggtactgccgctggatctacaacttcaacatcaagggcaaggagtatggagaggaggagcggctgtacatcatcaggaagtccatgaagatgagcaagagccagtttgacagcctggaggaccaccagaaggagaccttcctgaagcgggagctgtggatcaaggaaaattatgaggtgtacaagcaggagcaggaggaggagctgaagaagaagctggccaatgacccccgctggaagcgctaccgccgctggatgaagaatgaaggacctggccgcctgacctttgtggatgactag

SEQ ID NO: 33910 - DNA, 462 bp, Artificial Sequence
  Description of Artificial Sequence: Synthetic coding sequence
atgggcgcccccctgctgagccctggctggggcgctggagctgctggaagacgctggtggatgctgctggcccccctgctgcctgccctgctgctggtgcggcctgctggggccctggtggagggcctgtactgcggcacccgggactgctatgaggtgctgggcgtgagccgctctgctgggaaggccgagatcgcccgggcctaccggcagctggcccggcgctaccacccagaccgctaccggccccagcctggagatgagggccctggccgcaccccccagagcgctgaggaggccttcctgctggtggccacagcctatgagaccctgaaggtgtcccaggccgctgctgagctgcagcagtactgcatgcagaatgcctgcaaggatgccctgctggtgggcgtgcctgctggcagcaaccccttccgggagcccaggagctgtgccctgctgtag

SEQ ID NO: 33911 - DNA, 330 bp, Artificial Sequence
  Description of Artificial Sequence: Synthetic coding sequence
atgacagccccctgcagccagcctgcccagctgcccggccggcggcagctgggcctggtgcccttccccccacctccacccaggacccccctgctgtggctgctgctgctgctgctggccgctgtggccccagcccggggctgggagagcggggacctggagctgtttgacctggtggaggaggtgcagctgaacttctaccagttcctgggcgtgcagcaggatgccagcagcgctgacatcaggaaggcctacaggaagctgagcctgaccctgcacccagacaagaacaaggatgaaaatgctgagacccagttccggcaggtgtag

SEQ ID NO: 33912 - DNA, 1665 bp, Artificial Sequence
  Description of Artificial Sequence: Synthetic coding sequence
atgacagccccctgcagccagcctgcccagctgcccggccggcggcagctgggcctggtgcccttccccccacctccacccaggacccccctgctgtggctgctgctgctgctgctggccgctgtggccccagcccggggctgggagagcggggacctggagctgtttgacctggtggaggaggtgcagctgaacttctaccagttcctgggcgtgcagcaggatgccagcagcgctgacatcaggaaggcctacaggaagctgagcctgaccctgcacccagacaagaacaaggatgaaaatgctgagacccagttccggcagctggtggccatctatgaggtgctgaaggatgatgaaagacggcagagatatgatgacatcctgatcaatggcctgcctgactggaggcagcctgtgttctactaccgccgggtgaggaagatgagcaatgctgagctggccctgctgctcttcatcatcctgactgtgggccactatgctgtggtgtggagcatctacctggagaagcagctggatgagctgctgagcaggaagaagcgggagaagaagaagaagacaggcagcaagtctgtggatgtgtccaagctgggcgccagcgagaagaatgaaaggctgctgatgaagccccagtggcatgacctgctgccctgcaagctgggcatctggttctgcctgaccctgaaggccctgccccacctgatccaggatgctggccagttctacgccaagtacaaggagacccggctgaaggagaaggaggatgccctgaccaggacagagctggagaccctgcagaagcagaagaaggtgaagaagcccaagccagagttccctgtgtacacccccctggagaccacctacatccagagctatgaccacggcaccagcattgaggagattgaggagcagatggatgactggctggagaacagaaacagaacccagaagaagcaggcccctgagtggacagaggaggacctgagccagctgaccaggtccatggtgaagtttcctgggggcaccccaggccgctgggagaagatcgcccacgagctgggccgctctgtgacagatgtgaccaccaaggccaagcagctgaaggacagcgtgacctgcagccctggcatggtgcggctgtctgagctgaagagcacagtgcagaacagccggcccatcaagacagccaccaccctgcctgatgacatgatcacccagagagaagatgctgagggcgtggccgctgaggaggagcaggagggggacagcggggagcaggagactggagccacagatgcccggcccaggaggaggaagccagcccggctgctggaggccacagccaagccagagcctgaggagaagagccgggccaagaggcagaaggactttgatattgctgagcagaatgaaagcagtgatgaggagagcctgaggaaggagcgggcccggtctgctgaggagccctggacccagaaccagcagaagctgctggagctggccctgcagcagtacccccggggcagcagtgaccgctgggacaagatcgcccgctgtgtgcccagcaagagcaaagaagactgcatcgcccgctacaagctgctggtggagctggtgcagaagaagaagcaggccaagagctag

SEQ ID NO: 33913 - DNA, 351 bp, Artificial Sequence
  Description of Artificial Sequence: Synthetic coding sequence
tgaggaagacggcagctgggcctggtgcccttccccccacctccacccaggacccccctgctgtggctgctgctgctgctgctggccgctgtggccccagcccggggctgggagagcggggacctggagctgtttgacctggtggaggaggtgcagctgaacttctaccagttcctgggcgtgcagcaggatgccagcagcgctgacatcaggaaggcctacaggaagctgagcctgaccctgcacccagacaagaacaaggatgaaaatgctgagacccagttccggcagctggtggccatctatgaggtgctgaaggatgatgagcggcggcagaggatgaactactag

SEQ ID NO: 33914 - DNA, 1524 bp, Artificial Sequence
  Description of Artificial Sequence: Synthetic coding sequence
atggccacagccctgtctgaggaggagctggacaatgaagactactacagcctgctgaatgtgcggcgggaggccagcagcgaggagctgaaggccgcctacagaaggctgtgcatgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcgctggggcatccagagcgccatgaacaccagcatcgtgcgggacaccaagaccagccacttcaccgtggccctgcagctgggcatcccccacagctttgccctgatctcctaccagcacaagttccaggatgatgaccagaccagggtgaagggcagcctgaaggccggcttctttggaacagtggtggagtatggagctgagaggaagatcagccgccacagcgtgctgggcgctgctgtgtctgtgggcgtgccccagggcgtgtccctgaaggtgaaggagctggagaagcagcgggagagcgctgccacagatgtgctgcagaagaagcaggaggccgagagcgctgtgcggctgatgcaggagagcgtgcggcgcatcattgaagctgaggagagcaggatgggcctcatcatcgtgaatgcctggtacggcaagtttgtgaatgacaagagcaggaagtctgagaaggtgaaggtgattgatgtgacagtgcccctgcagtgcctggtgaaggacagcaagctgatcctgacagaggccagcaaggccggcctgcccggcttctatgacccctgtgtgggggaggagaagaacctgaaggtgctgtaccagttccggggcgtgctgcaccaggtgatggtgctggacagcgaggccctgcgcatccccaagcagagccacagaattgacacagatggatag

SEQ ID NO: 33915 - DNA, 957 bp, Artificial Sequence
  Description of Artificial Sequence: Synthetic coding sequence
atgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcactgcagcagccccctgctgcaggtgcagaggccccacaggaacacccgggcctgtgcccctgagcccagcttccggcccttcctgcacgtgcccacctgggatgctgaatgttctggggcccggacccccagcacagcctggaccagcgctgctgtgaagctgcgggaggcctgcctgagcggccctggcagcggcagccaccagctgctgctgctgacccccaggagcaagagaagaactggaggcggctag

SEQ ID NO: 33916 - DNA, 1410 bp, Artificial Sequence
  Description of Artificial Sequence: Synthetic coding sequence
atgaaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcgctggggcatccagagcgccatgaacaccagcatcgtgcgggacaccaagaccagccacttcaccgtggccctgcagctgggcatcccccacagctttgccctgatctcctaccagcacaagttccaggatgatgaccagaccagggtgaagggcagcctgaaggccggcttctttggaacagtggtggagtatggagctgagaggaagatcagccgccacagcgtgctgggcgctgctgtgtctgtgggcgtgccccagggcgtgtccctgaaggtgaagctgaacagagccagccagacctacttcttccccatccacctgacagaccagctgctgcccagcgccatgttttatgccaccgtgggccccctggtggtgtactttgccatgcacaggctcatcatcaagccctacctgcgggcccagaaggagaaggagctggagaagcagcgggagagcgctgccacagatgtgctgcagaagaagcaggaggccgagagcgctgtgcggctgatgcaggagagcgtgcggcgcatcattgaagctgaggagagcaggatgggcctcatcatcgtgaatgcctggtacggcaagtttgtgaatgacaagagcaggaagtctgagaaggtgaaggtgattgatgtgacagtgcccctgcagtgcctggtgaaggacagcaagctgatcctgacagaggccagcaaggccggcctgcccggcttctatgacccctgtgtgggggaggagaagaacctgaaggtgctgtaccagttccggggcgtgctgcaccaggtgatggtgctggacagcgaggccctgcgcatccccaagcagagccacagaattgacacagatggatag

SEQ ID NO: 33917 - DNA, 1680 bp, Artificial Sequence
  Description of Artificial Sequence: Synthetic coding sequence
atggccacagccctgtctgaggaggagctggacaatgaagactactacagcctgctgaatgtgcggcgggaggccagcagcgaggagctgaaggccgcctacagaaggctgtgcatgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcgctggggcatccagagcgccatgaacaccagcatcgtgcgggacaccaagaccagccacttcaccgtggccctgcagctgggcatcccccacagctttgccctgatctcctaccagcacaagttccaggatgatgaccagaccagggtgaagggcagcctgaaggccggcttctttggaacagtggtggagtatggagctgagaggaagatcagccgccacagcgtgctgggcgctgctgtgtctgtgggcgtgccccagggcgtgtccctgaaggtgaagctgaacagagccagccagacctacttcttccccatccacctgacagaccagctgctgcccagcgccatgttttatgccaccgtgggccccctggtggtgtactttgccatgcacaggctcatcatcaagccctacctgcgggcccagaaggagaaggagctggagaagcagcgggagagcgctgccacagatgtgctgcagaagaagcaggaggccgagagcgctgtgcggctgatgcaggagagcgtgcggcgcatcattgaagctgaggagagcaggatgggcctcatcatcgtgaatgcctggtacggcaagtttgtgaatgacaagagcaggaagtctgagaaggtgaaggtgattgatgtgacagtgcccctgcagtgcctggtgaaggacagcaagctgatcctgacagaggccagcaaggccggcctgcccggcttctatgacccctgtgtgggggaggagaagaacctgaaggtgctgtaccagttccggggcgtgctgcaccaggtgatggtgctggacagcgaggccctgcgcatccccaagcagagccacagaattgacacagatggatag

SEQ ID NO: 33918 - DNA, 975 bp, Artificial Sequence
  Description of Artificial Sequence: Synthetic coding sequence
atggccacagccctgtctgaggaggagctggacaatgaagactactacagcctgctgaatgtgcggcgggaggccagcagcgaggagctgaaggccgcctacagaaggctgtgcatgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagaggatgacagactgcctgatcatcggcctgattgacatctgccagcgctgcagcccccagcctgccagcgccagctgccgcctgtgctgctgccacgtgaccctgctggagctgtacatccctgtgcccagcaggaccacagctgtgtcctccttccccatctgctttgtgaccaccaactgtgccctgcagttcagcagccggggcatccggcccggcctgaccaccgtgctggccaggaacctggacaagaacacagtgggctacctgcagtggcgctggggcatccagagcgccatgaacaccagcatcgtgcgggacaccaagaccagccacttcacctag

SEQ ID NO: 33919 - DNA, 999 bp, Artificial Sequence
  Description of Artificial Sequence: Synthetic coding sequence
gccagcagcgaggagctgaaggccgcctacagaaggctgtgcatgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcactgcagcagccccctgctgcaggtgcagaggccccacaggaacacccgggcctgtgcccctgagcccagcttccggcccttcctgcacgtgcccacctgggatgctgaatgttctggggcccggacccccagcacagcctggaccagcgctgctgtgaagctgcgggaggcctgcctgagcggccctggcagcggcagccaccagctgctgctgctgacccccaggagcaagagaagaactggaggcggctag

SEQ ID NO: 33920 - DNA, 1566 bp, Artificial Sequence
  Description of Artificial Sequence: Synthetic coding sequence
atgctgtaccacccagacaagcaccgggaccctgagctgaagagccaggccgagcggctcttcaacctggtgcaccaggcctatgaggtgctgagtgacccccagacccgggccatctatgacatctacggcaagaggggcctggagatggagggctgggaggtggtggagaggaggaggaccccagctgagatccgggaggagtttgagcggctgcagcgggagcgggaggagcggcggctgcagcagaggaccaaccccaagggcaccatctctgtgggcgtggatgccacagacctgtttgacagatatgatgaggagtatgaagatgtgtctggcagcagcttcccccagatcgagatcaacaagatgcacatcagccagagcattgaggcccccctgacagccacagacacagccatcctgagcggcagcctgagcacccagaatggaaatggaggcggcagcatcaactttgccctgcggcgggtgaccagcgccaagggctggggcgagctggagtttggagctggggacctgcagggccccctgtttggcctgaagctgttcaggaacctgaccccccgctgctttgtgaccaccaactgtgccctgcagttcagcagccggggcatccggcccggcctgaccaccgtgctggccaggaacctggacaagaacacagtgggctacctgcagtggcgctggggcatccagagcgccatgaacaccagcatcgtgcgggacaccaagaccagccacttcaccgtggccctgcagctgggcatcccccacagctttgccctgatctcctaccagcacaagttccaggatgatgaccagaccagggtgaagggcagcctgaaggccggcttctttggaacagtggtggagtatggagctgagaggaagatcagccgccacagcgtgctgggcgctgctgtgtctgtgggcgtgccccagggcgtgtccctgaaggtgaagctgaacagagccagccagacctacttcttccccatccacctgacagaccagctgctgcccagcgccatgttttatgccaccgtgggccccctggtggtgtactttgccatgcacaggctcatcatcaagccctacctgcgggcccagaaggagaaggagctggagaagcagcgggagagcgctgccacagatgtgctgcagaagaagcaggaggccgagagcgctgtgcggctgatgcaggagagcgtgcggcgcatcattgaagctgaggagagcaggatgggcctcatcatcgtgaatgcctggtacggcaagtttgtgaatgacaagagcaggaagtctgagaaggtgaaggtgattgatgtgacagtgcccctgcagtgcctggtgaaggacagcaagctgatcctgacagaggccagcaaggccggcctgcccggcttctatgacccctgtgtgggggaggagaagaacctgaaggtgctgtaccagttccggggcgtgctgcaccaggtgatggtgctggacagcgaggccctgcgcatccccaagcagagccacagaattgacacagatggatag

SEQ ID NO: 33921 - DNA, 2109 bp, Artificial Sequence
  Description of Artificial Sequence: Synthetic coding sequence
atggcccagaagcaccctggagagcggggcctgtatggagcccaccacagcggcggggccagcctgcggaccctgggccccagcgtggaccctgagatccccagcttcagcggcctgcgggacagcgctggaacagcccccaacggcacccgctgcctgacagagcacagcggccccaagcacacccagcaccccaacccagcccactggctggaccccagccacggccccccaggcggccctggccccccaagagatgctgaggaccctgaccagagcgagaccagcagcgaggaggagagcggcgtggaccaggagctgagcaaagaaaatgaaacaggcaaccagaaggatggcaacagcttcctgagcatccccagcgcctgcaactgccagggcaccccaggcatccctgagggcccctacagcgagggcggcaatggcagcagcagcaacttctgccaccactgcaccagccctgccctgggggaggatgagctggaggaggagtatgatgatgaggagagcctgaagttccccagcgacttcagccgggtgagcagcggcaagaagccacccagccggcggcagaggcaccgcttccccaccaaggaggacacccgggagggcggccggcgggaccccaggagccctggccgccaccggctgggcaggaagaggagccaggccgacaagaggaagggcctgggcctgtggggcgctgaggagctgtgccagctgggccaggccggcttctggtggctgattgagctgctggtgctggtgggggagtatgtggagacctgtggccacctgatctatgcctgccggcagctgaagagcagtgacctggacctcttccgggtgtggatgggcgtgtggacaggccgcctgggcggctgggcccaggtgatgttccagttcctgagccagggcttctactgcggcgtgggcctcttcacccgcttcctgaagctgctgggcgccctgctgctgctggccctggccctcttcctgggcttcctgcagctgggctggaggttcctggtgggcctgggggaccggctgggctggagggacaaggccacctggctgttctcctggctggacagccctgccctgcagcgctgcctgaccctgctgcgggacagccggccctggcagaggctggtgagaattgtgcagtggggctggctggagctgccctgggtgaagcagaacatcaaccggcagggcaatgcccctgtggccagcggccgctactgccagcctgaggaggaggtggcccggctgctgaccatggccggcgtgcctgaagatgagctgaaccccttccacgtgctgggcgtggaggccacagccagtgatgtggagctgaagaaggcctaccggcagctggccgtgatggtgcacccagacaagaaccaccaccccagggctgaggaggccttcaaggtgctgcgggccgcctgggacatcgtgtccaatgctgagaagaggaaggagtatgagatgaagaggatggccgagaatgagctgagccgctctgtgaatgagttcctgagcaagctgcaggatgacctgaaggaggccatgaacaccatgatgtgcagccgctgccagggcaagcacagaagatttgagatggaccgggagcccaagagcgcccgctactgtgccgagtgcaaccggctgcaccctgctgaggagggggacttctgggccgagagctccatgctgggcctgaagatcacctactttgccctgatggatggcaaggtgtatgacatcacagagtgggccggctgccagagggtgggcatcagcccagacacccaccgggtgccctaccacatcagctttggcagccgcatccctggcacccggggccggcagagggccaccccagatgcccctcctgctgacctgcaggacttcctgagccgcatcttccaggtgcccccaggccagatgcccaacggcaacttctttgctgccccccagcctgcccctggagctgctgctgccagcaagcccaacagcacagtgcccaagggggaggccaagcccaagaggaggaagaaggtgagaagacccttccagaggtag

SEQ ID NO: 33922 - DNA, 2109 bp, Artificial Sequence; identical to SEQ ID NO: 33921
  Description of Artificial Sequence: Synthetic coding sequence

SEQ ID NO: 33923 - DNA, 2109 bp, Artificial Sequence; identical to SEQ ID NO: 33921
  Description of Artificial Sequence: Synthetic coding sequence

SEQ ID NO: 33924 - DNA, 1239 bp, Artificial Sequence
  Description of Artificial Sequence: Synthetic coding sequence
atgggcgtgtggacaggccgcctgggcggctgggcccaggtgatgttccagttcctgagccagggcttctactgcggcgtgggcctcttcacccgcttcctgaagctgctgggcgccctgctgctgctggccctggccctcttcctgggcttcctgcagctgggctggaggttcctggtgggcctgggggaccggctgggctggagggacaaggccacctggctgttctcctggctggacagccctgccctgcagcgctgcctgaccctgctgcgggacagccggccctggcagaggctggtgagaattgtgcagtggggctggctggagctgccctgggtgaagcagaacatcaaccggcagggcaatgcccctgtggccagcggccgctactgccagcctgaggaggaggtggcccggctgctgaccatggccggcgtgcctgaagatgagctgaaccccttccacgtgctgggcgtggaggccacagccagtgatgtggagctgaagaaggcctaccggcagctggccgtgatggtgcacccagacaagaaccaccaccccagggctgaggaggccttcaaggtgctgcgggccgcctgggacatcgtgtccaatgctgagaagaggaaggagtatgagatgaagaggatggccgagaatgagctgagccgctctgtgaatgagttcctgagcaagctgcaggatgacctgaaggaggccatgaacaccatgatgtgcagccgctgccagggcaagcacagaagatttgagatggaccgggagcccaagagcgcccgctactgtgccgagtgcaaccggctgcaccctgctgaggagggggacttctgggccgagagctccatgctgggcctgaagatcacctactttgccctgatggatggcaaggtgtatgacatcacagagtgggccggctgccagagggtgggcatcagcccagacacccaccgggtgccctaccacatcagctttggcagccgcatccctggcacccggggccggcagagggccaccccagatgcccctcctgctgacctgcaggacttcctgagccgcatcttccaggtgcccccaggccagatgcccaacggcaacttctttgctgccccccagcctgcccctggagctgctgctgccagcaagcccaacagcacagtgcccaagggggaggccaagcccaagaggaggaagaaggtgagaagacccttccagaggtag

SEQ ID NO: 33925 - DNA, 576 bp, Artificial Sequence
  Description of Artificial Sequence: Synthetic coding sequence
aggaagaggatggccgagaatgagctgagccgctctgtgaatgagttcctgagcaagctgcaggatgacctgaaggaggccatgaacaccatgatgtgcagccgctgccagggcaagcacagaagatttgagatggaccgggagcccaagagcgcccgctactgtgccgagtgcaaccggctgcaccctgctgaggagggggacttctgggccgagagctccatgctgggcctgaagatcacctactttgccctgatggatggcaaggtgtatgacatcacagagtgggccggctgccagagggtgggcatcagcccagacacccaccgggtgccctaccacatcagctttggcagccgcatccctggcacccggggccggcagagggccaccccagatgcccctcctgctgacctgcaggacttcctgagccgcatcttccaggtgcccccaggccagatgcccatgggcaccagcctgcagctgctgagcctgcccctggagcccctgcagcccctgagccccacagcccagtacccccgggagaagcccaacctgagcggcggcaggaagtag

SEQ ID NO: 33926 - DNA, 240 bp, Artificial Sequence
  Description of Artificial Sequence: Synthetic coding sequence
atggcccagaagcaccctggagagcggggcctgtatggagcccaccacagcggcggggccagcctgcggaccctgggccccagcgtggaccctgagatccccagcttcagcggcctgcgggacagcgctggaacagcccccaacggcacccgctgcctgacagagcacagcggccccaagcacacccagcaccccaacccagcccactggctggaccccagccacggccccccaggatag

SEQ ID NO: 33927 - DNA, 456 bp, Artificial Sequence
  Description of Artificial Sequence: Synthetic coding sequence
atggcccagaagcaccctggagagcggggcctgtatggagcccaccacagcggcggggccagcctgcggaccctgggccccagcgtggaccctgagatccccagcttcagcggcctgcgggacagcgctggaacagcccccaacggcacccgctgcctgacagagcacagcggccccaagcacacccagcaccccaacccagcccactggctggaccccagccacggccccccaggcggccctggccccccaagagatgctgaggaccctgaccagagcgagaccagcagcgaggaggagagcggcgtggaccaggagctgagcaaagaaaatgaaacaggcaaccagaaggatggcaacagcttcctgagcatccccagcgcctgcaactgccagggcaccccaggcatccctgagggcccctacagcgagggcggcaatggcagcagcagctag

SEQ ID NO: 33928 - DNA, 453 bp, Artificial Sequence
  Description of Artificial Sequence: Synthetic coding sequence
atggccgcccggggcgtgattgcccctgtgggggagagcctgcgctatgcagagtacctgcagcccagcgccaagaggccagatgctgatgtggaccagcagaggctggtgcgcagcctgattgctgtgggcctgggcgtggccgccctggcctttgctggccgctatgccttccgcatctggaagcccctggagcaggtgatcacagaaacagccaagaagatcagcacccccagcttcagcagctactacaagggcggctttgagcagaagatgagccggcgggaggccggcctcatcctgggcgtgagccccagcgctgggaaggccaagatcagaacagcccacagaagagtgatgatcctgaaccacccagacaagggcggcagcccctacgtggccgccaagatcaatgaggccaaggacctgctggagaccaccaccaagcactag

SEQ ID NO: 33929 - DNA, 1788 bp, Artificial Sequence
  Description of Artificial Sequence: Synthetic coding sequence
atggaggtgaggaagctgagcatctcctggcagttcctgattgtgctggtgctgatcctgcagatcctgagcgccctggactttgacccctacagagtgctgggcgtgtccaggacagccagccaggccgacatcaagaaggcctacaagaagctggcccgggagtggcacccagacaagaacaaggaccccggggctgaggacaagttcatccagatcagcaaggcctatgagatcctgagcaatgaggagaagaggagcaactatgaccagtatggagatgctggggagaaccagggctaccagaagcagcagcagcagcgggagtaccgcttccgccacttccacgagaacttctactttgatgagagcttcttccacttccccttcaacagcgagcggcgggacagcattgatgagaagtacctgctgcacttcagccactacgtgaatgaggtggtgcctgacagcttcaagaagccctacctgatcaagatcaccagtgactggtgcttcagctgcatccacatcgagcctgtgtggaaggaggtgatccaggagctggaggagctgggcgtgggcattggagtggtgcacgccggctatgaaagaaggctggcccaccacctgggcgcccacagcacccccagcatcctgggcatcatcaatggcaagatctccttcttccacaatgctgtggtgcgggagaacctgcggcagtttgtggagagcctgctgcccggcaacctggtggagaaggtgaccaacaagaactacgtgcgcttcctgagcggctggcagcaggagaacaagccccacgtgctgctgtttgaccagacccccatcgtgcccctgctgtacaagctgacagcctttgcctacaaggactacctgagctttggctacgtgtatgtgggcctgcggggcacagaggagatgacccggcgctacaacatcaacatctatgcccccaccctgctggtgttcaaggagcacatcaacagaccagcagatgtgatccaggcccggggcatgaagaagcagatcattgatgacttcatcaccaggaacaagtacctgctggccgcccggctgaccagccagaagctgttccacgagctgtgccctgtgaagaggagccaccggcagaggaagtactgtgtggtgctgctgacagctgagaccaccaagctgagcaagccctttgaggccttcctgagctttgccctggccaacacccaggacacagtgcgctttgtgcacgtgtacagcaaccggcagcaggagtttgctgacaccctgctgcctgacagcgaggccttccagggcaagtctgctgtgtccatcctggagaggaggaacacagctggccgggtggtgtacaagaccctggaggacccctggattggcagcgagagtgacaagttcatcctgctgggctacctggaccagctgaggaaggaccctgccctgctgagcagcgaggccgtgctgcctgacctgacagatgagctggcccctgtgttcctgctgcgctggttctacagcgccagtgactacatcagtgactgctgggacagcatcttccacaacaactggagggagatgatgcccctgctgagcctcatcttcagcgccctcttcatcctgtttggaacagtgattgtgcaggccttcagtgacagcaatgatgagcgggagagcagccccccagagaaggaggaggcccaggagaagacaggcaagacagagcccagcttcaccaaggagaacagccgcttcctgtag

SEQ ID NO: 33930 - DNA, 2349 bp, Artificial Sequence
  Description of Artificial Sequence: Synthetic coding sequence
atggaggtgaggaagctgagcatctcctggcagttcctgattgtgctggtgctgatcctgcagatcctgagcgccctggactttgacccctacagagtgctgggcgtgtccaggacagccagccaggccgacatcaagaaggcctacaagaagctggcccgggagtggcacccagacaagaacaaggaccccggggctgaggacaagttcatccagatcagcaaggcctatgagatcctgagcaatgaggagaagaggagcaactatgaccagtatggagatgctggggagaaccagggctaccagaagcagcagcagcagcgggagtaccgcttccgccacttccacgagaacttctactttgatgagagcttcttccacttccccttcaacagcgagcggcgggacagcattgatgagaagtacctgctgcacttcagccactacgtgaatgaggtggtgcctgacagcttcaagaagccctacctgatcaagatcaccagtgactggtgcttcagctgcatccacatcgagcctgtgtggaaggaggtgatccaggagctggaggagctgggcgtgggcattggagtggtgcacgccggctatgaaagaaggctggcccaccacctgggcgcccacagcacccccagcatcctgggcatcatcaatggcaagatctccttcttccacaatgctgtggtgcgggagaacctgcggcagtttgtggagagcctgctgcccggcaacctggtggagaaggtgaccaacaagaactacgtgcgcttcctgagcggctggcagcaggagaacaagccccacgtgctgctgtttgaccagacccccatcgtgcccctgctgtacaagctgacagcctttgcctacaaggactacctgagctttggctacgtgtatgtgggcctgcggggcacagaggagatgacccggcgctacaacatcaacatctatgcccccaccctgctggtgttcaaggagcacatcaacagaccagcagatgtgatccaggcccggggcatgaagaagcagatcattgatgacttcatcaccaggaacaagtacctgctggccgcccggctgaccagccagaagctgttccacgagctgtgccctgtgaagaggagccaccggcagaggaagtactgtgtggtgctgctgacagctgagaccaccaagctgagcaagccctttgaggccttcctgagctttgccctggccaacacccaggacacagtgcgctttgtgcacgtgtacagcaaccggcagcaggagtttgctgacaccctgctgcctgacagcgaggccttccagggcaagtctgctgtgtccatcctggagaggaggaacacagctggccgggtggtgtacaagaccctggaggacccctggattggcagcgagagtgacaagttcatcctgctgggctacctggaccagctgaggaaggaccctgccctgctgagcagcgaggccgtgctgcctgacctgacagatgagctggcccctgtgttcctgctgcgctggttctacagcgccagtgactacatcagtgactgctgggacagcatcttccacaacaactggagggagatgatgcccctgctgagcctcatcttcagcgccctcttcatcctgtttggaacagtgattgtgcaggccttcagtgacagcaatgatgagcgggagagcagccccccagagaaggaggaggcccaggagaagacaggcaagacagagcccagcttcaccaaggagaacagcagcaagatccccaagaagggctttgtggaggtgacagagctgacagatgtgacctacaccagcaacctggtgcggctgcggcccggccacatgaatgtggtgctgatcctgagcaacagcaccaagaccagcctgctgcagaagtttgccctggaggtgtacaccttcaccggcagcagctgcctgcacttctccttcctgagcctggacaagcaccgggagtggctggagtacctgctggagtttgcccaggatgctgcccccatccccaaccagtatgacaagcacttcatggagcgggactacacaggctacgtgctggccctgaatggccacaagaagtacttctgcctcttcaagccccagaagacagtggaggaggaggaggccatcggcagctgcagtgatgtggacagcagcctgtacctgggggagagccggggcaagcccagctgtggcctgggcagccggcccatcaagggcaagctgagcaagctgagcctgtggatggagcggctgctggagggcagcctgcagcgcttctacatccccagctggccagagctggactag

SEQ ID NO: 33931 - DNA, 1968 bp, Artificial Sequence
  Description of Artificial Sequence: Synthetic coding sequence
atggaggtgaggaagctgagcatctcctggcagttcctgattgtgctggtgctgatcctgcagatcctgagcgccctggactttgacccctacagagtgctgggcgtgtccaggacagccagccaggccgacatcaagaaggcctacaagaagctggcccgggagtggcacccagacaagaacaaggaccccggggctgaggacaagttcatccagatcagcaaggcctatgagatcctgagcaatgaggagaagaggagcaactatgaccagtatggagatgctggggagaaccagggctaccagaagcagcagcagcagcgggagtaccgcttccgccacttccacgagaacttctactttgatgagagcttcttccacttccccttcaacagcgagcggcgggacagcattgatgagaagtacctgctgcacttcagccactacgtgaatgaggtggtgcctgacagcttcaagaagccctacctgatcaagatcaccagtgactggtgcttcagctgcatccacatcgagcctgtgtggaaggaggtgatccaggagctggaggagctgggcgtgggcattggagtggtgcacgccggctatgaaagaaggctggcccaccacctgggcgcccacagcacccccagcatcctgggcatcatcaatggcaagatctccttcttccacaatgctgtggtgcgggagaacctgcggcagtttgtggagagcctgctgcccggcaacctggtggagaaggtgaccaacaagaactacgtgcgcttcctgagcggctggcagcaggagaacaagccccacgtgctgctgtttgaccagacccccatcgtgcccctgctgtacaagctgacagcctttgcctacaaggactacctgagctttggctacgtgtatgtgggcctgcggggcacagaggagatgacccggcgctacaacatcaacatctatgcccccaccctgctggtgttcaaggagcacatcaacagaccagcagatgtgatccaggcccggggcatgaagaagcagatcattgatgacttcatcaccaggaacaagtacctgctggccgcccggctgaccagccagaagctgttccacgagctgtgccctgtgaagaggagccaccggcagaggaagtactgtgtggtgctgctgacagctgagaccaccaagctgagcaagccctttgaggccttcctgagctttgccctggccaacacccaggacacagtgcgctttgtgcacgtgtacagcaaccggcagcaggagtttgctgacaccctgctgcctgacagcgaggccttccagggcaagtctgctgtgtccatcctggagaggaggaacacagctggccgggtggtgtacaagaccctggaggacccctggattggcagcgagagtgacaagttcatcctgctgggctacctggaccagctgaggaaggaccctgccctgctgagcagcgaggccgtgctgcctgacctgacagatgagctggcccctgtgttcctgctgcgctggttctacagcgccagtgactacatcagtgactgctgggacagcatcttccacaacaactggagggagatgatgcccctgctgagcctcatcttcagcgccctcttcatcctgtttggaacagtgattgtgcaggccttcagtgacagcaatgatgagcgggagagcagccccccagagaaggaggaggcccaggagaagacaggcaagacagagcccagcttcaccaaggagaacagcagcaagatccccaagaagggctttgtggaggtgacagagctgacagatgtgacctacaccagcaacctggtgcggctgcggcccggccacatgaatgtggtgctgatcctgagcaacagcaccaagaccagcctgctgcagaagtttgccctggaggtgtacaccttcaccgggaagatcatccgctggtag

SEQ ID NO: 33932 - DNA, 1788 bp, Artificial Sequence; identical to SEQ ID NO: 33929
  Description of Artificial Sequence: Synthetic coding sequence

SEQ ID NO: 33933 - DNA, 1077 bp, Artificial Sequence
  Description of Artificial Sequence: Synthetic coding sequence
atggccgccaccctgggcagcggggagcgctggacagaggcctacattgatgctgtgagaagaaacaagtacccagaggacaccccacctgagagccatgacccctgtggctgctgcaactgcatgaaggcccagaaggagaagaagtcagaaaatgagtggacccagacccggcagggcgagggcaacagcacctacagcgaggagcagctgctgggcgtgcagaggatcaagaagtgcaggaactactatgagatcctgggcgtgtccagagatgccagtgatgaggagctgaagaaggcctacaggaagctggccctgaagttccacccagacaagaactgtgcccctggggccacagatgccttcaaggccatcggaaatgcctttgctgtgctgagcaacccagacaagaggctgcgctatgatgaatatggagatgagcaggtgaccttcaccgccccccgggcccggccctacaactactacagagactttgaggccgacatcaccccagaggagctgttcaacgtgttcttcggcggccacttccccaccggcaacatccacatgttcagcaatgtgacagatgacacctactactacagaagaagacacagacatgagaggacccagacccagaaggaggaggaggaggagaagccccagaccacctacagcgccttcatccagctgctgcctgtgctggtgattgtcatcatcagcgtcatcacccagctgctggccaccaaccccccctacagcctcttctacaagagcaccctgggctacaccatcagccgggagacccagaacctgcaggtgccctactttgtggacaagaactttgacaaggcctacagaggagccagcctgcatgacctggagaagaccatcgagaaggactacatcgactacatccagaccagctgctggaaggagaagcagcagaagtctgagctgaccaacctggccggcctgtacagagatgagcggctgaagcagaaggccgagagcctgaagctggagaactgtgagaagctgagcaagctgattggcctgcggcggggcggctag

SEQ ID NO: 33934 - DNA, 78 bp, Artificial Sequence
  Description of Artificial Sequence: Synthetic coding sequence
atggccgccaccctgggcagcggggagcgctggacagaggcctacattgatgctgtgagaagaaacaagtacccctag

SEQ ID NO: 33935 - DNA, 522 bp, Artificial Sequence
  Description of Artificial Sequence: Synthetic coding sequence
atggccgccaccctgggcagcggggagcgctggacagaggcctacattgatgctgtgagaagaaacaagtacccagaggacaccccacctgagagccatgacccctgtggctgctgcaactgcatgaaggcccagaaggagaagaagtcagaaaatgagtggacccagacccggcagggcgagggcaacagcacctacagcgaggagcagctgctgggcgtgcagaggatcaagaagtgcaggaactactatgagatcctgggcgtgtccagagatgccagtgatgaggagctgaagaaggcctacaggaagctggccctgaagttccacccagacaagaactgtgcccctggggccacagatgccttcaaggccatcggaaatgcctttgctgtgctgagcaacccagacaagaggctgcgctatgatgaatatggagatgagcaggtgaccttcaccgccccccgggcccggccctacaactactacagagactttgaggccgacatcaccccagagtag

SEQ ID NO: 33936 - DNA, 546 bp, Artificial Sequence
  Description of Artificial Sequence: Synthetic coding sequence
atggccgccaccctgggcagcggggagcgctggacagaggcctacattgatgctgtgagaagaaacaagtacccagaggacaccccacctgagagccatgacccctgtggctgctgcaactgcatgaaggcccagaaggagaagaagtcagaaaatgagtggacccagacccggcagggcgagggcaacagcacctacagcgaggagcagctgctgggcgtgcagaggatcaagaagtgcaggaactactatgagatcctgggcgtgtccagagatgccagtgatgaggagctgaagaaggcctacaggaagctggccctgaagttccacccagacaagaactgtgcccctggggccacagatgccttcaaggccatcggaaatgcctttgctgtgctgagcaacccagacaagaggctgcgctatgatgaatatggagatgagcaggtgaccttcaccgccccccgggcccggccctacaactactacagagactttgaggccgacatcaccccagaggagctgttcaacgtgttcttcggctag

SEQ ID NO: 33937 - DNA, 1026 bp, Artificial Sequence
  Description of Artificial Sequence: Synthetic coding sequence
atggccaagggcctgctggtgacctacgccctgtgggccgtgggcggccctgctggcctgcaccacctgtacctgggccgggacagccacgccctgctgtggatgctgaccctgggcggcggcggcctgggctggctgtgggagttctggaagctgcccagctttgtggcccaggccaacagagcccagggccagaggcagagcccccggggcgtgaccccacccctgagccccatccgctttgctgcccaggtgattgtgggcatctacttcggcctggtggccctgatcagcctgagctccatggtgaacttctacatcgtggccctgcccctggccgtgggcctgggcgtgctgctggtggccgctgtgggcaaccagaccagtgacttcaagaacaccctgggcagcgccttcctgaccagccccatcttctacggccggcccatcgccatcctgcccatctctgtggccgccagcatcacagcccagaggcaccggcgctacaaggccctggtggccagcgagcccctgtctgtgcggctgtaccgcctgggcctggcctacctggccttcaccggccccctggcctacagcgccctgtgcaacacagctgccaccctgtcctatgtggccgagaccttcggcagcttcctgaactggttctccttcttccccctgctgggccgcctgatggagtttgtgctgctgctgccctaccgcatctggaggctgctgatgggagagaccggcttcaacagcagctgcttccaggagtgggccaagctgtatgaatttgtgcacagcttccaggatgagaagaggcagctggcctaccaggtgctgggcctgtctgagggcgccaccaatgaggagatccacaggagctaccaggagctggtgaaggtgtggcacccagaccacaacctggaccagacagaggaggcccagaggcacttcctggagatccaggccgcctatgaggtgctgagccagcccaggaagccctggggcagcagaagatag

SEQ ID NO: 33938 - DNA, 1026 bp, Artificial Sequence; identical to SEQ ID NO: 33937
  Description of Artificial Sequence: Synthetic coding sequence

SEQ ID NO: 33939 - DNA, 681 bp, Artificial Sequence
  Description of Artificial Sequence: Synthetic coding sequence
atggccgccatgcgctggcgctggtggcagaggctgctgccctggaggctgctgcaggcccggggcttcccccagaacagcgcccccagcctgggcctgggcgcccggacctacagccagggcgactgcagctacagcaggacagccctgtatgacctgctgggcgtgcccagcacagccacccaggcccagatcaaggccgcctactaccggcagtgcttcctgtaccacccagacaggaacagcggcagcgctgaggccgctgagcgcttcacccgcatcagccaggcctacgtggtgctgggcagcgccaccctgcggaggaaatatgaccggggcctgctgagtgatgaggacctgcggggccctggggtgcggcccagcaggaccccagccccagaccccggcagccccaggaccccaccacccaccagcaggacccatgatggcagccgggccagccctggggccaacagaaccatgttcaactttgatgccttctaccaggcccactacggggagcagctggagcgggagcggcggctgcgggcccggcgggaggccctgaggaagaggcaggagtaccgctccatgaagggcctgcgctgggaggacacccgggacacagctgccatcttcctgatcttcagcatcttcatcatcatcggcttctacatctag

SEQ ID NO: 33940 - DNA, 522 bp, Artificial Sequence
  Description of Artificial Sequence: Synthetic coding sequence
atgcgctggcgctggtggcagaggctgctgccctggaggctgctgcaggcccggggcttcccccagaacagcgcccccagcctgggcctgggcgcccggacctacagccagggcgactgcagctacagcaggacagccctgtatgacctgctgggcgtgcccagcacagccacccaggcccagatcaaggccgcctactaccggcagtgcttcctgtaccacccagacagaaattctggcagcgctgaggccgctgagcgcttcacccgcatcagccaggcctacgtggtgctgggcagcgccaccctgcggaggaaatatgaccggggcctgctgagtgatgaggacctgcggggccctggggtgcggcccagcaggaccccagccccagaccccggcagccccaggaccccaccacccaccagccgctccatgaagggcctgcgctgggaggacacccgggacacagctgccatcttcctgatcttcagcatcttcatcatcatcggcttctacatctag

SEQ ID NO: 33941 - DNA, 726 bp, Artificial Sequence
  Description of Artificial Sequence: Synthetic coding sequence
atgccacccctgctgcccctgcggctgtgccgcctgtggcccagaaatccacccagccggctgctgggcgctgctgctggccagaggagccggcccagcacctactatgagctgctgggcgtgcaccctggggccagcacagaggaggtgaagagggccttcttcagcaagagcaaggagctgcacccagaccgggaccccggcaaccccagcctgcacagcagatttgtggagctgtctgaggcctacagagtgctgagccgggagcagagccgccgctcctatgatgaccagctgcggagcggcagcccccccaagagccccaggaccaccgtgcatgacaagagcgcccaccagacccacagctcctggaccccaccaaatgcccagtactggagccagttccacagcgtgcggccccagggcccccagctgcggcagcagcagcacaagcagaacaagcaggtgctgggctactgcctgctgctgatgctggccggcatgggcctgcactacatcgccttcaggaaggtgaagcagatgcacctgaacttcatggatgagaaggaccgcatcatcacagccttctacaatgaggcccgggcccgggcccgggccaacagaggcatcctgcagcaggagcggcagaggctgggccagaggcagcccccacccagcgagcccacccagggccctgagatcgtgcccagaggagctggcccctag

SEQ ID NO: 33942 - DNA, 537 bp, Artificial Sequence
  Description of Artificial Sequence: Synthetic coding sequence
atgctgaggacagccctgcggggggccccccggctgctgagccgggtgcagccccgggccccctgcctgcggcggctgtggggccgcggggcccggcctgaggtggccggcagaagaagagcctgggcctggggctggaggaggagcagcagcgagcagggccctggccctgctgctgccctgggccgggtggaggccgcccactaccagctggtgtacacctgcaaggtgtgtggcaccaggagcagcaagaggatcagcaagctggcctaccaccagggcgtggtgattgtgacctgccccggctgccagaaccaccacatcatcgctgacaacctgggctggttcagtgacctgaatggcaagagaaatattgaggagatcctgacagcccggggggagcaggtgcaccgggtggccggggagggcgccctggagctggtgctggaggccgccggggcccccaccagcacagctgcccctgaggccggagaagatgagggcccccccagccctgggaagacagagcccagctag

SEQ ID NO: 33943 - DNA, 1617 bp, Artificial Sequence
  Description of Artificial Sequence: Synthetic coding sequence
atgacccgggagtgccccagccctgcccctggccctggggcccccctgagcggctctgtgctggccgaggccgctgtggtgtttgctgtggtgctgagcatccacgccaccgtgtgggaccgctacagctggtgtgctgtggccctggccgtgcaggccttctacgtgcagtacaagtgggaccggctgctgcagcagggcagcgctgtgttccagttcaggatgtctgccaacagcggcctgctgcctgcctccatggtgatgcccctgctgggcctggtgatgaaggagcgctgccagacagctggcaaccccttctttgagcgcttcggcatcgtggtggccgccaccggcatggctgtggccctcttcagctctgtgctggccctgggcatcaccaggcctgtgcccaccaacacctgtgtgatcctgggcctggccggcggcgtcatcatctacatcatgaagcacagcctgtctgtgggggaggtgattgaggtgctggaggtgctgctgatctttgtgtacctgaacatgatcctgctgtacctgctgccccgctgcttcaccccaggagaggccctgctggtgctgggcggcatcagctttgtgctgaaccagctgatcaagaggagcctgaccctggtggagagccagggcgaccctgtggacttcttcctgctggtggtggtggtgggcatggtgctgatgggcatcttcttcagcaccctgtttgtgttcatggacagcggcacctgggccagcagcatcttcttccacctgatgacctgtgtgctgagcctgggcgtggtgctgccctggctgcacaggctcatcagaagaaaccccctgctgtggctgctgcagttcctgttccagacagacacccgcatctacctgctggcctactggagcctgctggccaccctggcctgcctggtggtgctgtaccagaatgccaagaggagcagcagcgagagcaagaagcaccaggcccccaccatcgccaggaagtacttccacctgattgtggtggccacctacatccctggcatcatctttgaccggcccctgctgtatgtggccgccaccgtgtgcctggccgtgttcatcttcctggagtatgtgcgctacttccgcatcaagcccctgggccacaccctgcggagcttcctgagcctcttcctggatgagcgggacagcggccccctcatcctgacccacatctacctgctgctgggcatgagcctgcccatctggctgatcccccggccctgcacccagaagggcagcctgggcggggcccgggccctggtgccctatgctggggtgctggccgtgggcgtgggggacacagtggccagcatcttcggcagcaccatgggagagatccgctggccaggcaccaagaagacctttgagggcaccatgaccagcatctttgcccagatcatctctgtggccctgatcctgatctttgattctggagtggacctgaactacagctatgcctggatcctgggcagcatcagcacagtgtccctgctggaggcctacaccacccagattgacaacctgctgctgcccctgtacctgctgatcctgctgatggcctag

SEQ ID NO: 33944 - DNA, 801 bp, Artificial Sequence
  Description of Artificial Sequence: Synthetic coding sequence
atgacccgggagtgccccagccctgcccctggccctggggcccccctgagcggctctgtgctggccgaggccgctgtggtgtttgctgtggtgctgagcatccacgccaccgtgtgggaccgctacagctggtgtgctgtggccctggccgtgcaggccttctacgtgcagtacaagtgggaccggctgctgcagcagggcagcgctgtgttccagttcaggatgtctgccaacagcggcctgctgcctgcctccatggtgatgcccctgctgggcctggtgatgaaggagcgctgccagacagctggcaaccccttctttgagcgcttcggcatcgtggtggccgccaccggcatggctgtggccctcttcagctctgtgctggccctgggcatcaccaggcctgtgcccaccaacacctgtgtgatcctgggcctggccggcggcgtcatcatctacatcatgaagcacagcctgtctgtgggggaggtgattgaggtgctggaggtgctgctgatctttgtgtacctgaacatgatcctgctgtacctgctgccccgctgcttcaccccaggagaggccctgctggtgctgggcggcatcagctttgtgctgaaccagctgatcaagaggagcctgaccctggtggagagccagggcgaccctgtggacttcttcctgctggtggtggtggtgggcatggtgctgatgggcatcttcttcagcaccctgtttgtgttcatggacagcggcacccggcccccacccagccctgagagcatcagcaccagcctgtggtag

SEQ ID NO: 33945 - DNA, 717 bp, Artificial Sequence
  Description of Artificial Sequence: Synthetic coding sequence
atggctgctgatggccagtgcagcctgcctgcctcctggaggcctgtgaccctgacccacgtggagtacccagctggggacctgagcggccacctgctggcctacctgagcctgagccctgtgtttgtgattgtgggctttgtgaccctcatcatcttcaagcgggagctgcacaccatctccttcctgggcggcctggccctgaatgaaggagtgaactggctgatcaagaatgtcatccaggagccccggccctgtggcggcccccacacagctgtgggcaccaagtatggcatgcccagcagccacagccagttcatgtggttcttctctgtgtacagcttcctgttcctgtacctgaggatgcaccagaccaacaatgcccgcttcctggacctgctgtggaggcatgtgctgagcctgggcctgctggccgtggccttcctggtgtcctacagccgggtgtacctgctgtaccacacctggagccaggtgctgtatggaggcattgctgggggcctgatggccatcgcctggttcatcttcacccaggaggtgctgacccccctcttccccagaattgctgcctggcctgtgtctgagttcttcctgatccgggacaccagcctcatccccaacgtgctgtggtttgagtacacagtgaccagggctgaggccaggaaccggcagaggaagctgggcaccaagctgcagtag

SEQ ID NO: 33946 - DNA, 588 bp, Artificial Sequence
  Description of Artificial Sequence: Synthetic coding sequence
atggctgctgatggccagtgcagcctgcctgcctcctggaggcctgtgaccctgacccacgtggagtacccagctggggacctgagcggccacctgctggcctacctgagcctgagccctgtgtttgtgattgtgggctttgtgaccctcatcatcttcaagcgggagctgcacaccatctccttcctgggcggcctggccctgaatgaaggagtgaactggctgatcaagaatgtcatccaggagccccggccctgtggcggcccccacacagctgtgggcaccaagtatggcatgcccagcagccacagccagttcatgtggttcttctctgtgtacagcttcctgttcctgtacctgaggatgcaccagaccaacaatgcccgcttcctggacctgctgtggaggcatgtgctgagcctgggcctgctggccgtggccttcctggtgtcctacagcaggcctgtgtctgagttcttcctgatccgggacaccagcctcatccccaacgtgctgtggtttgagtacacagtgaccagggctgaggccaggaaccggcagaggaagctgggcaccaagctgcagtag

SEQ ID NO: 33947 - DNA, 294 bp, Artificial Sequence
  Description of Artificial Sequence: Synthetic coding sequence
atgcccagcagccacagccagttcatgtggttcttctctgtgtacagcttcctgttcctgtacctgaggatgcaccagaccaacaatgcccgcttcctggacctgctgtggaggcatgtgctgagcctgggcctgctggccgtggccttcctggtgtcctacagcaggcctgtgtctgagttcttcctgatccgggacaccagcctcatccccaacgtgctgtggtttgagtacacagtgaccagggctgaggccaggaaccggcagaggaagctgggcaccaagctgcagtag

SEQ ID NO: 33948 - DNA, 1227 bp, Artificial Sequence
  Description of Artificial Sequence: Synthetic coding sequence
atgtgggccttcagcgagctgcccatgcccctgctgatcaacctgattgtgtccctgctgggctttgtggccaccgtgaccctcatcccagccttccggggccacttcatcgccgcccggctgtgtggccaggacctgaacaagaccagccggcagcagatccctgagagccagggcgtcatcagcggggctgtgttcctgatcatcctcttctgcttcatccccttccccttcctgaactgctttgtgaaggagcagtgcaaggccttcccccaccatgaatttgtggccctgattggagccctgctggccatctgctgcatgatcttcctgggctttgctgatgatgtgctgaacctgcgctggaggcacaagctgctgctgcccacagctgccagcctgcccctgctgatggtgtacttcaccaactttggaaacaccaccatcgtggtgcccaagcccttccggcccatcctgggcctgcacctggacctgggcatcctgtactacgtgtacatgggcctgctggccgtgttctgcaccaatgccatcaacatcctggccggcatcaatggcctggaggccggccagagcctggtgatcagcgccagcatcatcgtgttcaacctggtggagctggagggggactgcagagatgaccacgtgttcagcctgtacttcatgatccccttcttcttcaccaccctgggcctgctgtaccacaactggtaccccagccgggtgtttgtgggggacaccttctgctactttgctggcatgacctttgctgtggtgggcatcctgggccacttcagcaagaccatgctgctcttcttcatgccccaggtgttcaacttcctgtacagcctgccccagctgctgcacatcatcccctgccccaggcaccgcatcccccggctgaacatcaagacaggcaagctggagatgagctacagcaagttcaagaccaagagcctgtccttcctgggcaccttcatcctgaaggtggccgagagcctgcagctggtgacagtgcaccagagcgagacagaagatggagagttcacagagtgcaacaacatgaccctcatcaacctgctgctgaaggtgctgggccccatccatgaaagaaacctgaccctgctgctgctgctgctgcagatcctgggcagcgccatcaccttcagcatccgctaccagctggtgcggctcttctatgatgtgtag

SEQ ID NO: 33949 - DNA, 1227 bp, Artificial Sequence; identical to SEQ ID NO: 33948
  Description of Artificial Sequence: Synthetic coding sequence

SEQ ID NO: 33950 - DNA, 984 bp, Artificial Sequence
  Description of Artificial Sequence: Synthetic coding sequence
atgatcttcctgggctttgctgatgatgtgctgaacctgcgctggaggcacaagctgctgctgcccacagctgccagcctgcccctgctgatggtgtacttcaccaactttggaaacaccaccatcgtggtgcccaagcccttccggcccatcctgggcctgcacctggacctgggcatcctgtactacgtgtacatgggcctgctggccgtgttctgcaccaatgccatcaacatcctggccggcatcaatggcctggaggccggccagagcctggtgatcagcgccagcatcatcgtgttcaacctggtggagctggagggggactgcagagatgaccacgtgttcagcctgtacttcatgatccccttcttcttcaccaccctgggcctgctgtaccacaactggtaccccagccgggtgtttgtgggggacaccttctgctactttgctggcatgacctttgctgtggtgggcatcctgggccacttcagcaagaccatgctgctcttcttcatgccccaggtgttcaacttcctgtacagcctgccccagctgctgcacatcatcccctgccccaggcaccgcatcccccggctgaacatcaagacaggcaagctggagatgagctacagcaagttcaagaccaagagcctgtccttcctgggcaccttcatcctgaaggtggccgagagcctgcagctggtgacagtgcaccagagcgagacagaagatggagagttcacagagtgcaacaacatgaccctcatcaacctgctgctgaaggtgctgggccccatccacgagaggaacctgaccctgctgctgctgctgctgcaggtgaggatgggcatcgagttcatccccccctgcctgcccttctgtgtgatcctgacccctgtgcacttcagcctgcagatcctgggcagcgccatcaccttcagcatccgctaccagctggtgcggctcttctatgatgtgtag

SEQ ID NO: 33951 - DNA, 255 bp, Artificial Sequence
  Description of Artificial Sequence: Synthetic coding sequence
atggccactggaacagaccaggtggtgggcctgggcctggtggccgtgtccctcatcatcttcacctactacacagcctgggtgatcctgctgcccttcatcgacagccagcacgtgatccacaagtacttcctgccccgggcctatgctgtggccatccccctggccgccggcctgctgctgctgctgtttgtgggcctcttcatctcctatgtgatgctgaagaccaagagggtgaccaagaaggcccagtag

SEQ ID NO: 33952 - DNA, 393 bp, Artificial Sequence
  Description of Artificial Sequence: Synthetic coding sequence
atggccactggaacagaccaggtggtgggcctgggcctggtggccgtgtccctcatcatcttcacctactacacagcctgggtgatcctgctgcccttcatcgacagccagcacgtgatccacaagtacttcctgccccgggcctatgctgtggccatccccctggccgccggcctgctgctgctgctgtttgtgggcaagagcagccccccacccctggaccccggccagggctttgggaagaccccacccctgaacatgctgccccactttggaggagctggcagctgcctgcccaggacccacccctggggcttccctgtgcaccccagccggctgcctgtgagcaacctgtgggtgtcctggtgcccccggctgtttggcctgcagtag

SEQ ID NO: 33953 - DNA, 7110 bp, Artificial Sequence
  Description of Artificial Sequence: Synthetic coding sequence
atgaacacagaggagctggagctgctgagtgacagcaagtacagaaattatgtggccgccatcgacaaggccctgaagaactttgagtacagcagcgagtgggccgacctgatcagcgccctgggcaagctgaacaaggtgctgcagaacaatgccaagtaccaggtggtgcccaagaagctgaccatcggcaagaggctggcccagtgcctgcacccagccctgcccggcggcgtgcacaggaaggccctggagacctatgagatcatcttcaagatcatcggccccaagaggctggccaaggacctcttcctgtacagcagcggcctcttccccctgctggccaatgctgccatgtctgtgaagcccaccctgctgagcctgtatgagatctactacctgcccctgggcaagaccctgaagccaggcctgcagggcctgctgaccggcatcctgcccggcctggaggagggcagcgagtactatgaaagaaccaacatgctgctggagaaggtggccgctgctgtggaccagagcgccttctacagcgccctgtggggcagcctgctgaccagccctgctgtgcggctgcccggcatcacctacgtgctggcccacctgaacaggaagctgtccatggaggaccagctgtacatcatcggcagtgacatcgagctgatggtggaggccgtgtccacctctgtgcaggacagctctgtgctggtgcagaggagcaccctggacctgatcctcttctgcttccccttccacatgagccaggccaccaggccagacatgatccgcatcctgtctgctgccctgcacgtggtgctgcggcgggacatgagcctgaacagaaggctgtatgcctggctgctgggccccaggagcaccaggcacagcaaccctgaggagcacgccacctactacttcaccaccttcagcaaggagctgctggtgcaggccatggtgggcatcctgcaggtgaatggatttggagaggagaacaccctgatgcaggacctgaagcccttccgcatcctgatcagcctgctggacaagccagagctgggccctgtgatcctggaggatgtgctgattgaggtgttccgcaccctgtacagccagtgcaaggccgagctggacctgcagacagagccccccttcagcaaggaccacgcccagctgagcagcaagctgcgggagaacaagaagacagctgagctgatcaagacagccaacctgctcttcaacagctttgagccctactacatgtgggactatgtggcccgctggtttgaggagtgctgcaggaggaccctgcacgtgcggctgcagatcggccctggggacagcaatgacagcagcgagctgcagctgaccaacttctgcctgctggtggacttcctgctggacatcgtgtccctggagacctacatcgagatccagacagagcacctgccccagctgctgctgaggatgatcagcgccctgaccagccacctgcagaccctgcacctgtctgagctgacagacagcctgcggctgtgcagcaagatcctgagcaaggtgcagccccccctgctgagcgccagcactggaggagtgctgcagttccccagcggccagaacaacagcgtgaaggagtgggaggacaagaaggtgtcctctgtgtcccatgagaaccccacagaggtgtttgaagatggagaaaatccacccagcagccgcagcagcgagagcggcttcacagagttcatccagtaccaggccgacagaacagatgacatcgaccgggagctgtctgagggccagggcgccgccgccatccccatcggcagcaccagcagcgagacagaaacagccagcacagtgggcagcgaggagaccatcatccagacccccagcgtggtgacccagggcacagccaccaggagcaggaagacagcccagaagacagccatgcagtgctgcctggagtatgtgcagcagttcctgaccaggctcatcaacctgtacatcatccagaacaacagcttcagccagagcctggccacagagcaccagggcgacctgggccgggagcagggcgagaccagcaagtgggacaggaacagccagggagatgtgaaggagaagaacatcagcaagcagaagaccagcaaggagtacctgagcgccttcctggccgcctgccagctgttcctggagtgcagcagcttccctgtgtacatcgccgagggcaaccacaccagcgagctgcggtctgagaagctggagacagactgtgaacatgtgcagcccccccagtggctgcagaccctgatgaatgcctgcagccaggccagtgacttctctgtgcagagcgtggccatcagcctggtgatggacctggtgggcctgacccagagcgtggccatggtgactggagagaacatcaacagcgtggagcccgcccagcccctgagccccaaccagggccgggtggccgtggtgatccggccccccctgacccagggcaacctgcgctacatcgccgagaagacagagttcttcaagcacgtggccctgaccctgtgggaccagctgggagatggcaccccccagcaccaccagaagtctgtggagctgttctaccagctgcacaacctggtgcccagcagcagcatctgtgaagatgtgatcagccagcagctgacccacaaggacaagaagatccgcatggaggcccacgccaagtttgctgtgctgtggcacctgacccgggacctgcacatcaacaagagcagcagctttgtgcgcagctttgacaggagcctcttcatcatgctggacagcctgaacagcctggatggcagcaccagctctgtgggccaggcctggctgaaccaggtgctgcagagacatgacatcgcccgggtgctggagcccctgctgctgctgctgctgcaccccaagacccagagggtgtctgtgcagagggtgcaggccgagcgctactggaacaagagcccctgctacccaggagaggagagtgacaagcacttcatgcagaactttgcctgcagcaatgtgtcccaggtgcagctgatcaccagcaaaggaaatggagagaagcccctgaccatggatgaaattgagaacttcagcctgactgtgaaccccctgagtgaccggctgagcctgctgagcaccagcagcgagaccatccccatggtggtgtctgactttgacctgcctgaccagcagatcgagatcctgcagagcagtgacagcggctgcagccagagcagcgctggggacaacctgtcctatgaggtggaccctgagaccgtgaatgcccaggaggacagccagatgcccaaggagagcagcccagatgatgatgtgcagcaggtggtgtttgacctgatctgcaaggtggtgtctggcctggaggtggagagcgcctctgtgaccagccagctggagattgaggccatgccacccaagtgcagcgacatcgaccctgatgaggagaccatcaagattgaagatgacagcatccagcagagccagaatgccctgctgagcaatgaaagcagccagttcctgtctgtgtctgctgagggcggccatgaatgtgtggccaacggcatcagcaggaacagcagcagcccctgcatcagcggcaccacccacaccctgcatgacagctctgtggccagcattgagaccaagagccggcagaggagccacagcagcatccagttctccttcaaggagaagctgtctgagaaggtgtctgagaaggagaccatcgtgaaggagagcggcaagcagcccggggccaagcccaaggtgaagctggccaggaagaaggatgatgacaagaagaagagcagcaatgagaagctgaagcagacctctgtgttcttcagtgatggcctggacctggagaactggtacagctgtggggagggggacatcagcgagattgaaagtgacatgggcagccctggcagcaggaagagccccaacttcaacatccaccccctgtaccagcacgtgctgctgtacctgcagctgtatgacagcagcaggaccctgtatgccttcagcgccatcaaggccatcctgaagaccaaccccatcgcctttgtgaatgccatcagcaccacctctgtgaacaatgcctacaccccccagctgagcctgctgcagaacctgctggcccggcaccgcatctctgtgatgggcaaggacttctacagccacatccctgtggacagcaaccacaacttccgcagctccatgtacatcgagatcctgatcagcctgtgcctgtactacatgaggagccactaccccacccacgtgaaggtgacagcccaggacctgattggcaacagaaacatgcagatgatgagcattgagatcctgaccctgctcttcacagagctggccaaggtgattgagagcagcgccaagggcttccccagcttcatcagtgacatgctgagcaagtgcaaggtgcagaaggtgatcctgcactgcctgctgagcagcatcttcagcgcccagaagtggcacagcgagaagatggccggcaagaacctggtggccgtggaggagggcttcagcgaggacagcctcatcaacttctctgaagatgaatttgacaatggcagcaccctgcagagccagctgctgaaggtgctgcagaggctgattgtgctggagcaccgggtgatgaccatcccagaagaaaatgagaccggctttgattttgtggtgtctgacctggagcacatcagcccccaccagcccatgaccagcctgcagtacctgcacgcccagcccatcacctgccagggcatgttcctgtgtgccgtcatccgggccctgcaccagcactgtgcctgcaagatgcacccccagtggattggcctcatcaccagcaccctgccctacatgggcaaggtgctgcagagggtggtggtgtctgtgaccctgcagctgtgcaggaacctggacaacctgatccagcagtacaagtatgagaccggcctgagtgacagccggcccctgtggatggccagcatcatccccccagacatgatcctgaccctgctggagggcatcacagccatcatccactactgcctgctggaccccaccacccagtaccaccagctgctggtgtctgtggaccagaagcacctgtttgaggcccggagcggcatcctgagcatcctgcacatgatcatgagctctgtgaccctgctgtggagcatcctgcaccaggccgacagcagcgagaagatgaccatcgccgccagcgccagcctgaccaccatcaacctgggcgccaccaagaacctgcggcagcagatcctggagctgctgggccccatctccatgaaccacggcgtgcacttcatggccgccatcgcctttgtgtggaatgaaagacggcagaacaagaccaccaccaggaccaaggtgatcccagctgccagcgaggagcagctgctgctggtggagctggtgcgcagcatctctgtgatgagagctgagaccgtcatccagacagtgaaggaggtgctgaagcagcccccagccatcgccaaggacaagaagcacctgagcctggaggtgtgcatgctgcagttcttctacgcctacatccagagggtgctgaatgagttcatcatgaagaaccccagcctggagaacaagaaggaccagagggacctgcaggatgtgacccacaagatcgtggatgccatcggggccatcgccggcagcagcctggagcagaccacctggctgcggaggaacctggaggtgaagcccagccccaagatcatggtggatggcaccaacctggagagtgatgtggagggcatcctggtgaagcacctgggcctgctgtctgtgctggcccacctgctggacatggtgttctacagtgatgagaaggagagggtcatccccctgctggtgaacatcatgcactacgtggtgccctacctgaggaaccacagcgcccacaatgcccccagctaccgggcctgtgtgcagctgctgagcagcctgagcggctaccagtacacccggcgggcctggaagaaggaggcctttgacctcttcatggaccccagcttcttccagatggatgccagctgtgtgaaccactggagggccatcatggacaacctgatgacccatgacaagaccaccttccgggacctgatgaccagggtggccgtggcccagagcagcagcctgaacctgtttgccaacagagatgtggagctggagcagagggccatgctgctgaagaggctggcctttgccatcttcagcagcgagattgaccagtaccagaagtacctgcctgacatccagggcatccctgtgtccaagtgggtgcagctgctgacagccctgagccctgcctaccgcaccagcggccccagcgtggccggcctggagaccacctacacaggaggaaatggcttcagcaccagctacaacagccagcgctggctgaacctgtacctgagcgcctgcaagttcctggacctggccctggccctgcccagcgagaacctgccccagttccagatgtaccgctgggccttcatccctgaggccagtgatgacagcggcctggaggtgcggcggcagggcatccaccagcgggagttcaagccctacgtggtgcggctggccaagctgctgaggaagagggccaaggacaaggaggaggacttcaagacagtcatcctggagggcctggagatggccaagcaccagaagaaccctgaggaggacaacagcggccgcaccctgggctgggagcccggccacctgctgctgaccatctgcaccgtgcgctccatggagcagctgctgcccttcttcaacgtgctgagccaggtgttcaacagcaaggtgaccagccgctgtggcggccacagcggcagccccatcctgtacagcaatgccttccccaacaaggacatgaagctggagaaccacaagccctgcagcagcaaggcccggcagaagattgaggagatggtggagaaggacttcctggagggcatgatcaagacctag

SEQ ID NO: 33954 - DNA, 7398 bp, Artificial Sequence
  Description of Artificial Sequence: Synthetic coding sequence
atgaacacagaggagctggagctgctgagtgacagcaagtacagaaattatgtggccgccatcgacaaggccctgaagaactttgagtacagcagcgagtgggccgacctgatcagcgccctgggcaagctgaacaaggtgctgcagaacaatgccaagtaccaggtggtgcccaagaagctgaccatcggcaagaggctggcccagtgcctgcacccagccctgcccggcggcgtgcacaggaaggccctggagacctatgagatcatcttcaagatcatcggccccaagaggctggccaaggacctcttcctgtacagcagcggcctcttccccctgctggccaatgctgccatgtctgtgaagcccaccctgctgagcctgtatgagatctactacctgcccctgggcaagaccctgaagccaggcctgcagggcctgctgaccggcatcctgcccggcctggaggagggcagcgagtactatgaaagaaccaacatgctgctggagaaggtggccgctgctgtggaccagagcgccttctacagcgccctgtggggcagcctgctgaccagccctgctgtgcggctgcccggcatcacctacgtgctggcccacctgaacaggaagctgtccatggaggaccagctgtacatcatcggcagtgacatcgagctgatggtggaggccgtgtccacctctgtgcaggacagctctgtgctggtgcagaggagcaccctggacctgatcctcttctgcttccccttccacatgagccaggccaccaggccagacatgatccgcatcctgtctgctgccctgcacgtggtgctgcggcgggacatgagcctgaacagaaggctgtatgcctggctgctgggctttgacaacaacggggccatcatcggccccaggagcaccaggcacagcaaccctgaggagcacgccacctactacttcaccaccttcagcaaggagctgctggtgcaggccatggtgggcatcctgcaggtgaatggatttggagaggagaacaccctgatgcaggacctgaagcccttccgcatcctgatcagcctgctggacaagccagagctgggccctgtgatcctggaggatgtgctgattgaggtgttccgcaccctgtacagccagtgcaaggccgagctggacctgcagacagagccccccttcagcaaggaccacgcccagctgagcagcaagctgcgggagaacaagaagacagctgagctgatcaagacagccaacctgctcttcaacagctttgagccctactacatgtgggactatgtggcccgctggtttgaggagtgctgcaggaggaccctgcacgtgcggctgcagatcggccctggggacagcaatgacagcagcgagctgcagctgaccaacttctgcctgctggtggacttcctgctggacatcgtgtccctgcccaccaggtccatgagggtgctgtgccaggagacctacatcgagatccagacagagcacctgccccagctgctgctgaggatgatcagcgccctgaccagccacctgcagaccctgcacctgtctgagctgacagacagcctgcggctgtgcagcaagatcctgagcaaggtgcagccccccctgctgagcgccagcactggaggagtgctgcagttccccagcggccagaacaacagcgtgaaggagtgggaggacaagaaggtgtcctctgtgtcccatgagaaccccacagaggtgtttgaagatggagagaacccccccagcagccgcagcagcgagagcggcttcacagagttcatccagtaccaggccgacagaacagatgacatcgaccgggagctgtctgagggccagggcgctgctgccatccccatcggcagcaccagcagcgagacagaaacagccagcacagtgggcagcgaggagaccatcatccagaccccatctgtggtgacccagggcacagccaccaggagcaggaagacagcccagaagacagccatgcagtgctgcctggagtatgtgcagcagttcctgaccaggctcatcaacctgtacatcatccagaacaacagcttcagccagagcctggccacagagcaccagggcgacctgggccgggagcagggcgagaccagcaagtgggacaggaacagccagggagatgtgaaggagaagaacatcagcaagcagaagaccagcaaggagtacctgagcgccttcctggccgcctgccagctgttcctggagtgcagcagcttccctgtgtacatcgccgagggcaaccacaccagcgagctgcggtctgagaagctggagacagactgtgagcacgtgcagcccccccagtggctgcagaccctgatgaatgcctgcagccaggccagtgacttctctgtgcagagcgtggccatcagcctggtgatggacctggtgggcctgacccagagcgtggccatggtgactggagagaacatcaacagcgtggagcccgcccagcccctgagccccaaccagggccgggtggccgtggtgatccggccccccctgacccagggcaacctgcgctacatcgccgagaagacagagttcttcaagcacgtggccctgaccctgtgggaccagctgggagatggcaccccccagcaccaccagaagtctgtggagctgttctaccagctgcacaacctggtgcccagcagcagcatctgtgaagatgtgatcagccagcagctgacccacaaggacaagaagatccgcatggaggcccacgccaagtttgctgtgctgtggcacctgacccgggacctgcacatcaacaagagcagcagctttgtgcgcagctttgacaggagcctcttcatcatgctggacagcctgaacagcctggatggcagcaccagctctgtgggccaggcctggctgaaccaggtgctgcagagacatgacatcgcccgggtgctggagcccctgctgctgctgctgctgcaccccaagacccagagggtgtctgtgcagagggtgcaggccgagcgctactggaacaagagcccctgctacccaggagaggagagtgacaagcacttcatgcagaactttgcctgcagcaatgtgtcccaggtgcagctgatcaccagcaaaggaaatggagagaagcccctgaccatggatgaaattgagaacttcagcctgactgtgaaccccctgagtgaccggctgagcctgctgagcaccagcagcgagaccatccccatggtggtgtctgactttgacctgcctgaccagcagatcgagatcctgcagagcagtgacagcggctgcagccagagcagcgctggggacaacctgtcctatgaggtggaccctgagaccgtgaatgcccaggaggacagccagatgcccaaggagagcagcccagatgatgatgtgcagcaggtggtgtttgacctgatctgcaaggtggtgtctggcctggaggtggagagcgcctctgtgaccagccagctggagattgaggccatgccacccaagtgcagcgacattgatcctgatgaggagaccatcaagattgaagatgacagcatccagcagagccagaatgccctgctgagcaatgaaagcagccagttcctgtctgtgtctgctgagggcggccatgaatgtgtggccaacggcatcagcaggaacagcagcagcccctgcatcagcggcaccacccacaccctgcatgacagctctgtggccagcattgagaccaagagccggcagaggagccacagcagcatccagttctccttcaaggagaagctgtctgagaaggtgtctgagaaggagaccatcgtgaaggagagcggcaagcagcccggggccaagcccaaggtgaagctggccaggaagaaggatgatgacaagaagaagagcagcaatgagaagctgaagcagaccagcgtcttcttcagtgatggcctggacctggagaactggtacagctgtggggagggggacatcagcgagattgaaagtgacatgggcagccctggcagcaggaagagccccaacttcaacatccaccccctgtaccagcacgtgctgctgtacctgcagctgtatgacagcagcaggaccctgtatgccttcagcgccatcaaggccatcctgaagaccaaccccatcgcctttgtgaatgccatcagcaccacctctgtgaacaatgcctacaccccccagctgagcctgctgcagaacctgctggcccggcaccgcatctctgtgatgggcaaggacttctacagccacatccctgtggacagcaaccacaacttccgcagctccatgtacatcgagatcctgatcagcctgtgcctgtactacatgaggagccactaccccacccacgtgaaggtgacagcccaggacctgattggcaacagaaacatgcagatgatgagcattgagatcctgaccctgctcttcacagagctggccaaggtgattgagagcagcgccaagggcttccccagcttcatcagtgacatgctgagcaagtgcaaggtgcagaaggtgatcctgcactgcctgctgagcagcatcttcagcgcccagaagtggcacagcgagaagatggccggcaagaacctggtggccgtggaggagggcttcagcgaggacagcctcatcaacttctctgaagatgaatttgacaatggcagcaccctgcagagccagctgctgaaggtgctgcagaggctcatcgtgctggagcaccgggtgatgaccatccctgaggagaatgaaacaggctttgattttgtggtgtctgacctggagcacatcagcccccaccagcccatgaccagcctgcagtacctgcacgcccagcccatcacctgccagggcatgttcctgtgtgctgtgatccgggccctgcaccagcactgtgcctgcaagatgcacccccagtggattggcctcatcaccagcaccctgccctacatgggcaaggtgctgcagagggtggtggtgtctgtgaccctgcagctgtgcaggaacctggacaacctgatccagcagtacaagtatgaaacaggcctgagtgacagccggcccctgtggatggccagcatcatccccccagacatgatcctgaccctgctggagggcatcacagccatcatccactactgcctgctggaccccaccacccagtaccaccagctgctggtgtctgtggaccagaagcacctgtttgaggcccggagcggcatcctgagcatcctgcacatgatcatgagctctgtgaccctgctgtggagcatcctgcaccaggccgacagcagcgagaagatgaccatcgccgccagcgccagcctgaccaccatcaacctgggcgccaccaagaacctgcggcagcagatcctggagctgctgggccccatctccatgaaccacggcgtgcacttcatggccgccatcgcctttgtgtggaatgaaagacggcagaacaagaccaccaccaggaccaaggtgatcccagctgccagcgaggagcagctgctgctggtggagctggtgcgcagcatctctgtgatgagagctgagaccgtcatccagacagtgaaggaggtgctgaagcagcccccagccatcgccaaggacaagaagcacctgagcctggaggtgtgcatgctgcagttcttctacgcctacatccagagaattcctgtgcccaacctggtggacagctgggccagcctgctgatcctgctgaaggacagcatccagctgagcctgcctgcccctggccagttcctgatcctgggcgtgctgaatgagttcatcatgaagaaccccagcctggagaacaagaaggaccagagggacctgcaggatgtgacccacaagatcgtggatgccatcggggccatcgccggcagcagcctggagcagaccacctggctgcggaggaacctggaggtgaagcccagccccaagatcatggtggatggcaccaacctggagagtgatgtggaggacatgctgagccctgccatggagacagccaacatcaccccatctgtgtacagcgtgcacgccctgaccctgctgtctgaggtgctggcccacctgctggacatggtgttctacagtgatgagaaggagagggtcatccccctgctggtgaacatcatgcactacgtggtgccctacctgaggaaccacagcgcccacaatgcccccagctaccgggcctgtgtgcagctgctgagcagcctgagcggctaccagtacacccggcgggcctggaagaaggaggcctttgacctcttcatggaccccagcttcttccagatggatgccagctgtgtgaaccactggagggccatcatggacaacctgatgacccatgacaagaccaccttccgggacctgatgaccagggtggccgtggcccagagcagcagcctgaacctgtttgccaacagagatgtggagctggagcagagggccatgctgctgaagaggctggcctttgccatcttcagcagcgagattgaccagtaccagaagtacctgcctgacatccaggagcggctggtggagagcctgcggctgccccaggtgcccaccctgcacagccaggtgttcctgttcttccgggtgctgctgctgaggatgagcccccagcacctgaccagcctgtggcccaccatgatcacagagctggtgcaggtgttcctgctgatggagcaggagctgacagcagatgaggacatcagcaggaccagcggccccagcgtggccggcctggagaccacctacacaggaggaaatggcttcagcaccagctacaacagccagcgctggctgaacctgtacctgagcgcctgcaagttcctggacctggccctggccctgcccagcgagaacctgccccagttccagatgtaccgctgggccttcatccctgaggccagtgatgacagcggcctggaggtgcggcggcagggcatccaccagcgggagttcaagccctacgtggtgcggctggccaagctgctgaggaagagggccaagaagaaccctgaggaggacaacagcggccgcaccctgggctgggagcccggccacctgctgctgaccatctgcaccgtgcgctccatggagcagctgctgcccttcttcaacgtgctgagccaggtgttcaacagcaaggtgaccagccgctgtggcggccacagcggcagccccatcctgtacagcaatgccttccccaacaaggacatgaagctggagaaccacaagccctgcagcagcaaggcccggcagaagattgaggagatggtggagaaggacttcctggagggcatgatcaagacctag

SEQ ID NO: 33955 - DNA, 7110 bp, Artificial Sequence; identical to SEQ ID NO: 33953
  Description of Artificial Sequence: Synthetic coding sequence

SEQ ID NO: 33956 - DNA, 690 bp, Artificial Sequence
  Description of Artificial Sequence: Synthetic coding sequence
atgaacacagaggagctggagctgctgagtgacagcaagtacagaaattatgtggccgccatcgacaaggccctgaagaactttgagtacagcagcgagtgggccgacctgatcagcgccctgggcaagctgaacaaggtgctgcagaacaatgccaagtaccaggtggtgcccaagaagctgaccatcggcaagaggctggcccagtgcctgcacccagccctgcccggcggcgtgcacaggaaggccctggagacctatgagatcatcttcaagatcatcggccccaagaggctggccaaggacctcttcctgtacagcagcggcctcttccccctgctggccaatgctgccatgtctgtgaagcccaccctgctgagcctgtatgagatctactacctgcccctgggcaagaccctgaagccaggcctgcagggcctgctgaccggcatcctgcccggcctggaggagggcagcgagtactatgaaagaaccaacatgctgctggagaaggtggccgctgctgtggaccagagcgccttctacagcgccctgtggggcagcctgctgaccagccctgctgtgcggctgcccggcatcacctacgtgctggcccacctgaacaggaagctgtccatggaggaccagctgtacatcatcggcagtgacatcgagctgatgaagcagtag

SEQ ID NO: 33957 - DNA, 423 bp, Artificial Sequence
  Description of Artificial Sequence: Synthetic coding sequence
atgcagaggctgaacatcggctacgtgatcaacgtgaccacccacctgcccctgtaccactatgagaagggcctcttcaactacaagaggctgcctgccacagacagcaacaagcagaacctgcggcagtactttgaggaggcctttgagttcatcgaggaggcccaccagtgtgggaagggcctgctgatccactgccaggccggcgtgagccgcagcgccaccatcgtcatcgcctacctgatgaagcacaccaggatgaccatgacagatgcctacaagtttgtgaagggcaagaggcccatcatcagccccaacctgaacttcatgggccagctgctggagtttgaggaggacctgaacaacggggtgaccccccgcatcctgacccccaagctgatgggcgtggagaccgtggtgtag

SEQ ID NO: 33958 - DNA, 1449 bp, Artificial Sequence
  Description of Artificial Sequence: Synthetic coding sequence
atgccacccagccccctggatgacagagtggtggtggccctgagcaggcctgtgcggccccaggacctgaacctgtgcctggacagcagctacctgggcagcgccaaccctggcagcaacagccacccccctgtgattgccaccaccgtggtgtccctgaaggccgccaacctgacctacatgcccagcagcagcggcagcgcccggagcctgaactgtggctgcagcagcgccagctgctgcaccgtggccacctatgacaaggacaaccaggcccagacccaggccatcgctgctggcaccaccaccacagccatcggcaccagcaccacctgcccagccaaccagatggtgaacaacaatgaaaatacaggcagcctgagccccagcagtggagtgggcagccctgtgtctggcacccccaagcagctggccagcatcaagatcatctacccaaatgacctggccaagaagatgaccaagtgcagcaagagccacctgcccagccagggccctgtgatcatcgactgccggcccttcatggagtacaacaagagccacatccagggcgctgtgcacatcaactgtgccgacaagatcagcagaagaaggctgcagcagggcaagatcaccgtgctggacctgatcagctgccgggagggcaaggacagcttcaagaggatcttcagcaaggagatcatcgtgtatgatgagaacaccaatgagcccagccgggtgatgcccagccagcccctgcacatcgtgctggagagcctgaagcgggagggcaaggagcccctggtgctgaagggcggcctgagcagcttcaagcagaaccacgagaacctgtgtgacaacagcctgcagctgcaggagtgccgggaggtgggcggcggggccagcgctgccagcagcctgctgccccagcccatccccaccaccccagacattgaaaatgctgagctgacccccatcctgcccttcctgttcctgggcaatgagcaggatgcccaggacctggacaccatgcagaggctgaacatcggctacgtgatcaacgtgaccacccacctgcccctgtaccactatgagaagggcctcttcaactacaagaggctgcctgccacagacagcaacaagcagaacctgcggcagtactttgaggaggcctttgagttcatcgaggaggcccaccagtgtgggaagggcctgctgatccactgccaggccggcgtgagccgcagcgccaccatcgtcatcgcctacctgatgaagcacaccaggatgaccatgacagatgcctacaagtttgtgaagggcaagaggcccatcatcagccccaacctgaacttcatgggccagctgctggagtttgaggaggacctgaacaacggggtgaccccccgcatcctgacccccaagctgatgggcgtggagaccgtggtgtag

SEQ ID NO: 33959 - DNA, 1284 bp, Artificial Sequence
  Description of Artificial Sequence: Synthetic coding sequence
atgccacccagccccctggatgacagagtggtggtggccctgagcaggcctgtgcggccccaggacctgaacctgtgcctggacagcagctacctgggcagcgccaaccctggcagcaacagccacccccctgtgatcaccaccacagccatcggcaccagcaccacctgcccagccaaccagatggtgaacaacaatgaaaatacaggcagcctgagccccagcagcggcgtgggcagccctgtgtctggcacccccaagcagctggccagcatcaagatcatctacccaaatgacctggccaagaagatgaccaagtgcagcaagagccacctgcccagccagggccctgtgatcatcgactgccggcccttcatggagtacaacaagagccacatccagggcgctgtgcacatcaactgtgccgacaagatcagcagaagaaggctgcagcagggcaagatcaccgtgctggacctgatcagctgccgggagggcaaggacagcttcaagaggatcttcagcaaggagatcatcgtgtatgatgagaacaccaatgagcccagccgggtgatgcccagccagcccctgcacatcgtgctggagagcctgaagcgggagggcaaggagcccctggtgctgaagggcggcctgagcagcttcaagcagaaccacgagaacctgtgtgacaacagcctgcagctgcaggagtgccgggaggtgggcggcggggccagcgctgccagcagcctgctgccccagcccatccccaccaccccagacattgaaaatgctgagctgacccccatcctgcccttcctgttcctgggcaatgagcaggatgcccaggacctggacaccatgcagaggctgaacatcggctacgtgatcaacgtgaccacccacctgcccctgtaccactatgagaagggcctcttcaactacaagaggctgcctgccacagacagcaacaagcagaacctgcggcagtactttgaggaggcctttgagttcatcgaggaggcccaccagtgtgggaagggcctgctgatccactgccaggccggcgtgagccgcagcgccaccatcgtgattgcctacctgatgaagcacaccaggatgaccatgacagatgcctacaagtttgtgaagggcaagaggcccatcatcagccccaacctgaacttcatgggccagctgctggagtttgaggaggacctgaacaatggagtgaccccccgcatcctgacccccaagctgatgggcgtggagaccgtggtgtag

SEQ ID NO: 33960 - DNA, 423 bp, Artificial Sequence; identical to SEQ ID NO: 33957
  Description of Artificial Sequence: Synthetic coding sequence

SEQ ID NO: 33961 - DNA, 888 bp, Artificial Sequence
  Description of Artificial Sequence: Synthetic coding sequence
atgacagagggcgtgctgcccggcctgtacctgggcaacttcattgatgccaaggacctggaccagctgggcaggaacaagatcacccacatcatcagcatccacgagagcccccagcccctgctgcaggacatcacctacctgcgcatccctgtggccgacaccccagaggtgcccatcaagaagcacttcaaggagtgcatcaacttcatccactgctgccgcctgaatggaggcaactgcctggtgcactgctttgctggcatcagccgcagcaccaccatcgtgacagcctacgtgatgacagtgacaggcctgggctggagagatgtgctggaggccatcaaggccacccggcccatcgccaaccccaaccctggcttccggcagcagctggaggagtttggctgggccagcagccagaagggggcccggcacaggaccagcaagaccagcggggcccagtgcccccccatgaccagcgccacctgcctgctggccgcccgggtggccctgctgtctgctgccctggtgcgggaggccaccggccgcacagcccagcgctgccgcctgagccccagggctgctgctgagcggctgctgggccccccaccccacgtggccgccggctggagcccagaccccaagtaccagatctgcctgtgctttggagaggaggaccccggccccacccagcaccccaaggagcagctgatcatggctgatgtgcaggtgcagctgcggcccggcagcagcagctgcaccctgagcgccagcacagagaggccagatggcagcagcaccccaggcaacccagatggcatcacccacctgcagtgcagctgcctgcaccccaagagagctgccagcagcagctgcaccaggtag

SEQ ID NO: 33962 - DNA, 708 bp, Artificial Sequence
  Description of Artificial Sequence: Synthetic coding sequence
atgggaaatggcatgaccaaggtgctgcccggcctgtacctgggcaacttcattgatgccaaggacctggaccagctgggcaggaacaagatcacccacatcatcagcatccacgagagcccccagcccctgctgcaggacatcacctacctgcgcatccctgtggccgacaccccagaggtgcccatcaagaagcacttcaaggagtgcatcaacttcatccactgctgccgcctgaatggaggcaactgcctggtgcactgctttgctggcatcagccgcagcaccaccatcgtgacagcctacgtgatgacagtgacaggcctgggctggagagatgtgctggaggccatcaaggccacccggcccatcgccaaccccaaccctggcttccggcagcagctggaggagtttggctgggccagcagccagaagctgcggcggcagctggaggagagatttggagagagccccttcagagatgaggaggagctgcgggccctgctgcccctgtgcaagcgctgccggcagggcagcgccaccagcgccagcagcgctggcccccacagcgctgccagcgagggcaccgtgcagaggctggtgcccaggaccccccgggaggcccaccggcccctgcccctgctggcccgggtgaagcagaccttcagctgcctgccccgctgcctgagcaggaagggcggcaagtag

SEQ ID NO: 33963 - DNA, 264 bp, Artificial Sequence
  Description of Artificial Sequence: Synthetic coding sequence
atgggaaatggcatgaccaagatgcccaagacctggatctcctgggccgagatccgcagccacaccagcagcctgtccatgagccaccccagcctgtgctgccgcatcagccccacctttgccagccgcagcctcatccccctgcgctaccccagcaagagcaccagcaagaatgtgtccaccagcagcacagctgctgccctgatgggcggcacagccctgtgcacagccctgcaggccagcctggccgccccccggctgtag

SEQ ID NO: 33964 - DNA, 699 bp, Artificial Sequence
  Description of Artificial Sequence: Synthetic coding sequence
atgacagagggcgtgctgcccggcctgtacctgggcaacttcattgatgccaaggacctggaccagctgggcaggaacaagatcacccacatcatcagcatccacgagagcccccagcccctgctgcaggacatcacctacctgcgcatccctgtggccgacaccccagaggtgcccatcaagaagcacttcaaggagtgcatcaacttcatccactgctgccgcctgaatggaggcaactgcctggtgcactgctttgctggcatcagccgcagcaccaccatcgtgacagcctacgtgatgacagtgacaggcctgggctggagagatgtgctggaggccatcaaggccacccggcccatcgccaaccccaaccctggcttccggcagcagctggaggagtttggctgggccagcagccagaagctgcggcggcagctggaggagagatttggagagagccccttcagagatgaggaggagctgcgggccctgctgcccctgtgcaagcgctgccggcagggcagcgccaccagcgccagcagcgctggcccccacagcgctgccagcgagggcaccgtgcagaggctggtgcccaggaccccccgggaggcccaccggcccctgcccctgctggcccgggtgaagcagaccttcagctgcctgccccgctgcctgagcaggaaaggaggcaagtag

SEQ ID NO: 33965 - DNA, 399 bp, Artificial Sequence
  Description of Artificial Sequence: Synthetic coding sequence
atgacagtgacaggcctgggctggagagatgtgctggaggccatcaaggccacccggcccatcgccaaccccaaccctggcttccggcagcagctggaggagtttggctgggccagcagccagaagctgcggcggcagctggaggagagatttggagagagccccttcagagatgaggaggagctgcgggccctgctgcccctgtgcaagcgctgccggcagggcagcgccaccagcgccagcagcgctggcccccacagcgctgccagcgagggcaccgtgcagaggctggtgcccaggaccccccgggaggcccaccggcccctgcccctgctggcccgggtgaagcagaccttcagctgcctgccccgctgcctgagcaggaaaggaggcaagtag

SEQ ID NO: 33966 - DNA, 399 bp, Artificial Sequence; identical to SEQ ID NO: 33965
  Description of Artificial Sequence: Synthetic coding sequence

SEQ ID NO: 33967 - DNA, 282 bp, Artificial Sequence
  Description of Artificial Sequence: Synthetic coding sequence
tgaacacggctgcccccaggcggctggagcccagaccccaagtaccagatctgcctgtgctttggagaggaggaccccggccccacccagcaccccaaggagcagctgatcatggctgatgtgcaggtgcagctgcggcccggcagcagcagctgcaccctgagcgccagcacagagaggccagatggcagcagcaccccaggcaacccagatggcatcacccacctgcagtgcagctgcctgcaccccaagagagctgccagcagcagctgcaccaggtag

SEQ ID NO: 33968 - DNA, 399 bp, Artificial Sequence; identical to SEQ ID NO: 33965
  Description of Artificial Sequence: Synthetic coding sequence

SEQ ID NO: 33969 - DNA, 2514 bp, Artificial Sequence
  Description of Artificial Sequence: Synthetic coding sequence
atggccaaggctgctgccagcagcagcctggaggacctggacctgagcggggaggaggtgcagaggctgaccagcgccttccaggaccctgagttccggaggatgttcagccagtatgcagaggagctgacagatcctgaaaatagaagaagatatgaggccgagatcacagccctggagcgggagcggggcgtggaggtgcgctttgtgcaccctgagcccggccacgtgctgcggaccagcctggatggagcccggcgctgctttgtgaatgtgtgcagcaatgccctggtgggcgcccccagcagcaggcctggcagcggcggggacagaggagctgcccctggcagccactggagcctgccctacagcctggcccctggccgggagtatgccggccgcagcagcagccgctacatggtgtatgatgtggtgttccacccagatgccctggccctggccaggagacatgagggcttccggcagatgctggatgccacagccctggaggccgtggagaagcagtttggagtgaagctggacagaagaaatgccaagaccctgaaggccaagtacaagggcaccccagaggccgctgtgctgcggacccccctgcccggggtcatcccagcccggccagatggagagcccaagggccccctgcctgacttcccctacccctaccagtacccagctgcccctggcccccgggcccccagccccccagaggccgccctgcagcctgcccccacagagccccgctacagcgtggtgcagaggcaccacgtggacctgcaggactaccgctgcagccgggacagcgcccccagccctgtgccccatgagctggtgatcaccatcgagctgcccctgctgcggtctgctgagcaggccgccctggaggtgaccaggaagctgctgtgcctggacagcaggaagccagactaccgcctgcggctgagcctgccctaccctgtggatgatggccggggcaaggcccagttcaacaaggcccggcggcagctggtggtgaccctgcctgtggtgctgcctgctgcccggcgggagcctgctgtggccgtggccgccgccgcccctgaggagagcgctgacagaagtggcacagatggccaggcctgtgccagcgcccgggagggggaggccggccctgcccggagcagagcagaagatggcggccatgacacctgtgtggccggggccgccggcagcggcgtgaccaccctgggggaccctgaggtggcccctcctcctgctgctgctggggaggagcgggtgcccaagccaggagagcaggacctgagcagacatgctggcagccccccaggctctgtggaggagcccagccctggaggagagaacagccctgggggcggcggcagcccctgcctgagcagccgcagcctggcctggggcagcagcgctggccgggagagcgcccggggggacagctctgtggagacccgggaggagagcgagggcactggaggccagaggtctgcctgtgccatgggcggccctggcaccaagtctggagagcccctgtgcccccccctgctgtgcaaccaggacaaggagaccctgaccctgctgatccaggtgccccgcatccagccccagagcctgcagggcgacctgaaccccctgtggtacaagctgcgcttcagcgcccaggacctggtgtacagcttcttcctgcagtttgcccctgagaacaagctgagcaccacagagcctgtgatcagcatcagcagcaacaatgctgtgattgagctggccaagagccctgagagccacggccactggagggagtggtactatggagtgaacaatgacagcctggaggagcggctgtttgtgaatgaagaaaatgtgaatgagttcctggaggaggtgctgagcagccccttcaagcagagcatgagcctgaccccacccctcatcgaggtgctgcaggtgacagacaacaagatccagatcaatgccaagctgcaggagtgcagcaacagcgaccagctgcagggcaaggaggagcgggtgaatgaggagagccacctgacagagaaggagtacatcgagcactgcaacacccccaccacagacagcgacagcagcattgctgtgaaggccctgcagattgacagctttggcctggtgacctgcttccagcaggagagcctggatgtgtcccagatgatcctgggcaagagccagcagcctgagagcaagatgcagagcgagttcatcaaggagaagagcgccacctgcagcaatgaggagaaggacaacctgaatgaatctgtcatcacagaggagaaggagacagatggagaccacctgagcagcctgctgaacaagaccaccgtgcacaacatccctggctttgacagcatcaaggagaccaacatgcaggacggctctgtgcaggtgatcaaggaccacgtgaccaactgtgccttctccttccagaacagcctgctgtatgacctggactag

SEQ ID NO: 33970 - DNA, 2370 bp, Artificial Sequence
  Description of Artificial Sequence: Synthetic coding sequence
atggccaaggctgctgccagcagcagcctggaggacctggacctgagcggggaggaggtgcagaggctgaccagcgccttccaggaccctgagttccggaggatgttcagccagtatgcagaggagctgacagatcctgaaaatagaagaagatatgaggccgagatcacagccctggagcgggagcggggcgtggaggtgcgctttgtgcaccctgagcccggccacgtgctgcggaccagcctggatggagcccggcgctgctttgtgaatgtgtgcagcaatgccctggtgggcgcccccagcagcaggcctggcagcggcggggacagaggagctgcccctggcagccactggagcctgccctacagcctggcccctggccgggagtatgccggccgcagcagcagccgctacatggtgtatgatgtggtgttccacccagatgccctggccctggccaggagacatgagggcttccggcagatgctggatgccacagccctggaggccgtggagaagcagtttggagtgaagctggacagaagaaatgccaagaccctgaaggccaagtacaagggcaccccagaggccgctgtgctgcggacccccctgcccggggtcatcccagcccggccagatggagagcccaagggccccctgcctgacttcccctacccctaccagtacccagctgcccctggcccccgggcccccagccccccagaggccgccctgcagcctgcccccacagagccccgctacagcgtggtgcagaggcaccacgtggacctgcaggactaccgctgcagccgggacagcgcccccagccctgtgccccatgagctggtgatcaccatcgagctgcccctgctgcggtctgctgagcaggccgccctggaggtgaccaggaagctgctgtgcctggacagcaggaagccagactaccgcctgcggctgagcctgccctaccctgtggatgatggccggggcaaggcccagttcaacaaggcccggcggcagctggtggtgaccctgcctgtggtgctgcctgctgcccggcgggagcctgctgtggccgtggccgccgccgcccctgaggagagcgctgacagaagtggcacagatggccaggcctgtgccagcgcccgggagggggaggccggccctgcccggagcagagcagaagatggcggccatgacacctgtgtggccggggccgccggcagcggcgtgaccaccctgggggaccctgaggtggcccctcctcctgctgctgctggggaggagcgggtgcccaagccaggagagcaggacctgagcagacatgctggcagccccccaggctctgtggaggagcccagccctggaggagagaacagccctgggggcggcggcagcccctgcctgagcagccgcagcctggcctggggcagcagcgctggccgggagagcgcccggggggacagctctgtggagacccgggaggagagcgagggcactggaggccagaggtctgcctgtgccatgggcggccctggcaccaagtctggagagcccctgtgcccccccctgctgtgcaaccaggacaaggagaccctgaccctgctgatccaggtgccccgcatccagccccagagcctgcagggcgacctgaaccccctgtggtacaagctgcgcttcagcgcccaggacctggtgtacagcttcttcctgcagtttgcccctgagaacaagctgagcaccacagagcctgtgatcagcatcagcagcaacaatgctgtgattgagctggccaagagccctgagagccacggccactggagggagtggtactatggagtgaacaatgacagcctggagctgcaggagtgcagcaacagcgaccagctgcagggcaaggaggagcgggtgaatgaggagagccacctgacagagaaggagtacatcgagcactgcaacacccccaccacagacagcgacagcagcattgctgtgaaggccctgcagattgacagctttggcctggtgacctgcttccagcaggagagcctggatgtgtcccagatgatcctgggcaagagccagcagcctgagagcaagatgcagagcgagttcatcaaggagaagagcgccacctgcagcaatgaggagaaggacaacctgaatgaatctgtcatcacagaggagaaggagacagatggagaccacctgagcagcctgctgaacaagaccaccgtgcacaacatccctggctttgacagcatcaaggagaccaacatgcaggacggctctgtgcaggtgatcaaggaccacgtgaccaactgtgccttctccttccagaacagcctgctgtatgacctggactag

SEQ ID NO: 33971 - DNA, 2154 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagcgagagcagccgggccagcggcctggtgggcaggaaggccacagaggacttcctgggcagcagcagcggctacagcagtgaagatgattatgtgggctacagtgatgtggaccagcagagcagcagcagccggctgcggtctgctgtgtcccgggccggcagcctgctgtggatggtggccaccagccctggccgcctcttccggctgctgtactggtgggccggcaccacctggtaccgcctgaccacagctgccagcctgctggatgtgtttgtgctgacccggcgcttcagcagcctgaagaccttcctgtggttcctgctgcccctgctgctgctgacctgcctgacctacggggcctggtacttctacccctacggcctgcagaccttccacccagccctggtgtcctggtgggccgccaaggacagcagaagaccagatgagggctgggaggcccgggacagcagcccccacttccaggccgagcagagggtgatgagccgggtgcacagcctggagcggcggctggaggccctggccgctgagttcagcagcaactggcagaaggaggccatgaggctggagcggctggagctgcggcagggcgcccctggccagggcggcggcggcggcctgagccatgaggacaccctggccctgctggagggcctggtgtcccggcgggaggccgccctgaaggaggacttccggcgggagacagctgcccgcatccaggaggagctgagcgccctgcgggcagagcaccagcaggacagtgaagatctcttcaagaagatcgtgcgggccagccaggagagcgaggcccgcatccagcagctgaagtctgagtggcagagcatgacccaggagagcttccaggagagctctgtgaaggagctgcggcggctggaggaccagctggccggcctgcagcaggagctggccgccctggccctgaagcagagctctgtggccgaggaggtgggcctgctgccccagcagatccaggccgtgagagatgatgtggagagccagtttcctgcctggatcagccagttcctggcccggggcggcggcggccgggtgggcctgctgcagcgggaggagatgcaggcccagctgcgggagctggagagcaagatcctgacccacgtggccgagatgcagggcaagagcgcccgggaggccgccgccagcctgagcctgaccctgcagaaggagggcgtgattggagtgacagaggagcaggtgcaccacatcgtgaagcaggccctgcagcgctacagtgaagatcgcatcggcctggccgactatgccctggagagcggcggggccagcgtcatcagcacccgctgcagcgagacctatgagaccaagacagccctgctgagcctgtttggcatccccctgtggtaccacagccagagccccagggtcatcctgcagccagatgtgcaccctggcaactgctgggccttccagggcccccagggctttgctgtggtgcggctgagcgcccgcatccggcccacagctgtgaccctggagcacgtgcccaaggccctgagccccaacagcaccatcagcagcgcccccaaggactttgccatctttggatttgatgaggacctgcagcaggagggcaccctgctgggcaagttcacctatgaccaggatggagagcccatccagaccttccacttccaggcccccaccatggccacctaccaggtggtggagctgcgcatcctgaccaactggggccaccctgagtacacctgcatctaccgcttccgggtgcacggggagcccgcccactag

SEQ ID NO: 33972 - DNA, 1572 bp, Artificial Sequence
  Description of Artificial Sequence: Synthetic coding sequence
atggctgctgtgggccgggtgggcagctttggcagcagccccccaggcctgagcagcacctacacaggaggccccctgggcaatgagatcgccagcggaaatggaggagctgctgctggagatgatgaagatggccagaacctgtggagctgcatcctgtctgaggtgtccaccaggagccgcagcaagctgcctgctgggaagaatgtgctgctgctgggagaagatggagctgggaagaccagcctcatcaggaagatccagggcatcgaggagtacaagaagggccggggcctggagtacctgtacctgaatgtgcatgatgaagatagagatgaccagacccgctgcaatgtgtggatcctggatggagacctgtaccacaagggcctgctgaagttcagcctggatgctgtgtccctgaaggacaccctggtgatgctggtggtggacatgagcaagccctggacagccctggacagcctgcagaagtgggcctctgtggtgcgggagcacgtggacaagctgaagatccccccagaggagatgaagcagatggagcagaagctgatccgggacttccaggagtatgtggagcccggggaggacttccctgccagcccccagaggaggaacacagccagccaggaggacaaggatgacagcgtggtgctgcccctgggcgctgacaccctgacccacaacctgggcatccctgtgctggtggtgtgcaccaagtgtgatgccatctctgtgctggagaaggagcatgactacagagatgagcactttgacttcatccagagccacatcaggaagttctgcctgcagtacggggccgccctgatctacacctctgtgaaggagaacaagaacatcgacctggtgtacaagtacatcgtgcagaagctgtatggcttcccctacaagatcccagctgtggtggtggagaaggatgctgtgttcatcccagctggctgggacaatgacaagaagattggcatcctgcacgagaacttccagaccctgaaggccgaggacaactttgaggacatcatcaccaagccccctgtgaggaagtttgtgcatgagaaggagatcatggccgaggatgaccaggtgttcctgatgaagctgcagagcctgctggccaagcagcccccaacagctgctggccggcctgtggatgccagcccccgggtgcctgggggcagccccaggacccccaacagatctgtgagcagcaatgtggcctctgtgagccccatcccagctggcagcaagaagattgaccccaacatgaaggccggggccaccagcgagggcgtgctggccaacttcttcaacagcctgctgagcaagaagacaggcagccctgggggccctggggtgtctgggggcagccctgctgggggcgccggcggcggcagcagcggcctgccccccagcaccaagaagagcggccagaagcctgtgctggatgtgcatgctgagctggaccgcatcaccaggaagcctgtgacagtgagccccaccacccccaccagccccacagaaggagaggccagctag

SEQ ID NO: 33973 - DNA, 351 bp, Artificial Sequence
  Description of Artificial Sequence: Synthetic coding sequence
atggaggagtaccaccgccactgtgatgaggtgggcttcaatgctgaggaggcccacaacatcgtgaaggaatgtgtggatggagtgctgggcggggaggactacaaccacaacaacatcaaccagtggacagccagcatcgtggagcagagcctgacccacctggtgaagctgggcaaggcctacaagtacatcgtgacctgtgctgtggtgcagaagagcgcctacggcttccacacagccagcagctgcttctgggacaccaccagtgatggcacctgcaccgtgcgctgggagaacagaaccatgaactgcatcgtgaatgtgtttgccatcgccatcgtgctgtag

SEQ ID NO: 33974 - DNA, 459 bp, Artificial Sequence
  Description of Artificial Sequence: Synthetic coding sequence
atggaggagtaccaccgccactgtgatgaggtgggcttcaatgctgaggaggcccacaacatcgtgaaggaatgtgtggatggagtgctgggcggggaggactacaaccacaacaacatcaaccagtggacagccagcatcgtggagcagagcctgacccacctggtgaagctgggcaaggcctacaagtacatcgtgacctgtgctgtggtgcagaagagcgcctacggcttccacacagccagcagctgcttctgggacaccaccagtgatggcacctgcaccgtgcgctgggagaacagaaccatgaactgtggggtgctgctgtgccggcccggctggagcgctgtgatgcagttccggctgacagccaccagcgccagccaggtgcaggtgatcctgctgccccagcccccagagtacctggagctgcaggcccacgccatcaccccaggatag

SEQ ID NO: 33975 - DNA, 369 bp, Artificial Sequence
  Description of Artificial Sequence: Synthetic coding sequence
atggcccggagcctgggcgtgctggtggccctgcccttccccctgcctgtgggcttcaatgctgaggaggcccacaacatcgtgaaggaatgtgtggatggagtgctgggcggggaggactacaaccacaacaacatcaaccagtggacagccagcatcgtggagcagagcctgacccacctggtgaagctgggcaaggcctacaagtacatcgtgacctgtgctgtggtgcagaagagcgcctacggcttccacacagccagcagctgcttctgggacaccaccagtgatggcacctgcaccgtgcgctgggagaacagaaccatgaactgcatcgtgaatgtgtttgccatcgccatcgtgctgtag

SEQ ID NO: 33976 - DNA, 1737 bp, Artificial Sequence
  Description of Artificial Sequence: Synthetic coding sequence
atggaccctgacaagcaggatgccctgaacagcattgaaaattccatctacagaacagccttcaagctgcagagcgtgcagaccctgtgccagctggacctgattgacagcagcctcatccagcaggtgctgctgcggcccagcttctgggaggccaggaagcacagcctgtctgtgcagcagctgagccaggccctgcaggagctgttccagaaggcccgggaggagaaccctggccaggtgcacccccgggcccctgagctgaccctgagcctgctgaccaccatgtacaacagcaagggcaccggcttcctgcagctgatgcctgctgctgctgccctgatcaccctgagcggggacagccccctgagcaagtaccgggccctcttccagctgtatgcagagaacagcagaggaggctatgattctggccccaggatgaccaggagagtgctgaggaagctgctgacagacctgcagcagatccccacctttgtgggggagagccgggccctgtgccctgtggagagcgccaccaggagctgcttccagggcgtgctgagccctgccatcaaggaggagaagttcctgtcctgggtgcagagcgagccccccatcctgctgtggctgcccacctgccaccggctgtctgctgctgagcgggtgacccacccagcccgctgcaccctgtgcaggaccttccccatcaccggcctgcgctaccgctgcctgaagtgcctgaactttgacatctgccagatgtgcttcctgagcggcctgcacagcaagagccaccagaagagccaccctgtgattgagcactgcatccagatgtctgccatgcagaacaccaagctgctcttccgcaccctgaggaacaacctgctgcagggccgctgcaggaagaaggaggccgcccggcggcagcagctgctggaccaggtgaaccccaagggcgtgccccaccacgcccaggcccggctgctgaagaagcagctgaaccagtacaaggacaagctgcaggccatctacaccagccaggaggagcgcatctgccgctttgagacccgcatccacaagctgaagaccaaccaggacagcctgtggaccaagctgcagcagatccggcgggacctgcaggcccggctgcagcccccaggccccagcagcagcagcttccagaatgtgggcaacaaggtggaccacagcagcacagagaaggtgcccaagggcggggactacctgcagatcaagaatgccacagaagatgccagcactggagagcccctgcccaagctggatgaggtggacaggagccacaggagccacaccaatgctgagcacgccctgagaaatcctgagagccctgagaccaccctgcacagcacccgggcccagagccagacccagaagatgccccagaaggtgatcagcgccctgcccagctaccaggagggcctgaagcaggacatccccaagatggtgcctgctgagatgagcagccctgccctggccgctgtggagaagaaggaggccggcaacatcaaggagaggaaggatgagctggaggaggaggagctgcaggagctgctgagcaagctgatggatgccttcaacctggagacccccagcggccctgagagctctgtgaacatggacctgtacagcggggcccagagggtgtgccgggccttcagcgccctggtggaccagatcgccctgcccaacctgaagtag

SEQ ID NO: 33977 - DNA, 858 bp, Artificial Sequence
  Description of Artificial Sequence: Synthetic coding sequence
atgaaccggctgcctgatgattatgacccctatgctgtggaggagcccagtgatgaggagcccgccctgagcagcagtgaagatgaggtggatgtgctgctgcacggcaccccagaccagaagaggaagctgatcagagaatgtctgaccggggagagcgagagcagcagtgaagatgaatttgagaaggagatggaggccgagctgaacagcaccatgaagaccatggaggacaagctgagcagcctgggcaccggcagcagcagtggaaatggcaaggtggccacagcccccacccgctactatgatgacatctactttgacagcgacagtgaagatgaggacagagctgtgcaggtgaccaagaagaagaagaagaagcagcacaagatccccaccaatgatgagctgctgtatgaccctgagaaggacaacagagaccaggcctgggtggatgcccagaggcggggctaccacggcctgggcccccagaggagccggcagcagcagcctgtgcccaacagtgatgctgtgctgaactgcccagcctgcatgaccaccctgtgcctggactgccagagacatgagagctacaagacccagtaccgggccatgtttgtgatgaactgcagcatcaacaaggaggaggtgctgcgctacaaggccagcgagaacaggaagaagagaagagtgcacaagaagatgaggagcaaccgggaggatgctgctgagaaggccgagacagatgtggaggagatctaccaccctgtgatgtgcacagaatgttccacagaggtggccgtgtatgacaaggatgaggtgttccacttcttcaacgtgctggccagccacagctag

SEQ ID NO: 33978 - DNA, 4236 bp, Artificial Sequence
  Description of Artificial Sequence: Synthetic coding sequence
atgctgcggcgcatcctgcagaggaccccaggccgggtgggcagccagggcagtgacctggacagcagcgccacccccatcaacacagtggatgtgaacaatgaaagcagcagcgagggcttcatctgcccccagtgcatgaagagcctgggcagcgcagatgagctgttcaagcactatgaggccgtgcatgatgctggaaatgacagcggccacggcggggagagcaacctggccctgaagagagatgatgtgaccctgctgcggcaggaggtgcaggacctgcaggccagcctgaaggaggagaagtggtacagcgaggagctgaagaaggagctggagaagtaccagggcctgcagcagcaggaggccaagccagatggcctggtgacagacagcagcgctgagctgcagagcctggagcagcagctggaggaggcccagacagagaacttcaacatcaagcagatgaaggacctgtttgagcagaaggccgcccagctggccacagaaattgctgacatcaagagcaaatatgatgaggagaggagcctgcgggaggccgctgagcagaaggtgacccggctgacagaggagctgaacaaggaggccaccgtcatccaggacctgaagacagagctgctgcagaggcctggcattgaagatgtggccgtgctgaagaaggagctggtgcaggtgcagaccctgatggacaacatgaccctggagcgggagcgggagagcgagaagctgaaggatgagtgcaagaagctgcagagccagtatgccagcagcgaggccaccatcagccagctgcggtctgagctggccaagggcccccaggaggtggccgtgtatgtgcaggagctgcagaagctgaagagctctgtgaatgagctgacccagaagaaccagaccctgacagagaacctgctgaagaaggagcaggactacaccaagctggaggagaagcacaatgaggagagcgtgtccaagaagaacatccaggccaccctgcaccagaaggacctggactgccagcagctgcagagccggctgagcgccagcgagaccagcctgcaccgcatccacgtggagctgtctgagaagggggaggccacccagaagctgaaggaggagctgtctgaggtggagaccaagtaccagcacctgaaggccgagttcaagcagctgcagcagcagcgggaggagaaggagcagcacggcctgcagctgcagagcgagatcaaccagctgcacagcaagctgctggagacagagcggcagctgggggaggcccacggccgcctgaaggagcagaggcagctgagcagcgagaagctgatggacaaggagcagcaggtggccgacctgcagctgaagctgagccggctggaggagcagctgaaggagaaggtgaccaacagcacagagctgcagcaccagctggacaagaccaagcagcagcaccaggagcagcaggccctgcagcagagcaccacagccaagctgcgggaggcccagaatgacctggagcaggtgctgcggcagatcggggacaaggaccagaagatccagaacctggaggccctgctgcagaagagcaaagaaaacatcagcctgctggagaaggagcgggaggacctgtatgccaagatccaggccggggagggggagacagctgtgctgaaccagctgcaggagaagaaccacaccctgcaggagcaggtgacccagctgacagagaagctgaagaaccagagcgagagccacaagcaggcccaggagaacctgcatgaccaggtgcaggagcagaaggcccacctgcgggccgcccaggacagagtgctgagcctggagacctctgtgaatgagctgaacagccagctgaatgaaagcaaggagaaggtgtcccagctggacatccagatcaaggccaagacagagctgctgctgtctgctgaggccgccaagacagcccagagagctgacctgcagaaccacctggacacagcccagaatgccctgcaggacaagcagcaggagctgaacaagatcaccacccagctggaccaggtgacagccaagctgcaggacaagcaggagcactgcagccagctggagagccacctgaaggagtacaaggagaagtacctgagcctggagcagaagacagaggagctggagggccagatcaagaagctggaggccgacagcctggaggtgaaggccagcaaggagcaggccctgcaggacctgcagcagcagaggcagctgaacacagacctggagctgcgggccacagagctgagcaagcagctggagatggagaaggagatcgtgagcagcacccggctggacctgcagaagaagtctgaggccctggagagcatcaagcagaagctgaccaagcaggaggaggagaagaagatcctgaagcaggactttgagaccctgagccaggagaccaagatccagcacgaggagctgaacaaccgcatccagaccaccgtgacagagctgcagaaggtgaagatggagaaggaggccctgatgacagagctgagcacagtgaaggacaagctgagcaaggtgtctgacagcctgaagaacagcaagtcagaatttgagaaggagaaccagaagggcaaggccgccatcctggacctggagaagacctgcaaggagctgaagcaccagctgcaggtgcagatggagaacaccctgaaggagcagaaggagctgaagaagagcctggagaaggagaaggaggccagccaccagctgaagctggagctgaacagcatgcaggagcagctgatccaggcccagaacaccctgaagcagaatgagaaggaggagcagcagctgcagggcaacatcaatgagctgaagcagagcagcgagcagaagaagaagcagatcgaggccctgcagggcgagctgaagattgctgtgctgcagaagacagagctggagaacaagctgcagcagcagctgacccaggccgcccaggagctggccgctgagaaggagaagatctctgtgctgcagaacaactatgagaagagccaggagaccttcaagcagctgcagagcgacttctacggccgggagagcgagctgctggccacccggcaggacctgaagtctgtggaggagaagctgagcctggcccaggaggacctgatcagcaacagaaaccagatcggcaaccagaacaagctgatccaggagctgaagacagccaaggccaccctggagcaggacagcgccaagaaggagcagcagctgcaggagcgctgcaaggccctgcaggacatccagaaggagaagagcctgaaggagaaggagctggtgaatgagaagagcaagctggccgagattgaggagatcaagtgccggcaggagaaggagatcaccaagctgaatgaggagctgaagagccacaagctggagagcatcaaggagatcaccaacctgaaggatgccaagcagctgctgatccagcagaagctggagctgcagggcaaggctgacagcctgaaggctgctgtggagcaggagaagaggaaccagcagatcctgaaggaccaggtgaagaaggaggaggaggagctgaagaaggagttcatcgagaaggaggccaagctgcacagcgagatcaaggagaaggaggtgggcatgaagaagcatgaggagaatgaggccaagctgaccatgcagatcacagccctgaatgaaaacctgggcaccgtgaagaaggagtggcagagcagccagaggagagtgtctgagctggagaagcagacagatgacctgcggggggagattgctgtgctggaggccaccgtgcagaacaaccaggatgagcggcgggccctgctggagcgctgcctgaagggggagggggagattgagaagctgcagaccaaggtgctggagctgcagaggaagctggacaacaccacagctgctgtgcaggagctgggccgggagaaccagagcctgcagatcaagcacacccaggccctgaacaggaagtgggccgaggacaatgaggtgcagaactgcatggcctgtgggaagggcttctctgtgacagtgcggcggcaccactgccggcagtgtggcaacatcttctgtgccgagtgcagcgccaagaatgccctgacccccagcagcaagaagcctgtgcgggtgtgtgatgcctgcttcaatgacctgcagggctag

SEQ ID NO: 33979 - DNA, 933 bp, Artificial Sequence
  Description of Artificial Sequence: Synthetic coding sequence
ctgcggcgggtggaccacgagaccccaggccgggtgggcagccagggcagtgacctggacagcagcgccacccccatcaacacagtggatgtgaacaatgaaagcagcagcgagggcttcatctgcccccagtgcatgaagagcctgggcagcgcagatgagctgttcaagcactatgaagctgtgcatgatgctggaaatgattctggccatggaggagagagcaacctggccctgaagagagatgatgtgaccctgctgcggcaggaggtgcaggacctgcaggccagcctgaaggaggagaagtggtacagcgaggagctgaagaaggagctggagaagtaccagggcctgcagcagcaggaggccaagccagatggcctggtgacagacagcagcgctgagctgcagagcctggagcagcagctggaggaggcccagacagagaacttcaacatcaagcagatgaaggacctgtttgagcagaaggccgcccagctggccacagaaattgctgacatcaagagcaaatatgatgaggagaggagcctgcgggaggccgctgagcagaaggtgacccggctgacagaggagctgaacaaggaggccaccgtcatccaggacctgaagacagagctgctgcagaggcctggcattgaagatgtggccgtgctgaagaaggagctggtgcaggtgcagaccctgatggacaacatgaccctggagcgggagcgggagagcgagaagctgaaggatgagtgcaagaagctgcagagccagtatgccagcagcgaggccaccatcagccagctgcggtctgagctggccaagggcccccaggaggtggccgtgtatgtgcaggagctgcagaagctgaagagctctgtgaatgagctgacccagaagaaccagaagaagaagaagaagaagtag

SEQ ID NO: 33980 - DNA, 1716 bp, Artificial Sequence
  Description of Artificial Sequence: Synthetic coding sequence
atgggccgcatcggcatcagctgcctcttccctgcctcctggcacttcagcatcagccctgtgggctgcccccgcatcctgaacaccaacctgcggcagatcatggtgatctctgtgctggccgctgctgtgtccctgctgtacttctctgtggtgatcatccggaacaagtatggccgcctgacccgggacaagaagttccagcgctacctggcccgggtgacagacatcgaggccacagacaccaacaaccccaacgtgaactatggaattgtggtggactgtggcagcagcggcagccgggtgtttgtgtactgctggcccaggcacaatggaaacccccatgacctgctggacatccggcagatgagggacaagaacaggaagcctgtggtgatgaagatcaagccaggcatcagcgagtttgccaccagccctgagaaggtgtctgactacatcagccccctgctgaactttgctgctgagcacgtgccccgggccaagcacaaggagacccccctgtacatcctgtgcacagctggcatgaggatcctgcctgagagccagcagaaggccatcctggaggacctgctgacagacatccctgtgcactttgacttcctgttcagtgacagccacgccgaggtgatcagcggcaagcaggagggcgtgtatgcctggattggcatcaactttgtgctgggccgctttgagcacattgaagatgatgatgaggccgtggtggaggtgaacatccctggcagcgagagcagcgaggccatcgtgaggaagaggacagctggcatcctggacatgggcggcgtgtccacccagatcgcctatgaggtgcccaagacagaggaggtggccaagaacctgctggccgagttcaacctgggctgtgatgtgcaccagacagagcacgtgtacagagtgtatgtggccaccttcctgggctttggaggaaatgctgcccggcagagatatgaggaccgcatctttgccaacaccatccagaagaaccggctgctgggcaagcagacaggcctgaccccagacatgccctacctggacccctgcctgcccctggacatcaaggatgagatccagcagaatggccagaccatctacctgcggggcactggagactttgacctgtgccgggagaccatccagcccttcatgaacaagaccaatgagacccagaccagcctgaatggagtgtaccagccccccatccacttccagaacagcgagttctacggcttcagcgagttctactactgcacagaagatgtgctgaggatgggcggggactacaatgctgccaagttcaccaaggccgccaaggactactgtgccaccaagtggagcatcctgcgggagagatttgaccggggcctgtatgccagccatgctgacctgcaccggctgaagtaccagtgcttcaagagcgcctggatgtttgaggtgttccaccggggcttctccttccctgtgaactacaagagcctgaagacagccctgcaggtgtatgacaaggaggtgcagtggaccctgggcgccatcctgtaccgcacccgcttcctgcccctgaggaagattggcatgctgatcatcccctgcagcggcggctgccccaagctgtgctgtgctgtgtggcagcccccaccctatggagccaccaagcacctgcagtgtgccgcctggaactag

SEQ ID NO: 33981 - DNA, 1851 bp, Artificial Sequence
  Description of Artificial Sequence: Synthetic coding sequence
atgggccgcatcggcatcagctgcctcttccctgcctcctggcacttcagcatcagccctgtgggctgcccccgcatcctgaacaccaacctgcggcagatcatggtgatctctgtgctggccgctgctgtgtccctgctgtacttctctgtggtgatcatccggaacaagtatggccgcctgacccgggacaagaagttccagcgctacctggcccgggtgacagacatcgaggccacagacaccaacaaccccaacgtgaactatggaattgtggtggactgtggcagcagcggcagccgggtgtttgtgtactgctggcccaggcacaatggaaacccccatgacctgctggacatccggcagatgagggacaagaacaggaagcctgtggtgatgaagatcaagccaggcatcagcgagtttgccaccagccctgagaaggtgtctgactacatcagccccctgctgaactttgctgctgagcacgtgccccgggccaagcacaaggagacccccctgtacatcctgtgcacagctggcatgaggatcctgcctgagagccagcagaaggccatcctggaggacctgctgacagacatccctgtgcactttgacttcctgttcagtgacagccacgccgaggtgatcagcggcaagcaggagggcgtgtatgcctggattggcatcaactttgtgctgggccgctttgagcacattgaagatgatgatgaggccgtggtggaggtgaacatccctggcagcgagagcagcgaggccatcgtgaggaagaggacagctggcatcctggacatgggcggcgtgtccacccagatcgcctatgaggtgcccaagacagtgtcctttgccagcagccagcaggaggaggtggccaagaacctgctggccgagttcaacctgggctgtgatgtgcaccagacagagcacgtgtacagagtgtatgtggccaccttcctgggctttggaggaaatgctgcccggcagagatatgaggaccgcatctttgccaacaccatccagaagaaccggctgctgggcaagcagacaggcctgaccccagacatgccctacctggacccctgcctgcccctggacatcaaggatgagatccagcagaatggccagaccatctacctgcggggcactggagactttgacctgtgccgggagaccatccagcccttcatgaacaagaccaatgagacccagaccagcctgaatggagtgtaccagccccccatccacttccagaacagcgagttctacggcttcagcgagttctactactgcacagaagatgtgctgaggatgggcggggactacaatgctgccaagttcaccaaggccgccaaggactactgtgccaccaagtggagcatcctgcgggagagatttgaccggggcctgtatgccagccatgctgacctgcaccggctgaagtaccagtgcttcaagagcgcctggatgtttgaggtgttccaccggggcttctccttccctgtgaactacaagagcctgaagacagccctgcaggtgtatgacaaggaggtgcagtggaccctgggcgccatcctgtaccgcacccgcttcctgcccctgcgggacatccagcaggaggccttccgggccagccacacccactggaggggcgtgtcctttgtgtacaaccactacctgttcagcggctgcttcctggtggtgctgctggccatcctgctgtacctgctgcggctgcggcgcatccacaggaggacccccaggagcagcagcgctgctgccctgtggatggaggagggcctgcctgcccagaatgcccctggcaccctgtag

SEQ ID NO: 33982 - DNA, 1827 bp, Artificial Sequence
  Description of Artificial Sequence: Synthetic coding sequence
atgggccgcatcggcatcagctgcctcttccctgcctcctggcacttcagcatcagccctgtgggctgcccccgcatcctgaacaccaacctgcggcagatcatggtgatctctgtgctggccgctgctgtgtccctgctgtacttctctgtggtgatcatccggaacaagtatggccgcctgacccgggacaagaagttccagcgctacctggcccgggtgacagacatcgaggccacagacaccaacaaccccaacgtgaactatggaattgtggtggactgtggcagcagcggcagccgggtgtttgtgtactgctggcccaggcacaatggaaacccccatgacctgctggacatccggcagatgagggacaagaacaggaagcctgtggtgatgaagatcaagccaggcatcagcgagtttgccaccagccctgagaaggtgtctgactacatcagccccctgctgaactttgctgctgagcacgtgccccgggccaagcacaaggagacccccctgtacatcctgtgcacagctggcatgaggatcctgcctgagagccagcagaaggccatcctggaggacctgctgacagacatccctgtgcactttgacttcctgttcagtgacagccacgccgaggtgatcagcggcaagcaggagggcgtgtatgcctggattggcatcaactttgtgctgggccgctttgagcacattgaagatgatgatgaggccgtggtggaggtgaacatccctggcagcgagagcagcgaggccatcgtgaggaagaggacagctggcatcctggacatgggcggcgtgtccacccagatcgcctatgaggtgcccaagacagaggaggtggccaagaacctgctggccgagttcaacctgggctgtgatgtgcaccagacagagcacgtgtacagagtgtatgtggccaccttcctgggctttggaggaaatgctgcccggcagagatatgaggaccgcatctttgccaacaccatccagaagaaccggctgctgggcaagcagacaggcctgaccccagacatgccctacctggacccctgcctgcccctggacatcaaggatgagatccagcagaatggccagaccatctacctgcggggcactggagactttgacctgtgccgggagaccatccagcccttcatgaacaagaccaatgagacccagaccagcctgaatggagtgtaccagccccccatccacttccagaacagcgagttctacggcttcagcgagttctactactgcacagaagatgtgctgaggatgggcggggactacaatgctgccaagttcaccaaggccgccaaggactactgtgccaccaagtggagcatcctgcgggagagatttgaccggggcctgtatgccagccatgctgacctgcaccggctgaagtaccagtgcttcaagagcgcctggatgtttgaggtgttccaccggggcttctccttccctgtgaactacaagagcctgaagacagccctgcaggtgtatgacaaggaggtgcagtggaccctgggcgccatcctgtaccgcacccgcttcctgcccctgcgggacatccagcaggaggccttccgggccagccacacccactggaggggcgtgtcctttgtgtacaaccactacctgttcagcggctgcttcctggtggtgctgctggccatcctgctgtacctgctgcggctgcggcgcatccacaggaggacccccaggagcagcagcgctgctgccctgtggatggaggagggcctgcctgcccagaatgcccctggcaccctgtag

SEQ ID NO: 33983 - DNA, 1815 bp, Artificial Sequence
  Description of Artificial Sequence: Synthetic coding sequence
atggcccgcatctccttctcctacctgtgcccagcctcctggtacttcaccgtgcccaccgtgagccccttcctgcggcagagggtggccttcctgggcctcttcttcatcagctgcctgctgctgctgatgctgatcatcgacttccgccactggagcgccagcctgccccgggaccggcagtatgaaagatacctggcccgggtgggggagctggaggccacagacacagaggaccccaacctgaactacggcctggtggtggactgtggcagcagcggcagccgcatctttgtgtacttctggcccaggcacaacggcaacccccatgacctgctggacatcaagcagatgagggacaggaacagccagcctgtggtgaagaagatcaagccaggcatcagcgccatggctgacaccccagagcacgccagtgactacctgcggcccctgctgagctttgctgctgcccacgtgcctgtgaagaagcacaaggagacccccctgtacatcctgtgcacagctggcatgaggctgctgcctgagaggaagcagctggccatcctggccgacctggtgaaggacctgcccctggagtttgacttcctgttcagccagagccaggccgaggtgatcagcggcaagcaggagggcgtgtatgcctggattggcatcaactttgtgctgggccgctttgaccatgaagatgaaagtgatgctgaggccacccaggagctggccgccggcagaagaagaacagtgggcatcctggacatgggcggggccagcctgcagatcgcctatgaggtgcccaccagcacctctgtgctgcctgccaagcaggaggaggccgccaagatcctgctggccgagttcaacctgggctgtgatgtgcagcacacagaacatgtgtacagagtgtatgtgaccaccttcctgggctttggaggcaactttgcccggcagagatatgaggacctggtgctgaatgagaccctgaacaagaaccggctgctgggccagaagacaggcctgagcccagacaaccccttcctggacccctgcctgcctgtgggcctgacagatgtggtggagaggaacagccaggtgctgcacgtgcggggccgcggggactgggtgtcctgtggggccatgctgagccccctgctggcccggagcaacaccagccaggccagcctgaatggcatctaccagagccccatcgacttcaacaacagcgagttctacggcttcagcgagttcttctactgcacagaagatgtgctgagaattggaggccgctaccacggccccacctttgccaaggccgcccaggactactgcggcatggcctggagcgtgctgacccagcgcttcaagaatggcctcttcagcagccatgctgatgagcaccggctgaagtaccagtgcttcaagagcgcctggatgtaccaggtgctgcacgagggcttccacttcccctatgactaccccaacctgaggacagcccagctggtgtatgaccgggaggtgcagtggaccctgggcgccatcctgtacaagacccgcttcctgcccctgcgggacctgcggcaggagggcgtgcggcaggcccacggctcctggttccggctgagctttgtgtacaaccactacctgttctttgcctgcatcctggtggtgctgctggccatcttcctgtacctgctgcggctgcggcgcatccaccaccggcagacccgggccagcgcccccctggacctgctgtggctggaggaggtggtgcccatgatgggcgtgcaggtgggcccctag

SEQ ID NO: 33984 - DNA, 1377 bp, Artificial Sequence
  Description of Artificial Sequence: Synthetic coding sequence
atgggcctgagcaggaaggagcaggtgttcctggccctgctgggcgccagcggcgtgtctggcctgacagccctgatcctgctgctggtggaggccacctctgtgctgctgcccacagacatcaagtttggaattgtgtttgatgctggcagcagccacaccagcctcttcctgtaccagtggctggccaacaaggaaaatggaactggagtggtgtcccaggccctggcctgccaggtggagggccctggcatcagcagctacaccagcaatgctgcccaggccggggagagcctgcagggctgcctggaggaggccctggtgctgatccctgaggcccagcacaggaagacccccaccttcctgggcgccacagctggcatgaggctgctgagcaggaagaacagcagccaggcccgggacatctttgctgctgtgacccaggtgctgggccgcagccctgtggacttctggggcgctgagctgctggccggccaggccgagggcgccttcggctggatcaccgtgaactacggcctgggcaccctggtgaagtacagcttcaccggggagtggatccagcccccagaggagatgctggtgggcgccctggacatgggcggggccagcacccagatcacctttgtgcctgggggccccatcctggacaagagcacccaggccgacttccggctgtatggcagtgactacagcgtgtacacccacagctacctgtgcttcggccgggaccagatgctgagccggctgctggtgggcctggtgcagagcaggcctgctgccctgctgcggcacccctgctacctgagcggctaccagaccaccctggccctgggccccctgtatgagagcccctgtgtgcacgccaccccacccctgagcctgccccagaacctgactgtggagggcaccggcaaccctggggcctgtgtgtctgccatccgggagctgttcaacttcagcagctgccagggccaggaggactgtgcctttgatggagtgtaccagccccccctgcggggccagttctacgtggaggccagctacccaggccaggaccgctggctgcgggactactgtgccagcggcctgtacatcctgaccctgctgcacgagggctacggcttcagcgaggagacctggcccagcctggagttcaggaagcaggccggcggcgtggacatcggctggaccctgggctacatgctgaacctgaccggcatgatcccagcagatgccccagcccagtggagggctgagagctatggagtgtgggtggccaaggtggtgttcatggtgctggccctggtggccgtggtgggcgccgccctggtgcagctgttctggctgcaggactag

SEQ ID NO: 33985 - DNA, 1488 bp, Artificial Sequence
  Description of Artificial Sequence: Synthetic coding sequence
atgggcctgagcaggaaggagcaggtgttcctggccctgctgggcgccagcggcgtgtctggcctgacagccctgatcctgctgctggtggaggccacctctgtgctgctgcccacagacatcaagtttggaattgtgtttgatgctggcagcagccacaccagcctcttcctgtaccagtggctggccaacaaggaaaatggaactggagtggtgtcccaggccctggcctgccaggtggagggccctggcatcagcagctacaccagcaatgctgcccaggccggggagagcctgcagggctgcctggaggaggccctggtgctgatccctgaggcccagcacaggaagacccccaccttcctgggcgccacagctggcatgaggctgctgagcaggaagaacagcagccaggcccgggacatctttgctgctgtgacccaggtgctgggccgcagccctgtggacttctggggcgctgagctgctggccggccaggccgagggcgccttcggctggatcaccgtgaactacggcctgggcaccctggtgaagtacagcttcaccggggagtggatccagcccccagaggagatgctggtgggcgccctggacatgggcggggccagcacccagatcacctttgtgcctgggggccccatcctggacaagagcacccaggccgacttccggctgtatggcagtgactacagcgtgtacacccacagctacctgtgcttcggccgggaccagatgctgagccggctgctggtgggcctggtgcagagcaggcctgctgccctgctgcggcacccctgctacctgagcggctaccagaccaccctggccctgggccccctgtatgagagcccctgtgtgcacgccaccccacccctgagcctgccccagaacctgactgtggagggcaccggcaaccctggggcctgtgtgtctgccatccgggagctgttcaacttcagcagctgccagggccaggaggactgtgcctttgatggagtgtaccagccccccctgcggggccagttctacgccttcagcaacttctactacaccttccacttcctgaacctgaccagccggcagcccctgagcacagtgaatgccaccatctgggagttctgccagaggccctggaagctggtggaggccagctacccaggccaggaccgctggctgcgggactactgtgccagcggcctgtacatcctgaccctgctgcacgagggctacggcttcagcgaggagacctggcccagcctggagttcaggaagcaggccggcggcgtggacatcggctggaccctgggctacatgctgaacctgaccggcatgatcccagcagatgccccagcccagtggagggctgagagctatggagtgtgggtggccaaggtggtgttcatggtgctggccctggtggccgtggtgggcgccgccctggtgcagctgttctggctgcaggactag

SEQ ID NO: 33986 - DNA, 1488 bp, Artificial Sequence; identical to SEQ ID NO: 33985
  Description of Artificial Sequence: Synthetic coding sequence

SEQ ID NO: 33987 - DNA, 1362 bp, Artificial Sequence
  Description of Artificial Sequence: Synthetic coding sequence
atgaagctgctggtgatcctgctcttcagcggcctcatcaccggcttcagaagtgacagcagcagcagcctgccccccaagctgctgctggtgtcctttgatggcttccgggctgactacctgaagaactatgagttcccccacctgcagaacttcatcaaggagggcgtgctggtggagcacgtgaagaatgtgttcatcaccaagaccttccccaaccactacagcatcgtgacaggcctgtatgaggagagccacggcatcgtggccaacagcatgtatgatgctgtgaccaagaagcacttcagtgacagcaatgacaaggaccccttctggtggaatgaggccgtgcccatctgggtgaccaaccagctgcaggagaacagaagcagcgctgctgccatgtggccaggcacagatgtgcccatccatgacaccatcagcagctacttcatgaactacaacagctctgtgtcctttgaggagcggctgaacaacatcaccatgtggctgaacaacagcaacccccctgtgacctttgccaccctgtactgggaggagccagatgccagcggccacaagtatggccctgaggacaaggagaacatgagccgggtgctgaagaagattgatgacctgattggagacctggtgcagaggctgaagatgctgggcctgtgggagaacctgaatgtcatcatcaccagtgaccacggcatgacccagtgcagccaggacaggctcatcaacctggacagctgcatcgaccacagctactacaccctgattgacctgagccctgtggccgccatcctgcccaagatcaacagaacagaggtgtacaacaagctgaagaactgcagcccccacatgaatgtgtacctgaaggaggacatccccaaccgcttctactaccagcacaatgaccgcatccagcccatcatcctggtggctgatgagggctggaccatcgtgctgaatgaaagcagccagaagctgggggaccacggctatgacaacagcctgcccagcatgcaccccttcctggccgcccacggccctgccttccacaagggctacaagcacagcaccatcaacatcgtggacatctaccccatgatgtgccacatcctgggcctgaagccccaccccaacaacggcaccttcggccacaccaagtgcctgctggtggaccagtggtgcatcaacctgcctgaggccatcgccatcgtcatcggcagcctgctggtgctgaccatgctgacctgcctgatcatcatcatgcagaaccggctgtctgtgccccggcccttcagccggctgcagctgcaggaggatgatgatgaccccctcatcggctag

SEQ ID NO: 33988 - DNA, 1362 bp, Artificial Sequence; identical to SEQ ID NO: 33987
  Description of Artificial Sequence: Synthetic coding sequence

SEQ ID NO: 33989 - DNA, 1377 bp, Artificial Sequence
  Description of Artificial Sequence: Synthetic coding sequence
atgaggggcctggccgtgctgctgactgtggccctggccaccctgctggcccctggggccggggcccctgtgcagagccagggcagccagaacaagctgctgctggtgtcctttgatggcttccgctggaactatgaccaggatgtggacacccccaacctggatgccatggccagagatggagtgaaggcccgctacatgaccccagcctttgtgaccatgaccagcccctgccacttcaccctggtgacaggcaagtacattgaaaatcatggagtggtgcacaacatgtactacaacaccaccagcaaggtgaagctgccctaccacgccaccctgggcatccagcgctggtgggacaatggatctgtgcccatctggatcacagcccagaggcagggcctgcgggccggcagcttcttctacccaggcggcaatgtgacctaccagggcgtggccgtgaccaggagcaggaaggagggcatcgcccacaactacaagaatgaaacagagtggagggccaacatcgacacagtgatggcctggttcacagaggaggacctggacctggtgaccctgtactttggagagccagacagcacaggccacagatatggccctgagagccctgagcggcgggagatggtgcggcaggtggacagaacagtgggctacctgcgggagagcatcgccaggaaccacctgacagaccggctgaacctgatcatcaccagtgaccacggcatgaccaccgtggacaagagagctggggacctggtggagttccacaagttccccaacttcaccttccgggacattgaatttgagctgctggactatggccccaacggcatgctgctgcccaaggagggccgcctggagaaggtgtatgatgccctgaaggatgcccaccccaagctgcacgtgtacaagaaggaggccttccctgaggccttccactacgccaacaacccccgggtgacccccctgctgatgtacagcgacctgggctacgtgattcatggccgcatcaacgtgcagttcaacaacggggagcacggctttgacaacaaggacatggacatgaagaccatcttccgggctgtgggccccagcttccgggccggcctggaggtggagccctttgagagcgtgcacgtgtatgagctgatgtgccgcctgctgggcatcgtgcctgaggccaatgatggccacctggccaccctgctgcccatgctgcacacagaaagtgccctgcccccagatggccggcccaccctgctgcccaagggccgcagcgccctgccccccagcagccggcccctgctggtgatgggcctgctgggcaccgtcatcctgctgtctgaggtggcctag

SEQ ID NO: 33990 - DNA, 1305 bp, Artificial Sequence
  Description of Artificial Sequence: Synthetic coding sequence
atggctgctgctgctggcagctgtgcccgggtggccgcctggggcggcaagctgcggcggggcctggccgtgtcccggcaggccgtgcgcagccctggccccctggccgctgctgtggccggggccgccctggccggggccggggccgcctggcaccacagccgggtgtctgtggccgccagagatggcagcttcaccgtgtctgcccagaagaatgtggagcacggcatcatctacatcggcaagcccagcctgaggaagcagcgcttcatgcagttcagcagcctggagcacgagggggagtactacatgaccccccgggacttcctgttctctgtgatgtttgagcagatggagaggaagacctctgtgaagaagctgaccaagaaggacatcgaggacaccctgagcggcatccagacagctggctgcggcagcaccttcttccgggacctgggggacaagggcctcatctcctacacagagtacctgttcctgctgaccatcctgaccaagccccacagcggcttccacgtggccttcaagatgctggacacagatggaaatgagatgattgagaagcgggagttcttcaagctgcagaagatcatcagcaagcaggatgacctgatgacagtgaagaccaatgagaccggctaccaggaggccatcgtgaaggagcctgagatcaacaccaccctgcagatgaggttcttcggcaagaggggccagaggaagctgcactacaaggagttccgccgcttcatggagaacctgcagacagagatccaggagatggagttcctgcagttcagcaagggcctgtccttcatgaggaaagaagattttgctgagtggctgctcttcttcaccaacacagagaacaaggacatctactggaagaatgtgcgggagaagctgtctgctggggagagcatcagcctggatgagttcaagagcttctgccacttcaccacccacctggaggactttgccatcgccatgcagatgttcagcctggcccacaggcctgtgcggctggccgagttcaagagagctgtgaaggtggccaccggccaggagctgagcaacaacatcctggacacagtgttcaagatctttgacctggatggagatgagtgcctgagccatgaggagttcctgggcgtgctgaagaacaggatgcaccggggcctgtgggtgccccagcaccagagcatccaggagtactggaagtgtgtgaagaaggagagcatcaagggcgtgaaggaggtgtggaagcaggccggcaagggcctcttctag

SEQ ID NO: 33991 - DNA, 1593 bp, Artificial Sequence
  Description of Artificial Sequence: Synthetic coding sequence
atggccgccctgcggcggctgctgtggcccccaccccgggtgagcccccccctgtgtgcccaccagcccctgctgggcccctggggccggcctgctgtgaccaccctgggcctgcccggccggcccttcagcagcagagaagatgaggagagagctgtggccgaggccgcctggaggagaagaagacgctggggcgagctgtctgtggccgctgctgctgggggcggcctggtgggcctggtgtgctaccagctgtatggagaccccagggctggcagccctgccaccggccggcccagcaagtctgctgccacagagcctgaggaccccccccggggccggggcatgctgcccatccctgtggccgccgccaaggagaccgtggccatcggccgcacagacatcgaggacctggacctgtatgccaccagccgggagcggcgcttccggctgtttgccagcattgaatgtgagggccagctgttcatgaccccctatgacttcatcctggccgtgaccacagatgagcccaaggtggccaagacctggaagagcctgagcaagcaggagctgaaccagatgctggccgagaccccacctgtgtggaagggcagcagcaagctgttcaggaacctgaaggagaagggcgtcatctcctacacagagtacctgttcctgctgtgcatcctgaccaagccccatgctggcttcagaattgccttcaacatgtttgacacagatggaaatgagatggtggacaagaaggagttcctggtgctgcaggagatcttcaggaagaagaatgagaagcgggagatcaagggagatgaggagaagagggccatgctgcggctgcagctgtatggctaccacagccccaccaacagcgtgctgaagacagatgctgaggagctggtgagccgcagctactgggacaccctgcggaggaacaccagccaggccctcttcagtgacctggccgagcgggcagatgacatcaccagcctggtgacagacaccaccctgctggtgcacttcttcggcaagaagggcaaggccgagctgaactttgaggacttctaccgcttcatggacaacctgcagacagaggtgctggagattgagttcctgagctacagcaatggcatgaacaccatcagtgaagaagattttgcccacatcctgctgcgctacaccaacgtggagaacacctctgtgttcctggagaatgtgcgctacagcatccctgaggagaagggcatcacctttgatgagttccgctccttcttccagttcctgaacaacctggaggactttgccatcgccctgaacatgtacaactttgccagccgcagcatcggccaggatgagttcaagagagctgtgtatgtggccaccggcctgaagttcagcccccacctggtgaacacagtgttcaagatctttgatgtggacaaggatgaccagctgagctacaaggagttcatcggcatcatgaaggaccggctgcaccggggcttccggggctacaagacagtgcagaagtaccccaccttcaagagctgcctgaagaaggagctgcacagcaggtag

SEQ ID NO: 33992 - DNA, 534 bp, Artificial Sequence
  Description of Artificial Sequence: Synthetic coding sequence
atgttcaagcagtatgatgctggaagagatggcttcatcgacctgatggagctgaagctgatgatggagaagctgggcgccccccagacccacctgggcctgaagaacatgatcaaggaggtggatgaagattttgacagcaagctgtccttccgggagttcctgctgatcttcaggaaggctgctgctggggagctgcaggaggacagcggcctgtgtgtgctggcccggctgtctgaaattgatgtgtccagtgaaggagtgaagggggccaagagcttctttgaggccaagtggaactgggtgtgccgctgggcccccaggacaggcagccggggcagcggctggcagcagctggagcggctgcccagcagcgccctggccctgcagcagccccagaacatcggccctggccaccagagggtgcagcccctgcggggcggggaccagggccgggccggcggcaaggaggaggccggcggcggagatgaagctgctgagagcggcctgcagggcgctgctgtgcacctgtag

SEQ ID NO: 33993 - DNA, 723 bp, Artificial Sequence
  Description of Artificial Sequence: Synthetic coding sequence
atggccacagatgagctggccaccaagctgagccggcggctgcagatggagggggagggcggcggggagaccccagagcagcccggcctgaatggagctgctgctgctgctgctggggccccagatgaggccgctgaggccctgggcagcgctgactgtgagctgagcgccaagctgctgcggcgggctgacctgaaccagggcattggagagccccagagccccagcagaagagtcttcaacccctacacagagttcaaggagttcagcaggaagcagatcaaggacatggagaagatgttcaagcagtatgatgctggaagagatggcttcatcgacctgatggagctgaagctgatgatggagaagctgggcgccccccagacccacctgggcctgaagaacatgatcaaggaggtggatgaggactttgacagcaagctgtccttccgggagttcctgctgatcttcaggaaggctgctgctggggagctgcaggaggacagcggcctgtgtgtgctggcccggctgtctgaaattgatgtgagcagcgagggcgtgaagggggccaagagcttctttgaggccaaggtgcaggccatcaacgtgagcagcagatttgaggaggagatcaaggccgagcaggaggagaggaagaagcaggccgaggagatgaagcagaggaaggccgccttcaaggagctgcagagcaccttcaagtag

SEQ ID NO: 33994 - DNA, 540 bp, Artificial Sequence
  Description of Artificial Sequence: Synthetic coding sequence
tgaaagatgttcaagcagtatgatgctggaagagatggcttcatcgacctgatggagctgaagctgatgatggagaagctgggcgccccccagacccacctgggcctgaagaacatgatcaaggaggtggatgaagattttgacagcaagctgtccttccgggagttcctgctgatcttcaggaaggctgctgctggggagctgcaggaggacagcggcctgtgtgtgctggcccggctgtctgaaattgatgtgtccagtgaaggagtgaagggggccaagagcttctttgaggccaagtggaactgggtgtgccgctgggcccccaggacaggcagccggggcagcggctggcagcagctggagcggctgcccagcagcgccctggccctgcagcagccccagaacatcggccctggccaccagagggtgcagcccctgcggggcggggaccagggccgggccggcggcaaggaggaggccggcggcggagatgaagctgctgagagcggcctgcagggcgctgctgtgcacctgtag

SEQ ID NO: 33995 - DNA, 2073 bp, Artificial Sequence
  Description of Artificial Sequence: Synthetic coding sequence
atgaagaggctgcccctgctggtggtgttcagcaccctgctgaactgcagctacacccagaactgcaccaagaccccctgcctgcccaatgccaagtgtgagatcagaaatggaattgaggcctgctactgcaacatgggcttctctggaaatggagtgaccatctgtgaagatgacaatgaatgtggcaacctgacccagagctgtggagaaaatgccaactgcaccaacacagagggcagctactactgcatgtgtgtgcccggcttccgcagcagcagcaaccaggaccgcttcatcaccaatgatggcaccgtgtgcattgaaaatgtgaatgccaactgccacctggacaacgtgtgcatcgccgccaacatcaacaagaccctgaccaagatccgcagcatcaaggagcctgtggccctgctgcaggaggtgtacagaaacagcgtgacagacctgagccccacagacatcatcacctacatcgagatcctggccgagagcagcagcctgctgggctacaagaacaacaccatcagcgccaaggacaccctgagcaacagcaccctgacagaatttgtgaagacagtgaacaactttgtgcagagggacacctttgtggtgtgggacaagctgtctgtgaaccacaggaggacccacctgaccaagctgatgcacacagtggagcaggccaccctgcgcatcagccagagcttccagaagaccacagaatttgacaccaacagcacagacatcgccctgaaggtgttcttctttgacagctacaacatgaagcacatccacccccacatgaacatggatggagactacatcaacatcttccccaagaggaaggccgcctatgacagcaatggaaatgtggccgtggcctttgtgtactacaagagcatcggccccctgctgagcagcagtgacaacttcctgctgaagccccagaactatgacaacagcgaggaggaggagagggtcatcagcagcgtcatctctgtgtccatgagcagcaacccccccaccctgtatgagctggagaagatcaccttcaccctgagccacaggaaggtgacagaccgctaccgcagcctgtgtgccttctggaactacagcccagacaccatgaatggctcctggagcagcgagggctgtgagctgacctacagcaatgagacccacaccagctgccgctgcaaccacctgacccactttgccatcctgatgagcagcggccccagcatcggcatcaaggactacaacatcctgacccgcatcacccagctgggcatcatcatcagcctcatctgcctggccatctgcatcttcaccttctggttcttcagcgagatccagagcaccaggaccaccatccacaagaacctgtgctgcagcctcttcctggccgagctggtgttcctggtgggcatcaacaccaacaccaacaagctgttctgcagcatcatcgccggcctgctgcactacttcttcctggccgcctttgcctggatgtgcatcgagggcatccacctgtacctgattgtggtgggcgtcatctacaacaagggcttcctgcacaagaacttctacatcttcggctacctgagccctgctgtggtggtgggcttctctgctgccctgggctaccgctactacggcaccaccaaggtgtgctggctgagcacagagaacaacttcatctggagcttcatcggccctgcctgcctgatcatcctggtgaacctgctggcctttggagtcatcatctacaaggtgttccgccacacagctggcctgaagccagaggtgtcctgctttgagaacatccgcagctgtgcccggggggccctggccctgctcttcctgctgggcaccacctggatctttggagtgctgcacgtggtgcacgcctctgtggtgacagcctacctgttcaccgtgtccaatgccttccagggcatgttcatcttcctgttcctgtgtgtgctgagcaggaagatccaggaggagtactaccgcctcttcaagaatgtgccctgctgcttcggctgcctgaggtag

SEQ ID NO: 33996 - DNA, 450 bp, Artificial Sequence
  Description of Artificial Sequence: Synthetic coding sequence
gtggtggtgggcttctctgctgccctgggctaccgctactacggcaccaccaaggtgtgctggctgagcacagagaacaacttcatctggagcttcatcggccctgcctgcctgatcatcctggtgaacctgctggcctttggagtcatcatctacaaggtgttccgccacacagctggcctgaagccagaggtgtcctgctttgagaacatccgcagctgtgcccggggggccctggccctgctcttcctgctgggcaccacctggatctttggagtgctgcacgtggtgcacgcctctgtggtgacagcctacctgttcaccgtgtccaatgccttccagggcatgttcatcttcctgttcctgtgtgtgctgagcaggaagatccaggaggagtactaccgcctcttcaagaatgtgccctgctgcttcggctgcctgagctgctag

SEQ ID NO: 33997 - DNA, 2472 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtgaatgaatgtaccagcggccagaacccctgccacagcagcacccactgcctgaacaacgtgggcagctaccagtgccgctgcaggcctggctggcagcccatccctggcagccccaacggccccaacaacacagtgtgtgaagatgtggatgaatgtagcagcggccagcaccagtgtgacagcagcacagtgtgcttcaacacagtgggcagctacagctgccgctgccggcccggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggccccagcgtggtgggcctggtgtccatccctggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccacaggagcgtcatcccccggcagaaggtgctgtgtgtgttctgggagcacggccagaatggctgcggccactgggccaccaccggctgcagcaccatcggcacccgggacaccagcaccatctgccgctgcacccacctgagcagctttgctgtgctgatggcccactatgatgtgcaggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctacggcgtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagaaagtgagatgcacaccctgagcagcagcgccaaggctgacaccagcaagcccagcacagtgaactag

SEQ ID NO: 33998 - DNA, 2472 bp, Artificial Sequence; identical to SEQ ID NO: 33997
  Description of Artificial Sequence: Synthetic coding sequence

SEQ ID NO: 33999 - DNA, 2325 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtggatgagtgcagcagcggccagcaccagtgtgacagcagcacagtgtgcttcaacacagtgggcagctacagctgccgctgcaggcctggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggccccagcgtggtgggcctggtgtccatccctggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccacaggagcgtcatcccccggcagaaggtgctgtgtgtgttctgggagcacggccagaatggctgcggccactgggccaccaccggctgcagcaccatcggcacccgggacaccagcaccatctgccgctgcacccacctgagcagctttgctgtgctgatggcccactatgatgtgcaggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctatggagtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagagagcgagatgcacaccctgagcagcagcgccaaggctgacaccagcaagcccagcacagtgaactag

SEQ ID NO: 34000 - DNA, 2046 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggccccagcgtggtgggcctggtgtccatccctggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccacaggagcgtcatcccccggcagaaggtgctgtgtgtgttctgggagcacggccagaatggctgcggccactgggccaccaccggctgcagcaccatcggcacccgggacaccagcaccatctgccgctgcacccacctgagcagctttgctgtgctgatggcccactatgatgtgcaggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctacggcgtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagaaagtgagatgcacaccctgagcagcagcgccaaggctgacaccagcaagcccagcacagtgaactag

SEQ ID NO: 34001 - DNA, 2193 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgcagcagcggccagcaccagtgtgacagcagcacagtgtgcttcaacacagtgggcagctacagctgccgctgcaggcctggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggccccagcgtggtgggcctggtgtccatccctggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccacaggagcgtcatcccccggcagaaggtgctgtgtgtgttctgggagcacggccagaatggctgcggccactgggccaccaccggctgcagcaccatcggcacccgggacaccagcaccatctgccgctgcacccacctgagcagctttgctgtgctgatggcccactatgatgtgcaggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctatggagtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagagagcgagatgcacaccctgagcagcagcgccaaggctgacaccagcaagcccagcacagtgaactag

SEQ ID NO: 34002 - DNA, 720 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtgaatgaatgtaccagcggccagaacccctgccacagcagcacccactgcctgaacaacgtgggcagctaccagtgccgctgcaggcctggctggcagcccatccctggcagccccaacggccccaacaacacagtgtgtgagggccgggagctgcggagccacgtgccccgggacccccagaccagtgaccacatgtttaatggagcccacaccaaccaggccgagtag

SEQ ID NO: 34003 - DNA, 1140 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtggatgagtgcagcagcggccagcaccagtgtgacagcagcacagtgtgcttcaacacagtgggcagctacagctgccgctgcaggcctggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggcggcggcagcagagctgactgccaccacctgcacggggctgagcggctgtctgctgtgcccccacctgggggcccccacttcagccctgtgtag

SEQ ID NO: 34004 - DNA, 678 bp, Artificial Sequence
  Description of Artificial Sequence: Synthetic coding sequence
atgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccctgtgtctgaccctgagacagagggcgccctgtgcctgctgggcgcctggccagagtggatgtggagcctgggccaccaccggctgcagcacaacagacaccagaggcaccagcaccacctgcccctgcaccccccagagcagctgtgccggccccacggccccctgcgctgtgccggcggcggcagcagagctgactgccaccacctgcacggggctgagcggctgtctgctgtgcccccacctgggggcccccacttcagccctgtgtag

SEQ ID NO: 34005 - DNA, 2298 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtgaatgaatgtaccagcggccagaacccctgccacagcagcacccactgcctgaacaacgtgggcagctaccagtgccgctgcaggcctggctggcagcccatccctggcagccccaacggccccaacaacacagtgtgtgaagatgtggatgaatgtagcagcggccagcaccagtgtgacagcagcacagtgtgcttcaacacagtgggcagctacagctgccgctgccggcccggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggccccagcgtggtgggcctggtgtccatccctggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccaccgggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctacggcgtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagaaagtgagatgcacaccctgagcagcagcgccaaggctgacaccagcaagcccagcacagtgaactag

SEQ ID NO: 34006 - DNA, 2439 bp, Artificial Sequence
  Description of Artificial Sequence: Synthetic coding sequence
atgggcggccgggtcttcctggtgttcctggccttctgtgtgtggctgaccctgcctggagctgagacccaggacagccggggctgtgcccgctggtgcccccaggacagcagctgtgtgaatgccacagcctgccgctgcaaccctggcttcagcagcttcagcgagatcatcaccacccccatggagacctgtgatgacatcaatgaatgtgccaccctgagcaaggtgtcctgtgggaagttcagtgactgctggaacacagagggcagctatgactgtgtgtgcagccctggctatgagcctgtgtctggggccaagaccttcaagaatgaaagtgagaacacctgccaggatgtggatgagtgccagcagaacccccggctgtgcaagagctatggcacctgtgtgaacaccctgggcagctacacctgccagtgcctgcccggcttcaagctgaagccagaggaccccaagctgtgcacagatgtgaatgaatgtaccagcggccagaacccctgccacagcagcacccactgcctgaacaacgtgggcagctaccagtgccgctgcaggcctggctggcagcccatccctggcagccccaacggccccaacaacacagtgtgtgaagatgtggatgaatgtagcagcggccagcaccagtgtgacagcagcacagtgtgcttcaacacagtgggcagctacagctgccgctgccggcccggctggaagcccaggcatggcatccccaacaaccagaaggacacagtgtgtgaggacatgaccttcagcacctggaccccacctcctggggtgcacagccagaccctgagccgcttctttgacaaggtgcaggacctgggccgggactacaagccaggcctggccaacaacaccatccagagcatcctgcaggccctggatgagctgctggaggcccctggggacctggagaccctgccccggctgcagcagcactgtgtggccagccacctgctggatggcctggaggatgtgctgcggggcctgagcaagaacctgagcaatggcctgctgaacttctcctacccagctggaacagagctgagcctggaggtgcagaagcaggtggacagatctgtgaccctgcggcagaaccaggccgtgatgcagctggactggaaccaggcccagaagagcggggaccccggcatgggcaagctgctggccgaggcccccctggtgctggagcctgagaagcagatgctgctgcacgagacccaccagggcctgctgcaggacggcagccccatcctgctgagtgatgtgatcagcgccttcctgagcaacaatgacacccagaacctgagcagccctgtgaccttcaccttcagccacaggagcgtcatcccccggcagaaggtgctgtgtgtgttctgggagcacggccagaatggctgcggccactgggccaccaccggctgcagcaccatcggcacccgggacaccagcaccatctgccgctgcacccacctgagcagctttgctgtgctgatggcccactatgatgtgcaggaggaggaccctgtgctgaccgtcatcacctacatgggcctgtctgtgtccctgctgtgcctgctgctggccgccctgaccttcctgctgtgcaaggccatccagaacaccagcaccagcctgcacctgcagctgagcctgtgcctcttcctggcccacctgctcttcctggtggccatcgaccagacaggccacaaggtgctgtgcagcatcatcgccggcaccctgcactacctgtacctggccaccctgacctggatgctgctggaggccctgtacctgttcctgacagccaggaacctgactgtggtgaactacagcagcatcaaccgcttcatgaagaagctgatgtttcctgtgggctatggagtgcctgctgtgacagtggccatctctgctgccagccggccccacctgtatggcacccccagccgctgctggctgcagcctgagaagggcttcatctggggcttcctgggccctgtgtgtgccatcttctctgtgaacctggtgctcttcctggtgaccctgtggatcctgaagaaccggctgagcagcctgaacagcgaggtgtccaccctgaggaacaccaggatgctggccttcaaggccacagcccagctgttcatcctgggctgcacctggtgcctgggcatcctgcaggtgggccctgctgcccgggtgatggcctacctgttcaccatcatcaacagcctgcagggcgtcttcatcttcctggtgtactgcctgctgagccagcaggtgcgggagcagtatggcaagtggagcaagggcatcaggaagctgaagacagagagcgagatgcacaccctgagcagcagcgccaaggctgacaccagcaagcccagcacagtgaactag

SEQ ID NO: 34007 - DNA, 2874 bp, Artificial Sequence
  Description of Artificial Sequence: Synthetic coding sequence
atgtatggcagcgcccggaccatcaccaacctggagggcagccccagccgcagcccccggctgcccaggagcccccggctgggccacaggaggaccagcagcggcggcggcggcggcaccgggaagaccctgtccatggagaacatccagagcctgaatgctgcctatgccaccagcggccccatgtacctgagtgaccatgaaggagtggccagcaccacctaccccaagggcaccatgaccctgggccgggccaccaacagagctgtgtatggaggccgggtgacagccatgggcagcagccccaacatcgccagcgctggcctgagccacacagatgtgctgagctacacagaccagcacggcggcctgaccggcagcagccaccaccaccaccaccaggtgcccagcatgctgcggcaggtgcgggacagcaccatgctggacctgcaggcccagctgaaggagctgcagcgggagaatgacctgctgaggaaggagctggacatcaaggacagcaagctgggcagctccatgaacagcatcaagaccttctggagccctgagctgaagaaggagcgggtgctgaggaaggaggaggccgccaggatgtctgtgctgaaggagcagatgagggtgtcccatgaggagaaccagcacctgcagctgaccatccaggccctgcaggatgagctgcggacccagagggacctgaaccacctgctgcagcaggagagcggcaacagaggagctgagcacttcaccatcgagctgacagaggagaacttccggcggctgcaggccgagcatgaccggcaggccaaggagctgttcctgctgaggaagaccctggaggagatggagctgagaattgagacccagaagcagaccctgaatgccagagatgagagcatcaagaagctgctggagatgctgcagagcaagggcctgcccagcaagagcctggaggatgacaatgaaagaaccaggaggatggccgaggccgagagccaggtgagccacctggaggtgatcctggaccagaaggagaaggagaacatccacctgcgggaggagctgcaccggcgcagccagctgcagcctgagcccgccaagaccaaggccctgcagaccgtcatcgagatgaaggacaccaagatcgccagcctggagaggaacatccgggacctggaggatgagatccagatgctgaaggccaatggagtgctgaacacagaagatcgggaggaggagatcaagcagatcgaggtgtacaagagccacagcaagttcatgaagaccaagattgaccagctgaagcaggagctgagcaagaaggagagcgagctgctggccctgcagaccaagctggagaccctgagcaaccagaacagcgactgcaagcagcacatcgaggtgctgaaggagagcctgacagccaaggagcagagagctgccatcctgcagacagaggtggatgccctgcggctgcggctggaggagaaggagagcttcctgaacaagaagaccaagcagctgcaggacctgacagaggagaagggcaccctggccggggagatccgggacatgaaggacatgctggaggtgaaggagaggaagatcaacgtgctgcagaagaagattgagaacctgcaggagcagctgcgggacaaggacaagcagctgaccaacctgaaggacagagtgaagagcctgcagacagacagcagcaacacagacacagccctggccaccctggaggaggccctgtctgagaaggagcgcatcatcgagcggctgaaggagcagcgggagagagatgaccgggagcggctggaggagattgagagcttcagaaaagaaaacaaggacctgaaggagaaggtgaatgccctgcaggccgagctgacagagaaggagagcagcctgattgacctgaaggagcacgccagcagcctggccagcgctggcctgaagagggacagcaagctgaagagcctggagatcgccatcgagcagaagaaggaggagtgcagcaagctggaggcccagctgaagaaggcccacaacattgaagatgacagcaggatgaaccctgagtttgctgaccagatcaagcagctggacaaggaggccagctactacagagatgaatgtgggaaggcccaggccgaggtggaccggctgctggagatcctgaaggaggtggagaatgagaagaatgacaaggacaagaagattgctgagctggagagcctgaccctgcggcacatgaaggaccagaacaagaaggtggccaacctgaagcacaaccagcagctggagaagaagaagaatgcccagctgctggaggaggtgagaagaagagaggacagcatggctgacaacagccagcacctgcagatcgaggagctgatgaatgccctggagaagacccggcaggagctggatgccaccaaggcccggctggccagcacccagcagagcctggccgagaaggaggcccacctggccaacctgcgcatcgagaggaggaagcagctggaggagatcctggagatgaagcaggaggccctgctggccgccatcagcgagaaggatgccaacatcgccctgctggagctgagcgccagcaagaagaagaagacccaggaggaggtgatggccctgaagcgggagaaggaccggctggtgcaccagctgaagcagcagacccagaacaggatgaagctgatggctgacaactatgatgatgaccaccaccactaccaccaccaccaccaccaccaccaccacaggagccctggccgcagccagcacagcaaccaccggcccagcccagaccaggatgatgaggagggcatctgggcctag

SEQ ID NO: 34008 - DNA, 2874 bp, Artificial Sequence; identical to SEQ ID NO: 34007
  Description of Artificial Sequence: Synthetic coding sequence

SEQ ID NO: 34009 - DNA, 1587 bp, Artificial Sequence
  Description of Artificial Sequence: Synthetic coding sequence
tgaagaagccagctgcagcctgagcccgccaagaccaaggccctgcagacagtgattgagatgaaggacaccaagatcgccagcctggagaggaacatccgggacctggaggatgagatccagatgctgaaggccaacggggtgctgaacacagaggaccgggaggaggagatcaagcagatcgaggtgtacaagagccacagcaagttcatgaagaccaagattgaccagctgaagcaggagctgagcaagaaggagagcgagctgctggccctgcagaccaagctggagaccctgagcaaccagaacagcgactgcaagcagcacatcgaggtgctgaaggagagcctgacagccaaggagcagagagctgccatcctgcagacagaggtggatgccctgcggctgcggctggaggagaaggagagcttcctgaacaagaagaccaagcagctgcaggacctgacagaggagaagggcaccctggccggggagatccgggacatgaaggacatgctggaggtgaaggagaggaagatcaacgtgctgcagaagaagattgagaacctgcaggagcagctgcgggacaaggacaagcagctgaccaacctgaaggacagagtgaagagcctgcagacagacagcagcaacacagacacagccctggccaccctggaggaggccctgtctgagaaggagcgcatcatcgagcggctgaaggagcagcgggagagagatgaccgggagcggctggaggagattgagagcttcaggaaggagaacaaggacctgaaggagaaggtgaatgccctgcaggccgagctgacagagaaggagagcagcctgattgacctgaaggagcacgccagcagcctggccagcgctggcctgaagagggacagcaagctgaagagcctggagatcgccatcgagcagaagaaggaggagtgcagcaagctggaggcccagctgaagaagcaggccgagcagctgttcaaccagatgtacaacccagcccacaacattgaagatgacagcaggatgaaccctgagtttgctgaccagatcaagcagctggacaaggaggccagctactacagagatgaatgtgggaaggcccaggccgaggtggaccggctgctggagatcctgaaggaggtggagaatgagaagaatgacaaggacaagaagattgctgagctggagcggcacatgaaggaccagaacaagaaggtggccaacctgaagcacaaccagcagctggagaagaagaagaatgcccagctgctggaggaggtgagaagaagagaagattccatggctgacaacagccagcacctgcagatcgaggagctgatgaatgccctggagaagacccggcaggagctggatgccaccaaggcccggctggccagcacccagcagagcctggccgagaaggaggcccacctggccaacctgagaattgaaagaaggaagcagctggaggagatcctggagatgaagcaggaggccctgctggccgccatcagcgagaaggatgccaacatcgccctgctggagctgagcgccagcaagaagaagtag

SEQ ID NO: 34010 - DNA, 984 bp, Artificial Sequence
  Description of Artificial Sequence: Synthetic coding sequence
atgagggccctgcccggcctgctggaggcccgggcccggaccccccggctgctgctgctgcagtgcctgctggccgccgcccggcccagcagcgcagatggcagcgccccagacagccccttcaccagcccccccctgcgggaggagatcatggccaacaacttcagcctggagagccacaacatcagcctgacagagcacagctccatgcctgtggagaagaacatcaccctggagcggcccagcaatgtgaacctgacctgccagttcaccaccagcggggacctgaatgctgtgaatgtgacctggaagaaggatggagagcagctggagaacaactacctggtgtctgccaccggcagcaccctgtacacccagtaccgcttcaccatcatcaacagcaagcagatgggcagctacagctgcttcttccgggaggagaaggagcagaggggcaccttcaacttcaaggtgcctgagctgcacggcaagaacaagcccctcatctcctatgtgggggacagcacagtgctgacctgcaagtgccagaactgcttccccctgaactggacctggtacagcagcaatggatctgtgaaggtgcctgtgggcgtgcagatgaacaagtatgtgatcaatggcacctacgccaatgagaccaagctgaagatcacccagctgctggaggaggatggagagagctactggtgccgggccctcttccagctgggggagagcgaggagcacatcgagctggtggtgctgagctacctggtgcccctgaagcccttcctggtgattgtggccgaggtgatcctgctggtggccaccatcctgctgtgtgagaagtacacccagaagaagaagaagcacagtgatgagggcaaggagtttgagcagatcgagcagctgaagagtgatgacagcaatggaattgaaaataatgtgcccaggcacaggaagaatgaaagcctgggccagtag

SEQ ID NO: 34011 - DNA, 621 bp, Artificial Sequence
  Description of Artificial Sequence: Synthetic coding sequence
atgggcgctgagtgggagctgggcgctgaggccggcggcagcctgctgctgtgtgccgccctgctggccgccggctgtgccctgggcctgcggctgggccggggccagggcgctgctgacagaggagccctgatctggctgtgctatgatgccctggtgcactttgccctggagggcccctttgtgtacctgagcctggtgggcaatgtggccaacagtgatggcctgattgccagcctgtggaaggagtatggcaaggcagatgcccgctgggtgtactttgaccccaccatcgtgtctgtggagatcctgactgtggccctggatggcagcctggccctcttcctgatctatgccatcgtgaaggagaagtactaccgccacttcctgcagatcaccctgtgtgtgtgtgagctgtatggctgctggatgaccttcctgcctgagtggctgaccaggagccccaacctgaacaccagcaactggctgtactgctggctgtacctgttcttcttcaatggagtgtgggtgctgatccctggcctgctgctgtggcagagctggctggagctgaagaagatgcaccagaaggagaccagctctgtgaagaagttccagtag

SEQ ID NO: 34012 - DNA, 261 bp, Artificial Sequence
  Description of Artificial Sequence: Synthetic coding sequence
atgggcgctgagtgggagctgggcgctgaggccggcggcagcctgctgctgtgtgccgccctgctggccgccggctgtgccctgggcctgcggctgggccggggccagggcgctgctgacagaggagccctgatctggctgtgctatgatgccctggtgcactttgccctggagcgggtgggcaagaccaccaaccaggagagcgctggggtgctgggcagcacagagtggaacttcaagaacacagacaagctgctgtag

SEQ ID NO: 34013 - DNA, 1257 bp, Artificial Sequence
  Description of Artificial Sequence: Synthetic coding sequence
atggccaccagcgagcagagcatctgccaggcccgggcctctgtgatggtgtatgatgacaccagcaagaagtgggtgcccatcaagccaggccagcagggcttcagccgcatcaacatctaccacaacacagccagcaacaccttccgggtggtgggcgtgaagctgcaggaccagcaggtggtgatcaactacagcatcgtgaagggcctgaagtacaaccaggccacccccaccttccaccagtggagagatgcccggcaggtgtatggcctgaactttgccagcaaggaggaggccaccaccttcagcaatgccatgctgtttgccctgaacatcatgaacagccaggagggcggccccagcagccagaggcaggtgcagaatggccccagcccagatgagatggacatccagaggcggcaggtgatggagcagcaccagcagcagaggcaggagagcctggagaggaggaccagcgccaccggccccatcctgcccccaggccaccccagcagcgctgccagcgcccctgtgtcctgcagcggccccccacctcctcctcctcctcctgtgcccccacctccaactggagccaccccacctcctcctccacccctgcctgctggaggagcccagggcagcagccatgatgagagctccatgagcggcctggccgccgccatcgccggggccaagctgcggcgggtgcagaggccagaagatgccagcggcggcagcagccccagcggcaccagcaagagtgatgccaacagagccagcagcggcggcggcggcggcggcctgatggaggagatgaacaagctgctggccaagaggaggaaggccgccagccagagcgacaagccagctgagaagaaggaggatgagagccagatggaggaccccagcaccagccccagccctggcaccagggctgccagccagccccccaacagcagcgaggccggcaggaagccctgggagaggagcaacagcgtggagaagcctgtgagcagcatcctgagcaggaccccatctgtggccaagagccctgaggccaagagccccctgcagagccagccccacagcaggatgaagccagctggctctgtgaatgacatggccctggatgcctttgacctggacaggatgaagcaggagatcctggaggaggtggtgcgggagctgcacaaggtgaaggaggagatcattgatgccatccggcaggagctgagcggcatcagcaccacctag

SEQ ID NO: 34014 - DNA, 1251 bp, Artificial Sequence
  Description of Artificial Sequence: Synthetic coding sequence
atgtctgagcagagcatctgccaggcccgggcctctgtgatggtgtatgatgacaccagcaagaagtgggtgcccatcaagccaggccagcagggcttcagccgcatcaacatctaccacaacacagccagcaacaccttccgggtggtgggcgtgaagctgcaggaccagcaggtggtgatcaactacagcatcgtgaagggcctgaagtacaaccaggccacccccaccttccaccagtggagagatgcccggcaggtgtatggcctgaactttgccagcaaggaggaggccaccaccttcagcaatgccatgctgtttgccctgaacatcatgaacagccaggagggcggccccagcagccagaggcaggtgcagaatggccccagcccagatgagatggacatccagaggcggcaggtgatggagcagcaccagcagcagaggcaggagagcctggagaggaggaccagcgccaccggccccatcctgcccccaggccaccccagcagcgctgccagcgcccctgtgtcctgcagcggccccccacctcctcctcctcctcctgtgcccccacctccaactggagccaccccacctcctcctccacccctgcctgctggaggagcccagggcagcagccatgatgagagctccatgagcggcctggccgccgccatcgccggggccaagctgcggcgggtgcagaggccagaagatgccagcggcggcagcagccccagcggcaccagcaagagtgatgccaacagagccagcagcggcggcggcggcggcggcctgatggaggagatgaacaagctgctggccaagaggaggaaggccgccagccagagcgacaagccagctgagaagaaggaggatgagagccagatggaggaccccagcaccagccccagccctggcaccagggctgccagccagccccccaacagcagcgaggccggcaggaagccctgggagaggagcaacagcgtggagaagcctgtgagcagcatcctgagcaggaccccatctgtggccaagagccctgaggccaagagccccctgcagagccagccccacagcaggatgaagccagctggctctgtgaatgacatggccctggatgcctttgacctggacaggatgaagcaggagatcctggaggaggtggtgcgggagctgcacaaggtgaaggaggagatcattgatgccatccggcaggagctgagcggcatcagcaccacctag

SEQ ID NO: 34015 - DNA, 1146 bp, Artificial Sequence
  Description of Artificial Sequence: Synthetic coding sequence
atggccaccagcgagcagagcatctgccaggcccgggcctctgtgatggtgtatgatgacaccagcaagaagtgggtgcccatcaagccaggccagcagggcttcagccgcatcaacatctaccacaacacagccagcaacaccttccgggtggtgggcgtgaagctgcaggaccagcaggtggtgatcaactacagcatcgtgaagggcctgaagtacaaccaggccacccccaccttccaccagtggagagatgcccggcaggtgtatggcctgaactttgccagcaaggaggaggccaccaccttcagcaatgccatgctgtttgccctgaacatcatgaacagccaggagggcggccccagcagccagaggcaggtgcagaatggccccagcccagatgagatggacatccagaggcggcaggtgatggagcagcaccagcagcagaggcaggagagcctggagaggaggaccagcgccaccggccccatcctgcccccaggccaccccagcagcgctgccagcgcccctgtgtcctgcagcggggcccccagcggcctggccgccgccatcgccggggccaagctgcggcgggtgcagaggccagaagatgccagcggcggcagcagccccagcggcaccagcaagagtgatgccaacagagccagcagcggcggcggcggcggcggcctgatggaggagatgaacaagctgctggccaagaggaggaaggccgccagccagagcgacaagccagctgagaagaaggaggatgagagccagatggaggaccccagcaccagccccagccctggcacccgggccgccagccagccccccaacagcagcgaggccggcaggaagccctgggagaggagcaacagcgtggagaagcctgtgagcagcatcctgagcaggacccccagcgtggccaagagccctgaggccaagagccccctgcagagccagccccacagcaggatgaagccagctggctctgtgaatgacatggccctggatgcctttgacctggacaggatgaagcaggagatcctggaggaggtggtgcgggagctgcacaaggtgaaggaggagatcattgatgccatccggcaggagctgagcggcatcagcaccacctag

SEQ ID NO: 34016 - DNA, 1173 bp, Artificial Sequence
  Description of Artificial Sequence: Synthetic coding sequence
atgtttgcctttgaggagttcagcgagcagagcatctgccaggcccgggcctctgtgatggtgtatgatgacaccagcaagaagtgggtgcccatcaagccaggccagcagggcttcagccgcatcaacatctaccacaacacagccagcaacaccttccgggtggtgggcgtgaagctgcaggaccagcaggtggtgatcaactacagcatcgtgaagggcctgaagtacaaccaggccacccccaccttccaccagtggagagatgcccggcaggtgtatggcctgaactttgccagcaaggaggaggccaccaccttcagcaatgccatgctgtttgccctgaacatcatgaacagccaggagggcggccccagcagccagaggcaggtgcagaatggccccagcccagatgagatggacatccagaggcggcaggtgatggagcagcaccagcagcagaggcaggagagcctggagaggaggaccagcgccaccggccccatcctgcccccaggccaccccagcagcgctgccagcgcccctgtgtcctgcagcggccccccacctcctcctcctcctcctgtgcccccacctccaactggagccaccccacctcctcctccacccctgcctgctggaggagcccagggcagcagccatgatgagagctccatgagcggcctggccgccgccatcgccggggccaagctgcggcgggtgcagaggccagaagatgccagcggcggcagcagccccagcggcaccagcaagagtgatgccaacagagccagcagcggcggcggcggcggcggcctgatggaggagatgaacaagctgctggccaagaggaggaaggccgccagccagagcgacaagccagctgagaagaaggaggatgagagccagatggaggaccccagcaccagccccagccctggcaccagggctgccagccagccccccaacagcagcgaggccggcaggaagccctgggagaggagcaacagcgtggagaagcctgtgagcagcatcctgagcaggaccccatctgtggccaagagccctgaggccaagagccccctgcagagccagccccacagccgctaccgcaccaccctgctgctgacctgccccccaggctttggagcccccctgagccctgtgccctag

SEQ ID NO: 34017 - DNA, 639 bp, Artificial Sequence
  Description of Artificial Sequence: Synthetic coding sequence
cctcctcctcctcctcctgtgcccccaccacccaccggggccaccccacctcctcctccacccctgcctgctgggggcgcccagggcagcagccatgatgagagctccatgagcggcctggccgccgccatcgccggggccaagctgcggcgggtgcagaggccagaagatgccagcggcggcagcagccccagcggcaccagcaagagtgatgccaacagagccagcagcggcggcggcggcggcggcctgatggaggagatgaacaagctgctggccaagaggaggaaggccgccagccagagcgacaagccagctgagaagaaggaggatgagagccagatggaggaccccagcaccagccccagccctggcacccgggccgccagccagccccccaacagcagcgaggccggcaggaagccctgggagaggagcaacagcgtggagaagcctgtgagcagcatcctgagcaggatgaagccagctggctctgtgaatgacatggccctggatgcctttgacctggacaggatgaagcaggagatcctggaggaggtggtgcgggagctgcacaaggtgaaggaggagatcattgatgccatccggcaggagctgagcggcatcagcaccacctag

SEQ ID NO: 34018 - DNA, 1617 bp, Artificial Sequence
  Description of Artificial Sequence: Synthetic coding sequence
atgggcctgctgctgctggtgctgatcctgacccccagcctggccgcctaccgccacccagacttccccctgctggagaaggcccagcagctgctgcagagcacaggcagcccctacagcaccaactgctggctgtgcaccagcagcagcacagagaccccaggcacagcctacccagccagcccccgggagtggaccagcattgaggccgagctgcacatctcctaccgctgggaccccaacctgaagggcctgatgaggcctgccaacagcctgctgagcacagtgaagcaggacttcccagacatccggcagaagccacccatcttcggccccatcttcaccaacatcaacctgatgggcatcgcccccatctgtgtgatggccaagaggaagaatggcaccaacgtgggcaccctgcccagcacagtgtgcaatgtgaccttcaccgtggacagcaaccagcagacctaccagacctacacccacaaccagttccgccaccagccccgcttccccaagccacccaacatcaccttcccccagggcaccctgctggacaagagcagccgcttctgccagggccggcccagcagctgcagcaccaggaacttctggttccggcctgctgactacaaccagtgcctgcagatcagcaacctgagcagcacagctgagtgggtgctgctggaccagaccaggaacagcctcttctgggagaacaagaccaagggggccaaccagagccagaccccctgtgtgcaggtgctggccggcatgaccatcgccaccagctacctgggcatctctgctgtgtctgagttcttcggcaccagcctgacccccctcttccacttccacatcagcacctgcctgaagacccagggcgccttctacatctgtggccagagcatccaccagtgcctgcccagcaactggacaggcacctgcaccatcggctacgtgaccccagacatcttcatcgcccctggcaacctgagcctgcccatccccatctacggcaacagccccctgccccgggtgagaagagccatccacttcatccccctgctggccggcctgggcatcctggccggcactggaactggaattgctggcatcaccaaggccagcctgacctacagccagctgagcaaggagatcgccaacaacatcgacaccatggccaaggccctgaccaccatgcaggagcagattgacagcctggccgctgtggtgctgcagaacagaagaggcctggacatgctgacagctgcccagggcggcatctgcctggccctggatgagaagtgctgcttctgggtgaaccagagcggcaaggtgcaggacaacatccggcagctgctgaaccaggccagcagcctgcgggagcgggccacccagggctggctgaactgggagggcacctggaagtggttctcctgggtgctgcccctgaccggccccctggtgtccctgctgctgctgctgctgtttggcccctgcctgctgaacctgatcacccagtttgtgagcagccggctgcaggccatcaagctgcagaccaacctgtctgctggccgccaccccaggaacatccaggagagccccttctag

SEQ ID NO: 34019 - DNA, 1617 bp, Artificial Sequence; identical to SEQ ID NO: 34018
  Description of Artificial Sequence: Synthetic coding sequence

SEQ ID NO: 34020 - DNA, 1617 bp, Artificial Sequence
  Description of Artificial Sequence: Synthetic coding sequence
atggccctgccctaccacatcttcctgttcaccgtgctgctgcccagcttcaccctgacagcccccccaccctgccgctgcatgaccagcagcagcccctaccaggagttcctgtggaggatgcagaggcctggcaacattgatgcccccagctaccgcagcctgagcaagggcacccccaccttcaccgcccacacccacatgcccaggaactgctaccacagcgccaccctgtgcatgcacgccaacacccactactggacaggcaagatgatcaaccccagctgccctgggggcctgggcgtgacagtgtgctggacctacttcacccagacaggcatgtctgatggcggcggcgtgcaggaccaggcccgggagaagcacgtgaaggaggtgatcagccagctgaccagggtgcacggcaccagcagcccctacaagggcctggacctgagcaagctgcacgagaccctgcggacccacacccggctggtgtccctcttcaacaccaccctgaccggcctgcacgaggtgtctgcccagaaccccaccaactgctggatctgcctgcccctgaacttccggccctacgtgtccatccctgtgcctgagcagtggaacaacttcagcacagagatcaacaccacctctgtgctggtgggccccctggtgagcaacctggagatcacccacaccagcaacctgacctgtgtgaagttcagcaacaccacctacaccaccaacagccagtgcatccgctgggtgaccccacccacccagatcgtgtgcctgcccagcggcatcttctttgtgtgtggcaccagcgcctaccgctgcctgaatggcagcagcgagagcatgtgcttcctgtccttcctggtgccccccatgaccatctacacagagcaggacctgtacagctatgtgatcagcaagcccaggaacaagagggtgcccatcctgccctttgtgattggagctggggtgctgggcgccctgggcactggaattggaggcatcaccaccagcacccagttctactacaagctgagccaggagctgaatggagacatggagcgggtggccgacagcctggtgaccctgcaggaccagctgaacagcctggccgctgtggtgctgcagaacagaagagccctggacctgctgacagctgagcggggcggcacctgcctcttcctgggggaggagtgctgctactacgtgaaccagagcggcatcgtgacagagaaggtgaaggagatccgggaccgcatccagaggagagctgaggagctgaggaacacaggcccctggggcctgctgagccagtggatgccctggatcctgcccttcctgggccccctggccgccatcatcctgctgctgctgtttggcccctgcatcttcaacctgctggtgaactttgtgagcagccgcatcgaggccgtgaagctgcagatggagcccaagatgcagagcaagaccaagatctacagaagacccctggacaggcctgccagccccaggagtgatgtgaatgacatcaagggcaccccacctgaggagatctctgctgcccagcccctgctgcggcccaacagcgctggcagcagctag

SEQ ID NO: 34021 - DNA, 1710 bp, Artificial Sequence
  Description of Artificial Sequence: Synthetic coding sequence
atgggcagcaccctgggctgccacaggagcatcccccgggaccccagcgacctgagccacagcaggaagttctctgctgcctgcaacttcagcaacatcctggtgaaccaggagcggctgaacatcaacacagccacagaggaggagctgatgaccctgcccggggtgaccagggctgtggcccggagcatcgtggagtaccgggagtacatcggcggcttcaagaaggtggaggacctggccctggtgtctggagtgggcgccaccaagctggagcaggtgaagtttgagatctgtgtgagcagcaagggcagcagcgcccagcacagccccagcagcctgcggcgggacctgctggccgagcagcagccccaccacctggccacagctgtgcccctgaccccccgggtgaacatcaacacagccaccccagcccagctgatgtctgtgcggggcctgtctgagaagatggccctgagcatcgtggacttcagaagagagcacggccccttccgctctgtggaggacctggtgaggatggatggcatcaatgctgccttcctggaccgcatccgccaccaggtgtttgctgagaggagccggccccccagcacccacaccaacggcggcctgaccttcaccgccaagccccaccccagccccaccagcctgagcctgcagagcgaggacctggacctgcccccaggcggccccacccagatcatcagcacccggcccagcgtggaggcctttggaggcaccagagatggccggcctgtgctgcggctggccacctggaacctgcagggctgcagcgtggagaaggccaacaaccctggggtgcgggaggtggtgtgcatgaccctgctggagaacagcatcaagctgctggccgtgcaggagctgctggaccgggaggccctggagaagttctgcacagagctgaaccagcccaccctgcccaacatcaggaagtggaagggcccccggggctgctggaaggctgtggtggccgagaagcccagcagccagctgcagaagggagctggctacgccggcttcctgtgggatgctgctgctggcatggagctgagagatgctggcagccaggagagcagccccagcaatggccacggcaagctggccggccccagcccctacctgggccgcttcaaggtgggcagccatgacctgaccctggtgaacctgcacctggccgccctgaccctgctgggcagcgagaaccccagcaagaaccacagtgatggccaccggctggccagctttgcccagaccctgcaggagaccctgaagggggagaaggatgtgatcatcctgggggactttggccagggccctgacagcaatgactatgacatcctgaggaaggagaagttccaccacctgatcccagcccacaccttcaccaacatcagcaccaagaacccccagggcagcaagagcctggacaacatctggatcagcaagagcctgaagaaggtgttcaccggccactgggccgtggtgcgggagggcctgaccaacccctggatcccagacaactggagctggggcggcgtggccagcgagcactgccctgtgctggccgagttctacacagagaaggactggagcaagaaggatgcccccagaaatggcagcggcgtggccctggagaggtctgaggccaacatcaagcatgaaagatag

SEQ ID NO: 34022 - DNA, 1710 bp, Artificial Sequence; identical to SEQ ID NO: 34021
  Description of Artificial Sequence: Synthetic coding sequence

SEQ ID NO: 34023 - DNA, 822 bp, Artificial Sequence
  Description of Artificial Sequence: Synthetic coding sequence
atggaggccgcccccagccgcttcatgttcctgctcttcctgctgacctgtgagctggccgctgaggtggccgctgaggtggagaagagcagtgatggccctggggccgcccaggagcccacctggctgacagatgtgcctgctgccatggagttcatcgccgccacagaggtggccgtgattggcttcttccaggacctggagatcccagctgtgcccatcctgcacagcatggtgcagaagtttcctggggtgtcctttggcatcagcacagattctgaggtgctgacccactacaacatcaccggcaacaccatctgcctcttccggctggtggacaatgagcagctgaacctggaggatgaggacatcgagagcattgatgccaccaagctgagccgcttcatcgagatcaacagcctgcacatggtgacagagtacaaccctgtgacagtgattggcctcttcaacagcgtcatccagatccacctgctgctgatcatgaacaaggccagcccagaatatgaggagaacatgcaccgctaccagaaggccgccaagctgttccagggcaagatcctcttcatcctggtggacagcggcatgaaggaaaatggcaaggtgatctccttcttcaagctgaaggagagccagctgcctgccctggccatctaccagaccctggatgatgagtgggacaccctgcccacagctgaggtgtctgtggagcacgtgcagaacttctgtgatggcttcctgagcggcaagctgctgaaggagaaccgggagagcgagggcaagacccccaaggtggagctgtag

SEQ ID NO: 34024 - DNA, 2934 bp, Artificial Sequence
  Description of Artificial Sequence: Synthetic coding sequence
atgcctgcccggcggctgctgctgctgctgaccctgctgctgcccggcctgggcatcttcggcagcaccagcacagtgaccctgcctgagaccctgctgtttgtgtccaccctggatggcagcctgcatgctgtgtccaagaggacaggcagcatcaagtggaccctgaaggaggaccctgtgctgcaggtgcccacccacgtggaggagcccgccttcctgcctgaccccaatgatggcagcctgtacaccctgggcagcaagaacaatgaaggcctgaccaagctgcccttcaccatccctgagctggtgcaggccagcccctgccgcagcagtgatggcatcctgtacatgggcaagaagcaggacatctggtacgtgattgacctgctgaccggggagaagcagcagaccctgagcagcgcctttgctgacagcctgtgccccagcaccagcctgctgtacctgggccgcacagagtacaccatcaccatgtatgacaccaagacccgggagctgcgctggaatgccacctactttgattatgctgccagcctgcctgaagatgatgtggactacaagatgagccactttgtgtccaatggagatggcctggtggtgacagtggacagcgagagcggagatgtgctgtggatccagaactatgccagccctgtggtggccttctacgtgtggcagcgggagggcctgaggaaggtgatgcacatcaacgtggccgtggagaccctgcgctacctgaccttcatgtctggagaggtgggccgcatcaccaagtggaagtaccccttccccaaggagacagaggccaagagcaagctgacccccaccctgtatgtgggcaagtacagcaccagcctgtatgccagccccagcatggtgcatgaaggagtggccgtggtgccccggggcagcaccctgcccctgctggagggcccccagacagatggagtgaccatcggggacaagggagaatgtgtgatcacccccagcacagatgtgaagtttgaccccggcctgaagagcaagaacaagctgaactacctgaggaactactggctgctgattggccaccacgagacccccctgagcgccagcaccaagatgctggagcgcttccccaacaacctgcccaagcaccgggagaatgtcatcccagctgacagcgagaagaagagctttgaggaggtgatcaacctggtggaccagaccagtgaaaatgcccccaccaccgtgtccagagatgtggaggagaagccagcccacgccccagcccggcctgaggcccctgtggacagcatgctgaaggacatggccaccatcatcctgagcaccttcctgctgattggctgggtggccttcatcatcacctaccccctgtccatgcaccagcagcagcagctgcagcaccagcagttccagaaggagctggagaagatccagctgctgcagcagcagcagcagcagctgcccttccaccccccaggggacacagcccaggatggagagctgctggacaccagcggcccctacagcgagagcagcggcaccagcagccccagcaccagcccccgggccagcaaccacagcctgtgcagcggcagcagcgccagcaaggccggcagcagccccagcctggagcaggatgatggagatgaggagacctctgtggtgattgtgggcaagatctccttctgccccaaggatgtgctgggccatggagctgagggcaccatcgtgtaccggggcatgtttgacaacagagatgtggccgtgaagaggatcctgcctgagtgcttctcctttgctgaccgggaggtgcagctgctgcgggagagtgatgagcaccccaacgtcatccgctacttctgcacagagaaggaccggcagttccagtacatcgccatcgagctgtgtgccgccaccctgcaggagtatgtggagcagaaggactttgcccacctgggcctggagcccatcaccctgctgcagcagaccaccagcggcctggcccacctgcacagcctgaacatcgtgcaccgggacctgaagccccacaacatcctgatctccatgcccaatgcccacggcaagatcaaggccatgatcagtgactttggcctgtgcaagaagctggccgtgggccgccacagcttcagcagaagaagtggagtgcccggcacagagggctggatcgcccctgagatgctgtctgaggactgcaaggagaaccccacctacacagtggacatcttctctgctggctgtgtgttctactacgtgatcagcgagggcagccacccctttgggaagagcctgcagaggcaggccaacatcctgctgggcgcctgcagcctggactgcctgcaccctgagaagcatgaagatgtgattgcccgggagctgattgagaagatgattgccatggacccccagaagaggcccagcgccaagcacgtgctgaagcaccccttcttctggagcctggagaagcagctgcagttcttccaggatgtgtctgacagaattgagaaggagagcctggatggccccatcgtgaagcagctggagcggggcggccgggctgtggtgaagatggactggagggagaacatcaccgtgcccctgcagacagacctgaggaagttccgcacctacaagggcggctctgtgcgggacctgctgcgggccatgaggaacaagaagcaccactaccgggagctgcctgctgaggtgcgggagaccctgggcagcctgcctgatgactttgtgtgctacttcaccagccgcttcccccacctgctggcccacacctaccgggccatggagctgtgcagccatgagcggctcttccagccctactacttccacgagcccccagagccccagccccctgtgaccccagatgccctgtag

SEQ ID NO: 34025 - DNA, 873 bp, Artificial Sequence
  Description of Artificial Sequence: Synthetic coding sequence
atgccctttgacttccgccgctttgacatctacaggaaggtgcccaaggacctgacccagcccacctacaccggggccatcatcagcatctgctgctgcctcttcatcctcttcctgttcctgtctgagctgaccggcttcatcaccacagaggtggtgaatgagctgtatgtggatgatcctgacaaggacagcggcggcaagattgatgtgtccctgaacatcagcctgcccaacctgcactgtgagctggtgggcctggacatccaggatgagatgggcagacatgaggtgggccacatcgacaacagcatgaagatccccctgaacaatggagctggctgccgctttgagggccagttcagcatcaacaaggtgcccggcaacttccacgtgtccacccacagcgccacagcccagccccagaacccagacatgacccacgtgatccacaagctgagctttggagacaccctgcaggtgcagaacatccatggagccttcaatgccctgggcggcgctgaccggctgaccagcaaccccctggccagccatgactacatcctgaagatcgtgcccaccgtgtatgaggacaagagcggcaagcagcgctacagctaccagtacacagtggccaacaaggagtatgtggcctacagccacacaggccgcatcatcccagccatctggttccgctatgacctgagccccatcaccgtgaagtacacagaaagacggcagcccctgtaccgcttcatcaccaccatctgtgccatcatcggcggcaccttcaccgtggccggcatcctggacagctgcatcttcaccgccagcgaggcctggaagaagatccagctgggcaagatgcactag

SEQ ID NO: 34026 - DNA, 108 bp, Artificial Sequence
  Description of Artificial Sequence: Synthetic coding sequence
tgatgcagcacagccaacggggagaaggacagcatcaccctcatctccatgaagaacatcaacatgaacaacgggaagcagagcctgtctgctgagaaggtgctgtag

SEQ ID NO: 34027 - DNA, 219 bp, Artificial Sequence
  Description of Artificial Sequence: Synthetic coding sequence
atgggcacagctggggccatgcagctgtgctgggtgatcctgggcttcctgctcttccggggccacaacagccagcccaccatgacccagaccagcagcagccagggcggcctgggcggcctgagcctgaccacagagcctgtgagcagcaaccctggctacatccccagcagcgaggccaaccggcccagccacctgagcagcacaggcaccccctag

SEQ ID NO: 34028 - DNA, 768 bp, Artificial Sequence
  Description of Artificial Sequence: Synthetic coding sequence
atggccagccctggggccggccgggcccctcctgagctgcctgagaggaactgtggctaccgggaggtggagtactgggaccagcgctaccagggcgctgctgacagcgccccctatgactggtttggagacttcagcagcttccgggccctgctggagcctgagctgcggccagaagatcgcatcctggtgctgggctgcggcaacagcgccctgtcctatgagctgttcctgggcggcttccccaacgtgacctctgtggactacagctctgtggtggtggccgccatgcaggcccggcatgcccacgtgccccagctgcgctgggagaccatggatgtgaggaagctggacttccccagcgccagctttgatgtggtgctggagaagggcaccctggatgccctgctggccggggagcgggacccctggacagtgagcagcgagggcgtgcacacagtggaccaggtgctgtctgaggtgtcccgggtgctggtgcctgggggccgcttcatctccatgaccagcgctgccccccacttccgcaccaggcactacgcccaggcctactacggctggagcctgcggcatgccacctacggcagcggcttccacttccacctgtacctgatgcacaagggcggcaagctgtctgtggcccagctggccctgggcgcccagatcctgagccccccccggccccccaccagcccctgcttcctgcaggacagcgaccacgaggacttcctgagcgccatccagctgtag

SEQ ID NO: 34029 - DNA, 2211 bp, Artificial Sequence
  Description of Artificial Sequence: Synthetic coding sequence
atgaatgtggccctgcaggagctgggcgccggcagcaatgtgggcttccagaagggcacccggcagctgctgggcagcaggacccagctggagctggtgctggccggggccagcctgctgctggccgccctgctgctgggctgcctggtggccctgggcgtgcagtaccaccgggaccccagccacagcacctgcctgacagaggcctgcatccgggtggccggcaagatcctggagagcctggaccggggcgtgagcccctgtgaggacttctaccagttcagctgtggcggctggatcagaagaaaccccctgcctgatggccgcagccgctggaacaccttcaacagcctgtgggaccagaaccaggccatcctgaagcacctgctggagaacaccaccttcaacagcagcagcgaggccgagcagaagacccagcgcttctacctgagctgcctgcaggtggagcgcatcgaggagctgggcgcccagcccctgcgggacctgattgagaagattggaggctggaacatcaccggcccctgggaccaggacaacttcatggaggtgctgaaggctgtggccggcacctaccgggccacccccttcttcaccgtgtacatctctgctgacagcaagagcagcaacagcaatgtcatccaggtggaccagagcggcctcttcctgcccagccgggactactacctgaacagaacagccaatgagaaggtgctgacagcctacctggactacatggaggagctgggcatgctgctgggcggccggcccaccagcacccgggagcagatgcagcaggtgctggagctggagatccagctggccaacatcaccgtgccccaggaccagaggagagatgaggagaagatctaccacaagatgagcatcagcgagctgcaggccctggcccccagcatggactggctggagttcctgtccttcctgctgagccccctggagctgagtgacagcgagcctgtggtggtgtatggcatggactacctgcagcaggtgtctgagctgatcaacagaacagagcccagcatcctgaacaactacctgatctggaacctggtgcagaagaccaccagcagcctggacagaagatttgagagcgcccaggagaagctgctggagaccctgtatggcaccaagaagagctgtgtgccccgctggcagacctgcatcagcaacacagatgatgccctgggctttgccctgggcagcctgtttgtgaaggccacctttgaccggcagagcaaggagattgctgagggcatgatcagcgagatcagaacagcctttgaggaggccctgggccagctggtgtggatggatgagaagacccggcaggccgccaaggagaaggcagatgccatctatgacatgattggcttcccagacttcatcctggagcccaaggagctggatgatgtgtatgatggctatgagatcagtgaagattccttcttccagaacatgctgaacctgtacaacttcagcgccaaggtgatggctgaccagctgaggaagccacccagccgggaccagtggagcatgaccccccagacagtgaatgcctactacctgcccaccaagaatgagatcgtgtttcctgctggcatcctgcaggcccccttctacgccaggaaccaccccaaggccctgaactttggaggcattggagtggtgatgggccacgagctgacccacgcctttgatgaccagggccgggagtatgacaaggagggcaacctgcggccctggtggcagaatgaaagcctggccgccttcaggaaccacacagcctgcatggaggagcagtacaaccagtaccaggtgaatggagagcggctgaatggccggcagaccctgggagaaaatattgctgacaatggaggcctgaaggccgcctacaatgcctacaaggcctggctgaggaagcatggagaggagcagcagctgcctgctgtgggcctgaccaaccaccagctgttctttgtgggctttgcccaggtgtggtgcagcgtgaggaccccagagagcagccatgagggcctggtgacagacccccacagccctgcccgcttccgggtgctgggcaccctgagcaacagccgggacttcctgcggcacttcggctgccctgtgggcagccccatgaaccctggccagctgtgtgaggtgtggtag

SEQ ID NO: 34030 - DNA, 2652 bp, Artificial Sequence
  Description of Artificial Sequence: Synthetic coding sequence
atggccagccctggggccggccgggcccctcctgagctgcctgagaggaactgtggctaccgggaggtggagtactgggaccagcgctaccagggcgctgctgacagcgccccctatgactggtttggagacttcagcagcttccgggccctgctggagcctgagctgcggccagaagatcgcatcctggtgctgggctgcggcaacagcgccctgtcctatgagctgttcctgggcggcttccccaacgtgacctctgtggactacagctctgtggtggtggccgccatgcaggcccggcatgcccacgtgccccagctgcgctgggagaccatggatgtgaggaagctggacttccccagcgccagctttgatgtggtgctggagaagggcaccctggatgccctgctggccggggagcgggacccctggacagtgagcagcgagggcgtgcacacagtggaccaggtgctgtctgaggtgggcttccagaagggcacccggcagctgctgggcagcaggacccagctggagctggtgctggccggggccagcctgctgctggccgccctgctgctgggctgcctggtggccctgggcgtgcagtaccaccgggaccccagccacagcacctgcctgacagaggcctgcatccgggtggccggcaagatcctggagagcctggacagaggagtgagcccctgtgaggacttctaccagttcagctgtggcggctggatcagaagaaaccccctgcctgatggccgcagccgctggaacaccttcaacagcctgtgggaccagaaccaggccatcctgaagcacctgctggagaacaccaccttcaacagcagcagcgaggccgagcagaagacccagcgcttctacctgagctgcctgcaggtggagagaattgaggagctgggcgcccagcccctgcgggacctgattgagaagattggaggctggaacatcaccggcccctgggaccaggacaacttcatggaggtgctgaaggctgtggccggcacctaccgggccacccccttcttcaccgtgtacatctctgctgacagcaagagcagcaacagcaatgtcatccaggtggaccagagcggcctcttcctgcccagccgggactactacctgaacagaacagccaatgagaaggtgctgacagcctacctggactacatggaggagctgggcatgctgctgggcggccggcccaccagcacccgggagcagatgcagcaggtgctggagctggagatccagctggccaacatcaccgtgccccaggaccagaggagagatgaggagaagatctaccacaagatgagcatcagcgagctgcaggccctggcccccagcatggactggctggagttcctgtccttcctgctgagccccctggagctgagtgacagcgagcctgtggtggtgtatggcatggactacctgcagcaggtgtctgagctgatcaacagaacagagcccagcatcctgaacaactacctgatctggaacctggtgcagaagaccaccagcagcctggacagaagatttgaaagtgcccaggagaagctgctggagaccctgtatggcaccaagaagagctgtgtgccccgctggcagacctgcatcagcaacacagatgatgccctgggctttgccctgggcagcctgtttgtgaaggccacctttgaccggcagagcaaggagattgctgagggcatgatcagcgagatcagaacagcctttgaggaggccctgggccagctggtgtggatggatgagaagacccggcaggccgccaaggagaaggcagatgccatctatgacatgattggcttcccagacttcatcctggagcccaaggagctggatgatgtgtatgatggctatgagatcagcgaggacagcttcttccagaacatgctgaacctgtacaacttcagcgccaaggtgatggctgaccagctgaggaagccacccagccgggaccagtggagcatgaccccccagacagtgaatgcctactacctgcccaccaagaatgaaattgtgtttcctgctggcatcctgcaggcccccttctacgccaggaaccaccccaaggccctgaactttggaggcatcggcgtggtgatgggccacgagctgacccacgcctttgatgaccagggccgggagtatgacaaggagggcaacctgcggccctggtggcagaatgaaagcctggccgccttcaggaaccacacagcctgcatggaggagcagtacaaccagtaccaggtgaatggagagcggctgaatggccggcagaccctgggggagaacattgctgacaatggaggcctgaaggccgcctacaatgcctacaaggcctggctgaggaagcacggggaggagcagcagctgcctgctgtgggcctgaccaaccaccagctgttctttgtgggctttgcccaggtgtggtgcagcgtgaggaccccagagagcagccatgagggcctggtgacagacccccacagccctgcccgcttccgggtgctgggcaccctgagcaacagccgggacttcctgcggcacttcggctgccctgtgggcagccccatgaaccctggccagctgtgtgaggtgtggtag

SEQ ID NO: 34031 - DNA, 2298 bp, Artificial Sequence
  Description of Artificial Sequence: Synthetic coding sequence
atgaatgtggccctgcaggagctgggcgccggcagcaacatggtggagtacaagagggccaccctgagagatgaagatgcccctgagacccctgtggagggcggggccagcccagatgccatggaggtgggcttccagaagggcacccggcagctgctgggcagcaggacccagctggagctggtgctggccggggccagcctgctgctggccgccctgctgctgggctgcctggtggccctgggcgtgcagtaccaccgggaccccagccacagcacctgcctgacagaggcctgcatccgggtggccggcaagatcctggagagcctggacagaggagtgagcccctgtgaggacttctaccagttcagctgtggcggctggatcagaagaaaccccctgcctgatggccgcagccgctggaacaccttcaacagcctgtgggaccagaaccaggccatcctgaagcacctgctggagaacaccaccttcaacagcagcagcgaggccgagcagaagacccagcgcttctacctgagctgcctgcaggtggagagaattgaggagctgggcgcccagcccctgcgggacctgattgagaagattggaggctggaacatcaccggcccctgggaccaggacaacttcatggaggtgctgaaggctgtggccggcacctaccgggccacccccttcttcaccgtgtacatctctgctgacagcaagagcagcaacagcaatgtcatccaggtggaccagagcggcctcttcctgcccagccgggactactacctgaacagaacagccaatgagaaggtgctgacagcctacctggactacatggaggagctgggcatgctgctgggcggccggcccaccagcacccgggagcagatgcagcaggtgctggagctggagatccagctggccaacatcaccgtgccccaggaccagaggagagatgaggagaagatctaccacaagatgagcatcagcgagctgcaggccctggcccccagcatggactggctggagttcctgtccttcctgctgagccccctggagctgagtgacagcgagcctgtggtggtgtatggcatggactacctgcagcaggtgtctgagctgatcaacagaacagagcccagcatcctgaacaactacctgatctggaacctggtgcagaagaccaccagcagcctggacagaagatttgaaagtgcccaggagaagctgctggagaccctgtatggcaccaagaagagctgtgtgccccgctggcagacctgcatcagcaacacagatgatgccctgggctttgccctgggcagcctgtttgtgaaggccacctttgaccggcagagcaaggagattgctgagggcatgatcagcgagatcagaacagcctttgaggaggccctgggccagctggtgtggatggatgagaagacccggcaggccgccaaggagaaggcagatgccatctatgacatgattggcttcccagacttcatcctggagcccaaggagctggatgatgtgtatgatggctatgagatcagcgaggacagcttcttccagaacatgctgaacctgtacaacttcagcgccaaggtgatggctgaccagctgaggaagccacccagccgggaccagtggagcatgaccccccagacagtgaatgcctactacctgcccaccaagaatgaaattgtgtttcctgctggcatcctgcaggcccccttctacgccaggaaccaccccaaggccctgaactttggaggcatcggcgtggtgatgggccacgagctgacccacgcctttgatgaccagggccgggagtatgacaaggagggcaacctgcggccctggtggcagaatgaaagcctggccgccttcaggaaccacacagcctgcatggaggagcagtacaaccagtaccaggtgaatggagagcggctgaatggccggcagaccctgggggagaacattgctgacaatggaggcctgaaggccgcctacaatgcctacaaggcctggctgaggaagcacggggaggagcagcagctgcctgctgtgggcctgaccaaccaccagctgttctttgtgggctttgcccaggtgtggtgcagcgtgaggaccccagagagcagccatgagggcctggtgacagacccccacagccctgcccgcttccgggtgctgggcaccctgagcaacagccgggacttcctgcggcacttcggctgccctgtgggcagccccatgaaccctggccagctgtgtgaggtgtggtag

SEQ ID NO: 34032 - DNA, 2436 bp, Artificial Sequence
  Description of Artificial Sequence: Synthetic coding sequence
atgaatgtggccctgcaggagctgggcgccggcagcaacatggtggagtacaagagggccaccctgagagatgaagatgcccctgagacccctgtggagggcggggccagcccagatgccatggaggtgggcaaaggagccagccccttcagccctggccccagccctggcatgaccccaggcacccccaggagcagcggcctcttctggagggtgacctgcccccacctgcggagcatcagcggcctgtgcagcaggaccatggtgggcttccagaagggcacccggcagctgctgggcagcaggacccagctggagctggtgctggccggggccagcctgctgctggccgccctgctgctgggctgcctggtggccctgggcgtgcagtaccaccgggaccccagccacagcacctgcctgacagaggcctgcatccgggtggccggcaagatcctggagagcctggacagaggagtgagcccctgtgaggacttctaccagttcagctgtggcggctggatcagaagaaaccccctgcctgatggccgcagccgctggaacaccttcaacagcctgtgggaccagaaccaggccatcctgaagcacctgctggagaacaccaccttcaacagcagcagcgaggccgagcagaagacccagcgcttctacctgagctgcctgcaggtggagagaattgaggagctgggcgcccagcccctgcgggacctgattgagaagattggaggctggaacatcaccggcccctgggaccaggacaacttcatggaggtgctgaaggctgtggccggcacctaccgggccacccccttcttcaccgtgtacatctctgctgacagcaagagcagcaacagcaatgtcatccaggtggaccagagcggcctcttcctgcccagccgggactactacctgaacagaacagccaatgagaaggtgctgacagcctacctggactacatggaggagctgggcatgctgctgggcggccggcccaccagcacccgggagcagatgcagcaggtgctggagctggagatccagctggccaacatcaccgtgccccaggaccagaggagagatgaggagaagatctaccacaagatgagcatcagcgagctgcaggccctggcccccagcatggactggctggagttcctgtccttcctgctgagccccctggagctgagtgacagcgagcctgtggtggtgtatggcatggactacctgcagcaggtgtctgagctgatcaacagaacagagcccagcatcctgaacaactacctgatctggaacctggtgcagaagaccaccagcagcctggacagaagatttgaaagtgcccaggagaagctgctggagaccctgtatggcaccaagaagagctgtgtgccccgctggcagacctgcatcagcaacacagatgatgccctgggctttgccctgggcagcctgtttgtgaaggccacctttgaccggcagagcaaggagattgctgagggcatgatcagcgagatcagaacagcctttgaggaggccctgggccagctggtgtggatggatgagaagacccggcaggccgccaaggagaaggcagatgccatctatgacatgattggcttcccagacttcatcctggagcccaaggagctggatgatgtgtatgatggctatgagatcagcgaggacagcttcttccagaacatgctgaacctgtacaacttcagcgccaaggtgatggctgaccagctgaggaagccacccagccgggaccagtggagcatgaccccccagacagtgaatgcctactacctgcccaccaagaatgaaattgtgtttcctgctggcatcctgcaggcccccttctacgccaggaaccaccccaaggccctgaactttggaggcatcggcgtggtgatgggccacgagctgacccacgcctttgatgaccagggccgggagtatgacaaggagggcaacctgcggccctggtggcagaatgaaagcctggccgccttcaggaaccacacagcctgcatggaggagcagtacaaccagtaccaggtgaatggagagcggctgaatggccggcagaccctgggggagaacattgctgacaatggaggcctgaaggccgcctacaatgcctacaaggcctggctgaggaagcacggggaggagcagcagctgcctgctgtgggcctgaccaaccaccagctgttctttgtgggctttgcccaggtgtggtgcagcgtgaggaccccagagagcagccatgagggcctggtgacagacccccacagccctgcccgcttccgggtgctgggcaccctgagcaacagccgggacttcctgcggcacttcggctgccctgtgggcagccccatgaaccctggccagctgtgtgaggtgtggtag

SEQ ID NO: 34033 - DNA, 786 bp, Artificial Sequence
  Description of Artificial Sequence: Synthetic coding sequence
atgctgcgggtgctgtgcctgctgcggccctggaggcccctgcgggcccggggctgtgccagtgatggagctgctgggggcagcgagatccaggtgcgggccctggccggccctgaccagggcatcacagagatcctgatgaaccggcccagcgccagaaatgccctgggcaatgtgtttgtgtctgagctgctggagaccctggcccagctgagagaagatcggcaggtgcgggtgctgctcttccgcagcggcgtgaagggcgtcttctgtgccggggctgacctgaaggagcgggagcagatgtctgaggccgaggtgggcgtgtttgtgcagaggctgcggggcctgatgaatgacatcgccagcagcgctgtgatgggcctcatcgagaccacccggggcctgctgcccggggccggcggcacccagaggctgccccgctgcctgggcgtggccctggccaaggagctgatcttcaccggccgccgcctgagcggcacagaggcccacgtgctgggcctggtgaaccacgctgtggcccagaatgaggagggagatgctgcctaccagagggcccgggccctggcccaggagatcctgccccaggcccccatcgctgtgcggctgggcaaggtggccatcgaccggggcacagaggtggacatcgccagcggcatggccatcgagggcatgtgctacgcccagaacatccccacccgggaccggctggagggcatggccgccttccgggagaagaggacccccaagtttgtgggcaagtag

SEQ ID NO: 34034 - DNA, 879 bp, Artificial Sequence
  Description of Artificial Sequence: Synthetic coding sequence
atgctgcgggtgctgtgcctgctgcggccctggaggcccctgcgggcccggggctgtgccagtgatggagctgctgggggcagcgagatccaggtgcgggccctggccggccctgaccagggcatcacagagatcctgatgaaccggcccagcgccagaaatgccctgggcaatgtgtttgtgtctgagctgctggagaccctggcccagctgagagaagatcggcaggtgcgggtgctgctcttccgcagcggcgtgaagggcgtcttctgtgccggggctgacctgaaggagcgggagcagatgtctgaggccgaggtgggcgtgtttgtgcagaggctgcggggcctgatgaatgacattgctgccttccctgcccccaccatcgccgccatggatggctttgccctgggcggcggcctggagctggccctggcctgtgacctgcgggtggccgccagcagcgctgtgatgggcctgattgagaccacccggggcctgctgcctggagctgggggcacccagaggctgccccgctgcctgggcgtggccctggccaaggagctgatcttcaccggccggcggctgtctggaacagaggcccacgtgctgggcctggtgaaccacgctgtggcccagaatgaggagggagatgctgcctaccagagggcccgggccctggcccaggagatcctgccccaggcccccatcgctgtgcggctgggcaaggtggccatcgaccggggcacagaggtggacatcgccagcggcatggccatcgagggcatgtgctacgcccagaacatccccacccgggaccggctggagggcatggccgccttccgggagaagaggacccccaagtttgtgggcaagtag

SEQ ID NO: 34035 - DNA, 741 bp, Artificial Sequence
  Description of Artificial Sequence: Synthetic coding sequence
atgaaccggcccagcgccagaaatgccctgggcaatgtgtttgtgtctgagctgctggagaccctggcccagctgagagaagatcggcaggtgcgggtgctgctcttccgcagcggcgtgaagggcgtcttctgtgccggggctgacctgaaggagcgggagcagatgtctgaggccgaggtgggcgtgtttgtgcagaggctgcggggcctgatgaatgacattgctgccttccctgcccccaccatcgccgccatggatggctttgccctgggcggcggcctggagctggccctggcctgtgacctgcgggtggccgccagcagcgctgtgatgggcctgattgagaccacccggggcctgctgcctggagctgggggcacccagaggctgccccgctgcctgggcgtggccctggccaaggagctgatcttcaccggccggcggctgtctggaacagaggcccacgtgctgggcctggtgaaccacgctgtggcccagaatgaggagggagatgctgcctaccagagggcccgggccctggcccaggagatcctgccccaggcccccatcgctgtgcggctgggcaaggtggccatcgaccggggcacagaggtggacatcgccagcggcatggccatcgagggcatgtgctacgcccagaacatccccacccgggaccggctggagggcatggccgccttccgggagaagaggacccccaagtttgtgggcaagtag

SEQ ID NO: 34036 - DNA, 384 bp, Artificial Sequence
  Description of Artificial Sequence: Synthetic coding sequence
atgaaccggcccagcgccagaaatgccctgggcaatgtgtttgtgtctgagctgctggagaccctggcccagctgagagaagatcggcaggtgcgggtgctgctcttccgcagcggcgtgaagggcgtcttctgtgccggggctgacctgaaggagcgggagcagatgtctgaggccgaggtgggcgtgtttgtgcagaggctgcggggcctgatgaatgacattgctgccttccctgcccccaccatcgccgccatggatggctttgccctgggcggcggcctggagctggccctggcctgtgacctgcgggtggccggcaccggccctggcctgggcgctgggggcggggcccgggagagcggcgtgtctgagaccggctag

SEQ ID NO: 34037 - DNA, 660 bp, Artificial Sequence
  Description of Artificial Sequence: Synthetic coding sequence
atgctgcgggtgctgtgcctgctgcggccctggaggcccctgcgggcccggggctgtgccagtgatggagctgctgggggcagcgagatccaggtgcgggccctggccggccctgaccagggcatcacagagatcctgatgaaccggcccagcgccagaaatgccctgggcaatgtgtttgtgtctgagctgctggagaccctggcccagctgagagaagatcggcaggtgcgggtgctgctcttccgcagcggcgtgaagggcgtcttctgtgccggggctgacctgaaggagcgggagcagatgtctgaggccgaggtgggcgtgtttgtgcagaggctgcggggcctgatgaatgacatcgccagcagcgctgtgatgggcctcatcgagaccacccggggcctgctgcccggggccggcggcacccagaggctgccccgctgcctgggcgtggccctggccaaggagctgatcttcaccggccgccgcctgagcggcacagaggcccacgtgctgggcctggtgaaccacgctgtggcccagaatgaggagggagatgctgcctaccagagggcccgggccctggcccaggagatcctgccccaggtggacatcgccagcggcatggccatcgagggcatgtgctacgcccagtag

SEQ ID NO: 34038 - DNA, 912 bp, Artificial Sequence
  Description of Artificial Sequence: Synthetic coding sequence
atggctgctgtggccgtgctgcgggccttcggggccagcggccccatgtgcctgcggcggggcccctgggcccagctgcctgcccgcttctgcagccgggaccctgctggggccggccggcgggagagcgagccccggcccaccagcgcccggcagctggatggcatcagaaatattgtgctgagcaaccccaagaagagaaatgccctgagcctggccatgctgaagagcctgcagagcgacatcctgcatgatgctgacagcaatgacctgaaggtgatcatcatctctgctgagggccctgtgttcagcagcggccatgacctgaaggagctgacagaggagcagggccgggactaccacgccgaggtgttccagacctgcagcaaggtgatgatgcacatccggaaccaccctgtgcctgtgattgccatggtgaatggcctggccgctgctgctggctgccagctggtggccagctgtgacattgctgtggccagtgacaagagcagctttgccaccccaggagtgaatgtgggcctcttctgcagcaccccaggagtggccctggcccgggctgtgcccaggaaggtggccctggagatgctgttcaccggggagcccatcagcgcccaggaggccctgctgcacggcctgctgagcaaggtggtgcctgaggccgagctgcaggaggagaccatgagaattgccaggaagatcgccagcctgagcaggcctgtggtgtccctgggcaaggccaccttctacaagcagctgccccaggacctgggcacagcctactacctgaccagccaggccatggtggacaacctggccctgagagatggccaggagggcatcacagccttcctgcagaagaggaagcctgtgtggagccatgagcctgtgtag

SEQ ID NO: 34039 - DNA, 726 bp, Artificial Sequence
  Description of Artificial Sequence: Synthetic coding sequence
atggctgctgtggccgtgctgcgggccttcggggccagcggccccatgtgcctgcggcggggcccctgggcccagctgcctgcccgcttctgcagccgggaccctgctggggccggccggcgggagagcgagccccggcccaccagcgcccggcagctggatggcatccgcagcgcccctggccgggccggcagcagccgctggtgccgggtgggcgtgcgggccccacccctgacccggggcggccctggagagcctgagccccggctgcggccctggggcggcaacagcccctgccccggccctggccctggcagcgagaccaggaggaacatcgtgctgagcaaccccaagaagagaaatgccctgagcctggccatgctgaagagcctgcagagcgacatcctgcatgatgctgacagcaatgacctgaaggtgatcatcatctctgctgagggccctgtgttcagcagcggccatgacctgaaggagctgacagaggagcagggccgggactaccacgccgaggtgttccagacctgcagcaaggtgatgatgcacatccggaaccaccctgtgcctgtgattgccatggtgaatggcctggccgctgctgctggctgccagctggtggccagctgtgacattgctgtggccagtgacaagagcagctttgccaccccaggagtgaatgtgggcctcttctgcagcaccccaggagtgtag

SEQ ID NO: 34040 - DNA, 501 bp, Artificial Sequence
  Description of Artificial Sequence: Synthetic coding sequence
atgctgaagagcctgcagagcgacatcctgcatgatgctgacagcaatgacctgaaggtgatcatcatctctgctgagggccctgtgttcagcagcggccatgacctgaaggagctgacagaggagcagggccgggactaccacgccgaggtgttccagacctgcagcaaggtgatgatgcacatccggaaccaccctgtgcctgtgattgccatggtgaatggcctggccgctgctgctggctgccagctggtggccagctgtgacattgctgtggccagtgacaagagcagctttgccaccccaggagtgaatgtgggcctcttctgcagcaccccaggagtggccctggcccgggctgtgcccaggaaggtggccctggagatgctgttcaccggggagcccatcagcgcccaggaggccctgctgcacggcctgctgagcaaggtggtgcctgaggccgagctgcaggaggagaccatgagaattgccaggaagtag

SEQ ID NO: 34041 - DNA, 909 bp, Artificial Sequence
  Description of Artificial Sequence: Synthetic coding sequence
atggccctggtggcctctgtgcgggtgcctgcccgggtgctgctgcgggccggggcccggctgcccggggccgccctgggccgcacagaaagagctgctggaggaggagatggagcccggcgcttcggcagccagagggtgctggtggagccagatgctggagctggggtggccgtgatgaagttcaagaacccccctgtgaacagcctgagcctggagttcctgacagagctggtgatcagcctggagaagctggagaatgacaagagcttccggggcgtcatcctgaccagtgacaggcctggggtcttctctgctggcctggacctgacagagatgtgtggccgcagccctgcccactacgccggctactggaaggctgtgcaggagctgtggctgcggctgtaccagagcaacctggtgctggtgtctgccatcaatggagcctgcccagctgggggctgcctggtggccctgacctgtgactaccgcatcctggccgacaacccccgctactgcatcggcctgaatgagacccagctgggcatcatcgcccccttctggctgaaggacaccctggagaacaccatcggccacagagctgctgagcgggccctgcagctgggcctgctcttccccccagctgaggccctgcaggtgggcatcgtggaccaggtggtgcctgaggagcaggtgcagagcacagccctgagcgccatcgcccagtggatggccatcccagaccacgcccggcagctgaccaaggccatgatgaggaaggccacagccagccggctggtgacccagagagatgctgatgtgcagaactttgtgtccttcatcagcaaggacagcatccagaagagcctgcagatgtacctggagcggctgaaggaggagaagggctag

SEQ ID NO: 34042 - DNA, 858 bp, Artificial Sequence
  Description of Artificial Sequence: Synthetic coding sequence
atggccctggtggcctctgtgcgggtgcctgcccgggtgctgctgcgggccggggcccggctgcccggggccgccctgggccgcacagaaagagctgctggaggaggagatggagcccggcgcttcggcagccagagggtgctggtggagccagatgctggagctggggtggccgtgatgaagttcaagaacccccctgtgaacagcctgagcctggagttcctgacagagctggtgatcagcctggagaagctggagaatgacaagagcttccggggcgtcatcctgaccagtgacaggcctggggtcttctctgctggcctggacctgacagagatgtgtggccgcagccctgcccactacgccggctactggaaggctgtgcaggagctgtggctgcggctgtaccagagcaacctggtgctggtgtctgccatcaatggagcctgcccagctgggggctgcctggtggccctgacctgtgactaccgcatcctggccgacaacccccggctgaaggacaccctggagaacaccatcggccacagagctgctgagcgggccctgcagctgggcctgctcttccccccagctgaggccctgcaggtgggcatcgtggaccaggtggtgcctgaggagcaggtgcagagcacagccctgagcgccatcgcccagtggatggccatcccagaccacgcccggcagctgaccaaggccatgatgaggaaggccacagccagccggctggtgacccagagagatgctgatgtgcagaactttgtgtccttcatcagcaaggacagcatccagaagagcctgcagatgtacctggagcggctgaaggaggagaagggctag

SEQ ID NO: 34043 - DNA, 1095 bp, Artificial Sequence
  Description of Artificial Sequence: Synthetic coding sequence
atgaacagaacagccatgagggccagccagaaggactttgagaacagcatgaaccaggtgaagctgctgaagaaggaccctggaaatgaggtgaagctgaagctgtatgccctgtacaagcaggccacagagggcccctgcaacatgcccaagccaggagtgtttgacctgatcaacaaggccaagtgggatgcctggaatgccctgggcagcctgcccaaggaggccgcccggcagaactacgtggacctggtgagcagcctgagccccagcctggagagcagcagccaggtggagcccggcacagacaggaagagcactggatttgagaccctggtggtgaccagtgaagatggcatcaccaagatcatgttcaaccggcccaagaagaagaatgccatcaacacagagatgtaccacgagatcatgagggccctgaaggccgccagcaaggatgacagcatcatcaccgtgctgactggaaatggagactactacagcagtggaaatgacctgaccaacttcacagacatccccccaggcggcgtggaggagaaggccaagaacaatgctgtgctgctgcgggagtttgtgggctgcttcatcgacttccccaagcccctgattgctgtggtgaatggacctgctgtgggcatctctgtgaccctgctgggcctgtttgatgctgtgtatgccagtgaccgggccaccttccacacccccttcagccacctgggccagagccctgagggctgcagcagctacaccttccccaagatcatgagccctgccaaggccacagagatgctgatctttgggaagaagctgacagctggggaggcctgtgcccagggcctggtgacagaggtgtttcctgacagcaccttccagaaggaggtgtggacccggctgaaggcctttgccaagctgcccccaaatgccctgcgcatcagcaaggaggtgatcaggaagcgggagcgggagaagctgcatgctgtgaatgcagaagaatgtaatgtgctgcagggccgctggctgagtgatgaatgtaccaatgctgtggtgaacttcctgagcaggaagagcaagctgtag

SEQ ID NO: 34044 - DNA, 1185 bp, Artificial Sequence
  Description of Artificial Sequence: Synthetic coding sequence
atggccatggcctacctggcctggaggctggcccggcgcagctgccccagcagcctgcaggtgaccagcttccctgtggtgcagctgcacatgaacagaacagccatgagggccagccagaaggactttgagaacagcatgaaccaggtgaagctgctgaagaaggaccctggaaatgaggtgaagctgaagctgtatgccctgtacaagcaggccacagagggcccctgcaacatgcccaagccaggagtgtttgacctgatcaacaaggccaagtgggatgcctggaatgccctgggcagcctgcccaaggaggccgcccggcagaactacgtggacctggtgagcagcctgagccccagcctggagagcagcagccaggtggagcccggcacagacaggaagagcactggatttgagaccctggtggtgaccagtgaagatggcatcaccaagatcatgttcaaccggcccaagaagaagaatgccatcaacacagagatgtaccacgagatcatgagggccctgaaggccgccagcaaggatgacagcatcatcaccgtgctgactggaaatggagactactacagcagtggaaatgacctgaccaacttcacagacatccccccaggcggcgtggaggagaaggccaagaacaatgctgtgctgctgcgggagtttgtgggctgcttcatcgacttccccaagcccctgattgctgtggtgaatggacctgctgtgggcatctctgtgaccctgctgggcctgtttgatgctgtgtatgccagtgaccgggccaccttccacacccccttcagccacctgggccagagccctgagggctgcagcagctacaccttccccaagatcatgagccctgccaaggccacagagatgctgatctttgggaagaagctgacagctggggaggcctgtgcccagggcctggtgacagaggtgtttcctgacagcaccttccagaaggaggtgtggacccggctgaaggcctttgccaagctgcccccaaatgccctgcgcatcagcaaggaggtgatcaggaagcgggagcgggagaagctgcatgctgtgaatgcagaagaatgtaatgtgctgcagggccgctggctgagtgatgaatgtaccaatgctgtggtgaacttcctgagcaggaagagcaagctgtag

SEQ ID NO: 34045 - DNA, 1095 bp, Artificial Sequence; identical to SEQ ID NO: 34043
  Description of Artificial Sequence: Synthetic coding sequence

SEQ ID NO: 34046 - DNA, 684 bp, Artificial Sequence
  Description of Artificial Sequence: Synthetic coding sequence
atgtaccacgagatcatgagggccctgaaggccgccagcaaggatgacagcatcatcaccgtgctgactggaaatggagactactacagcagtggaaatgacctgaccaacttcacagacatccccccaggaggagtggaggagaaggccaagaacaatgctgtgctgctgcgggagtttgtgggctgcttcatcgacttccccaagcccctgattgctgtggtgaatggacctgctgtgggcatctctgtgaccctgctgggcctgtttgatgctgtgtatgccagtgaccgggccaccttccacacccccttcagccacctgggccagagccctgagggctgcagcagctacaccttccccaagatcatgagccctgccaaggccacagagatgctgatctttgggaagaagctgacagctggggaggcctgtgcccagggcctggtgacagaggtgtttcctgacagcaccttccagaaggaggtgtggacccggctgaaggcctttgccaagctgcccccaaatgccctgcgcatcagcaaggaggtgatcaggaagcgggagcgggagaagctgcatgctgtgaatgctgaggagtgcaatgtgctgcagggccgctggctgagtgatgagtgcaccaatgctgtggtgaacttcctgagcaggaagagcaagctgtag

SEQ ID NO: 34047 - DNA, 1095 bp, Artificial Sequence; identical to SEQ ID NO: 34043
  Description of Artificial Sequence: Synthetic coding sequence

SEQ ID NO: 34048 - DNA, 2961 bp, Artificial Sequence
  Description of Artificial Sequence: Synthetic coding sequence
atggccggcatcttctactttgccctcttcagctgcctgtttggcatctgtgatgctgtgacaggcagccgggtgtacccagccaatgaggtgaccctgctggacagccgctctgtgcagggcgagctgggctggatcgccagccccctggagggcggctgggaggaggtgtccatcatggatgagaagaacacccccatccgcacctaccaggtgtgcaatgtgatggagcccagccagaacaactggctgaggacagactggatcacccgggagggcgcccagagggtgtacatcgagatcaagttcaccctgcgggactgcaacagcctgcccggggtgatgggcacctgcaaggagaccttcaacctgtactactatgaaagtgacaatgacaaggagcgcttcatccgggagaaccagtttgtgaagattgacaccatcgccgcagatgagagcttcacccaggtggacattggagaccgcatcatgaagctgaacacagagatcagagatgtgggccccctgagcaagaagggcttctacctggccttccaggatgtgggcgcctgcatcgccctggtgtctgtgcgggtcttctacaagaagtgccccctgactgtgaggaacctggcccagttcccagacaccatcactggagctgacaccagcagcctggtggaggtgcggggcagctgtgtgaacaacagcgaggagaaggatgtgcccaagatgtactgtggggctgatggagagtggctggtgcccatcggcaactgcctgtgcaatgccggccacgaggagaggtctggagagtgccaggcctgcaagattggctactacaaggccctgagcacagatgccacctgtgccaagtgccccccccacagctacagcgtgtgggagggcgccaccagctgcacctgtgaccggggcttcttccgggctgacaatgatgctgcctccatgccctgcacccggccccccagcgcccccctgaacctgatcagcaatgtgaatgagacctctgtgaacctggagtggagcagcccccagaacacaggaggccggcaggacatctcctacaacgtggtgtgcaagaagtgtggggccggggaccccagcaagtgccggccctgtggcagcggcgtgcactacaccccccagcagaatggcctgaagaccaccaaggtgtccatcacagacctgctggcccacaccaactacacctttgagatctgggccgtgaatggagtgtccaagtacaaccccaacccagaccagagcgtgtctgtgacagtgaccaccaaccaggccgcccccagcagcatcgccctggtgcaggccaaggaggtgacccgctacagcgtggccctggcctggctggagccagaccggcccaacggggtcatcctggagtatgaggtgaagtactatgagaaggaccagaatgaaagaagctaccgcatcgtgaggacagctgccaggaacacagacatcaagggcctgaaccccctgaccagctatgtgttccacgtgcgggccaggacagctgctggctatggagacttcagcgagcccctggaggtgaccaccaacacagtgcccagccgcatcattggagatggagccaacagcacagtgctgctggtgtctgtgtctggctctgtggtgctggtggtgatcctgattgctgcctttgtgatcagcagaagaagaagcaagtacagcaaggccaagcaggaggctgatgaggagaagcacctgaaccagggcgtgaggacctacgtggaccccttcacctatgaggaccccaaccaggccgtgcgggagtttgccaaggagattgatgccagctgcatcaagattgagaaggtgattggagtgggggagtttggagaggtgtgcagcggccgcctgaaggtgcctgggaagcgggagatctgtgtggccatcaagaccctgaaggccggctacacagacaagcagaggcgggacttcctgtctgaggccagcatcatgggccagtttgaccaccccaacatcatccacctggagggcgtggtgaccaagtgcaagcctgtgatgatcatcacagagtacatggagaatggcagcctggatgccttcctgaggaagaatgatggccgcttcaccgtcatccagctggtgggcatgctgcggggcatcggcagcggcatgaagtacctgagtgacatgtcctatgtgcaccgggacctggccgccaggaacatcctggtgaacagcaacctggtgtgcaaggtgtctgactttggcatgagccgggtgctggaggatgatcctgaggccgcctacaccacccggggcggcaagatccccatccgctggacagcccctgaggccatcgcctacaggaagttcaccagcgccagtgatgtgtggagctatggcatcgtgatgtgggaggtgatgtcctatggagagcggccctactgggacatgagcaaccaggacgtcatcaaggccatcgaggagggctaccgcctgcccccacccatggactgccccatcgccctgcaccagctgatgctggactgctggcagaaggagaggagtgaccggcccaagtttggccagatcgtgaacatgctggacaagctgatccggaaccccaacagcctgaagaggactggaacagagagcagccggcccaacacagccctgctggaccccagcagccctgagttctctgctgtggtgtctgtgggggactggctgcaggccatcaagatggaccgctacaaggacaacttcaccgctgctggctacaccaccctggaggccgtggtgcacgtgaaccaggaggacctggcccgcatcggcatcacagccatcacccaccagaacaagatcctgagctctgtgcaggccatgaggacccagatgcagcagatgcacggccgcatggtgcctgtgtag

SEQ ID NO: 34049 - DNA, 2808 bp, Artificial Sequence
  Description of Artificial Sequence: Synthetic coding sequence
atgaagtgggaggaggtgtccatcatggatgagaagaacacccccatccgcacctaccaggtgtgcaatgtgatggagcccagccagaacaactggctgaggacagactggatcacccgggagggcgcccagagggtgtacatcgagatcaagttcaccctgcgggactgcaacagcctgcccggggtgatgggcacctgcaaggagaccttcaacctgtactactatgaaagtgacaatgacaaggagcgcttcatccgggagaaccagtttgtgaagattgacaccatcgctgctgatgagagcttcacccaggtggacatcggggaccgcatcatgaagctgaacacagagatcagagatgtgggccccctgagcaagaagggcttctacctggccttccaggatgtgggcgcctgcatcgccctggtgtctgtgcgggtcttctacaagaagtgccccctgactgtgaggaacctggcccagttcccagacaccatcaccggggctgacaccagcagcctggtggaggtgcggggcagctgtgtgaacaacagcgaggagaaggatgtgcccaagatgtactgtggggctgatggagagtggctggtgcccatcggcaactgcctgtgcaatgccggccacgaggagaggtctggagagtgccaggcctgcaagattggctactacaaggccctgagcacagatgccacctgtgccaagtgccccccccacagctacagcgtgtgggagggcgccaccagctgcacctgtgaccggggcttcttccgggctgacaatgatgctgcctccatgccctgcaccaggcctccttctgcccccctgaacctgatcagcaatgtgaatgagacctctgtgaacctggagtggagcagcccccagaacacaggaggccggcaggacatctcctacaacgtggtgtgcaagaagtgtggggccggggaccccagcaaatgtcggccctgtggcagcggcgtgcactacaccccccagcagaatggcctgaagaccaccaaggtgtccatcacagacctgctggcccacaccaactacacctttgagatctgggccgtgaatggagtgtccaagtacaaccccaacccagaccagagcgtgtctgtgacagtgaccaccaaccaggccgcccccagcagcatcgccctggtgcaggccaaggaggtgacccgctacagcgtggccctggcctggctggagccagaccggcccaatggagtcatcctggagtatgaggtgaagtactatgagaaggaccagaatgaaagaagctacagaattgtgaggacagctgccaggaacacagacatcaagggcctgaaccccctgaccagctatgtgttccacgtgcgggccaggacagctgctggctacggggacttcagcgagcccctggaggtgaccaccaacacagtgcccagccgcatcattggagatggagccaacagcacagtgctgctggtgtctgtgtctggctctgtggtgctggtggtgatcctgattgctgccttcgtcatcagcagaagaagaagcaagtacagcaaggccaagcaggaggctgatgaggagaagcacctgaaccagggcgtgaggacctacgtggaccccttcacctatgaggaccccaaccaggccgtgcgggagtttgccaaggagattgatgccagctgcatcaagattgagaaggtgattggagtgggggagtttggagaggtgtgcagcggccgcctgaaggtgcctgggaagcgggagatctgtgtggccatcaagaccctgaaggccggctacacagacaagcagaggcgggacttcctgtctgaggccagcatcatgggccagtttgaccaccccaacatcatccacctggagggcgtggtgaccaagtgcaagcctgtgatgatcatcacagagtacatggagaatggcagcctggatgccttcctgaggaagaatgatggccgcttcaccgtcatccagctggtgggcatgctgcggggcatcggcagcggcatgaagtacctgagtgacatgtcctatgtgcaccgggacctggccgccaggaacatcctggtgaacagcaacctggtgtgcaaggtgtctgactttggcatgagccgggtgctggaggatgatcctgaggccgcctacaccacccggggcggcaagatccccatccgctggacagcccctgaggccatcgcctacaggaagttcaccagcgccagtgatgtgtggagctatggaattgtgatgtgggaggtgatgtcctatggagagcggccctactgggacatgagcaaccaggatgtgatcaaggccatcgaggagggctaccgcctgcccccacccatggactgccccatcgccctgcaccagctgatgctggactgctggcagaaggagaggagtgaccggcccaagtttggccagatcgtgaacatgctggacaagctgatccggaaccccaacagcctgaagaggactggaacagagagcagccggcccaacacagccctgctggaccccagcagccctgagttctctgctgtggtgtctgtgggggactggctgcaggccatcaagatggaccgctacaaggacaacttcaccgctgctggctacaccaccctggaggccgtggtgcacgtgaaccaggaggacctggccagaattggcatcacagccatcacccaccagaacaagatcctgagctctgtgcaggccatgaggacccagatgcagcagatgcacggccgcatggtgcctgtgtag

SEQ ID NO: 34050 - DNA, 2850 bp, Artificial Sequence
  Description of Artificial Sequence: Synthetic coding sequence
atggccggcatcttctactttgccctcttcagctgcctgtttggcatctgtgatgctgtgacaggcagccgggtgtacccagccaatgaggtgaccctgctggacagccgctctgtgcagggcgagctgggctggatcgccagccccctggagggcggctgggaggaggtgtccatcatggatgagaagaacacccccatccgcacctaccaggtgtgcaatgtgatggagcccagccagaacaactggctgaggacagactggatcacccgggagggcgcccagagggtgtacatcgagatcaagttcaccctgcgggactgcaacagcctgcccggggtgatgggcacctgcaaggagaccttcaacctgtactactatgaaagtgacaatgacaaggagcgcttcatccgggagaaccagtttgtgaagattgacaccatcgccgcagatgagagcttcacccaggtggacattggagaccgcatcatgaagctgaacacagagatcagagatgtgggccccctgagcaagaagggcttctacctggccttccaggatgtgggcgcctgcatcgccctggtgtctgtgcgggtcttctacaagaagtgccccctgactgtgaggaacctggcccagttcccagacaccatcactggagctgacaccagcagcctggtggaggtgcggggcagctgtgtgaacaacagcgaggagaaggatgtgcccaagatgtactgtggggctgatggagagtggctggtgcccatcggcaactgcctgtgcaatgccggccacgaggagaggtctggagagtgccaggcctgcaagattggctactacaaggccctgagcacagatgccacctgtgccaagtgccccccccacagctacagcgtgtgggagggcgccaccagctgcacctgtgaccggggcttcttccgggctgacaatgatgctgcctccatgccctgcacccggccccccagcgcccccctgaacctgatcagcaatgtgaatgagacctctgtgaacctggagtggagcagcccccagaacacaggaggccggcaggacatctcctacaacgtggtgtgcaagaagtgtggggccggggaccccagcaagtgccggccctgtggcagcggcgtgcactacaccccccagcagaatggcctgaagaccaccaaggtgtccatcacagacctgctggcccacaccaactacacctttgagatctgggccgtgaatggagtgtccaagtacaaccccaacccagaccagagcgtgtctgtgacagtgaccaccaaccaggccgcccccagcagcatcgccctggtgcaggccaaggaggtgacccgctacagcgtggccctggcctggctggagccagaccggcccaacggggtcatcctggagtatgaggtgaagtactatgagaaggaccagaatgaaagaagctaccgcatcgtgaggacagctgccaggaacacagacatcaagggcctgaaccccctgaccagctatgtgttccacgtgcgggccaggacagctgctggctatggagacttcagcgagcccctggaggtgaccaccaacacagtgcccagccgcatcattggagatggagccaacagcacagtgctgctggtgtctgtgtctggctctgtggtgctggtggtgatcctgattgctgcctttgtgatcagcagaagaagaagcaagtacagcaaggccaagcaggaggctgatgaggagaagcacctgaaccagggcgtgaggacctacgtggaccccttcacctatgaggaccccaaccaggccgtgcgggagtttgccaaggagattgatgccagctgcatcaagattgagaaggtgattggagtgggggagtttggagaggtgtgcagcggccgcctgaaggtgcctgggaagcgggagatctgtgtggccatcaagaccctgaaggccggctacacagacaagcagaggcgggacttcctgtctgaggccagcatcatgggccagtttgaccaccccaacatcatccacctggagggcgtggtgaccaagtgcaagcctgtgatgatcatcacagagtacatggagaatggcagcctggatgccttcctgaggaagaatgatggccgcttcaccgtcatccagctggtgggcatgctgcggggcatcggcagcggcatgaagtacctgagtgacatgtcctatgtgcaccgggacctggccgccaggaacatcctggtgaacagcaacctggtgtgcaaggtgtctgactttggcatgagccgggtgctggaggatgatcctgaggccgcctacaccacccggggcggcaagatccccatccgctggacagcccctgaggccatcgcctacaggaagttcaccagcgccagtgatgtgtggagctatggcatcgtgatgtgggaggtgatgtcctatggagagcggccctactgggacatgagcaaccaggacgtcatcaaggccatcgaggagggctaccgcctgcccccacccatggactgccccatcgccctgcaccagctgatgctggactgctggcagaaggagaggagtgaccggcccaagtttggccagatcgtgaacatgctggacaagctgatccggaaccccaacagcctgaagaggactggaacagagagcagccggcccaacacagccctgctggaccccagcagccctgagttctctgctgtggtgtctgtgggggactggctgcaggccatcaagatggaccgctacaaggacaacttcaccgctgctggctacaccaccctggaggccgtggtgcacgtgaaccaggagtag

SEQ ID NO: 34051 - DNA, 2961 bp, Artificial Sequence; identical to SEQ ID NO: 34048
  Description of Artificial Sequence: Synthetic coding sequence

SEQ ID NO: 34052 - DNA, 276 bp, Artificial Sequence
  Description of Artificial Sequence: Synthetic coding sequence
atggccggcatcttctactttgccctcttcagctgcctgtttggcatctgtgatgctgtgacaggcagccgggtgtacccagccaatgaggtgaccctgctggacagccgctctgtgcagggcgagctgggctggatcgccagccccctggagggcggctgggaggaggtgtccatcatggatgagaagaacacccccatccgcacctaccaggtgtgcaatgtgatggagcccagccagaacaactggctgaggacagactggatcaccaggtag

SEQ ID NO: 34053 - DNA, 450 bp, Artificial Sequence
  Description of Artificial Sequence: Synthetic coding sequence
atggccggcatcttctactttgccctcttcagctgcctgtttggcatctgtgatgctgtgacaggcagccgggtgtacccagccaatgaggtgaccctgctggacagccgctctgtgcagggcgagctgggctggatcgccagccccctggagggcggctgggaggaggtgtccatcatggatgagaagaacacccccatccgcacctaccaggtgtgcaatgtgatggagcccagccagaacaactggctgaggacagactggatcacccgggagggcgcccagagggtgtacatcgagatcaagttcaccctgcgggactgcaacagcctgcccggggtgatgggcacctgcaaggagaccttcaacctgtactactatgaaagtgacaatgacaaggagcgcttcatccgggagaaccagtttgtgaagattgacaccatcgcctag

SEQ ID NO: 34054 - DNA, 840 bp, Artificial Sequence
  Description of Artificial Sequence: Synthetic coding sequence
atggtgttccagacccgctaccccagctggatcatcctgtgctacatctggctgctgcgctttgcccacactggagaggcccaggccgccaaggaggtgctgctgctggacagcaaggcccagcagacagagctggagtggatcagcagccccccaaatggctgggaggagatcagcggcctggatgagaactacacccccatccgcacctaccaggtgtgccaggtgatggagcccaaccagaacaactggctgcggaccaactggatcagcaaaggaaatgcccagaggatctttgtggagctgaagttcaccctgcgggactgcaacagcctgcccggggtgctgggcacctgcaaggagaccttcaacctgtactactatgaaacagattatgacaccggcaggaacatccgggagaacctgtatgtgaagattgacaccatcgctgctgatgagagcttcacccagggcgacctgggggagaggaagatgaagctgaacacagaggtgcgggagatcggccccctgagcaagaagggcttctacctggccttccaggatgtgggcgcctgcatcgccctggtgtctgtgaaggtgtactacaagaagtgctggagcatcatcgagaacctggccatcttcccagacacagtgacaggcagcgagttcagcagcctggtggaggtgcggggcacctgtgtgtcctctgctgaggaggaggctgaaaatgcccccaggatgcactgcagcgctgagggggagtggctggtgcccatcggcaagtgcatctgcaaggccggctaccagcagaagggggacacctgtgagaggaagtag

SEQ ID NO: 34055 - DNA, 2997 bp, Artificial Sequence
  Description of Artificial Sequence: Synthetic coding sequence
atggtgttccagacccgctaccccagctggatcatcctgtgctacatctggctgctgcgctttgcccacactggagaggcccaggccgccaaggaggtgctgctgctggacagcaaggcccagcagacagagctggagtggatcagcagccccccaaatggctgggaggagatcagcggcctggatgagaactacacccccatccgcacctaccaggtgtgccaggtgatggagcccaaccagaacaactggctgcggaccaactggatcagcaaaggaaatgcccagaggatctttgtggagctgaagttcaccctgcgggactgcaacagcctgcccggggtgctgggcacctgcaaggagaccttcaacctgtactactatgaaacagattatgacaccggcaggaacatccgggagaacctgtatgtgaagattgacaccatcgctgctgatgagagcttcacccagggcgacctgggggagaggaagatgaagctgaacacagaggtgcgggagatcggccccctgagcaagaagggcttctacctggccttccaggatgtgggcgcctgcatcgccctggtgtctgtgaaggtgtactacaagaagtgctggagcatcatcgagaacctggccatcttcccagacacagtgacaggcagcgagttcagcagcctggtggaggtgcggggcacctgtgtgtcctctgctgaggaggaggctgaaaatgcccccaggatgcactgcagcgctgagggggagtggctggtgcccatcggcaagtgcatctgcaaggccggctaccagcagaagggggacacctgtgagccctgtggccggggcttctacaagagcagcagccaggacctgcagtgcagccgctgccccacccacagcttcagtgacaaggagggcagcagccgctgtgaatgtgaagatggctactaccgggcccccagcgaccccccctacgtggcctgcaccaggcctccttctgccccccagaacctgatcttcaacatcaaccagaccaccgtgtccctggagtggagccccccagctgacaatggaggaagaaatgatgtgacctaccgcatcctgtgcaagcgctgctcctgggagcagggagaatgtgtgccctgtggcagcaacatcggctacatgccccagcagacaggcctggaggacaactacgtgacagtgatggacctgctggcccacgccaactacacctttgaggtggaggccgtgaatggagtgtctgacctgagccgcagccagaggctgtttgctgctgtgtccatcaccaccggccaggccgcccccagccaggtgtctggagtgatgaaggagcgggtgctgcagaggtctgtggagctgtcctggcaggagcctgagcaccccaacggggtcatcacagaatatgagatcaagtactatgagaaggaccagcgggagaggacctacagcacagtgaagaccaagagcaccagcgccagcatcaacaacctgaagccaggcaccgtgtatgtgttccagatccgggccttcaccgctgctggctacggcaactacagcccccggctggatgtggccaccctggaggaggccaccgggaagatgtttgaggccacagctgtgagcagcgagcagaaccctgtgatcatcatcgctgtggtggccgtggccggcaccatcatcctggtgttcatggtgtttggcttcatcatcggccgccgccactgcggctacagcaaggctgaccaggagggagatgaggagctgtacttccacttcaagtttcctggcaccaagacctacattgatcctgagacctatgaggaccccaacagagctgtgcaccagtttgccaaggagctggatgccagctgcatcaagattgagcgggtgattggagctggggagtttggagaggtgtgcagcggccgcctgaagctgcccgggaagagagatgtggccgtggccatcaagaccctgaaggtgggctacacagagaagcagaggcgggacttcctgtgtgaggccagcatcatgggccagtttgaccaccccaacgtggtgcacctggagggcgtggtgacccggggcaagcctgtgatgattgtgattgagttcatggagaatggagccctggatgccttcctgaggaagcatgatggccagttcaccgtcatccagctggtgggcatgctgcggggcattgctgctggcatgagatacctggccgacatgggctacgtgcaccgggacctggccgccaggaacatcctggtgaacagcaacctggtgtgcaaggtgtctgactttggcctgagccgggtgattgaagatgatcctgaggccgtgtacaccaccaccggcggcaagatccctgtgcgctggacagcccctgaggccatccagtacaggaagttcaccagcgccagtgatgtgtggagctatggcatcgtgatgtgggaggtgatgtcctatggagagcggccctactgggacatgagcaaccaggacgtcatcaaggccatcgaggagggctaccgcctgcctgcccccatggactgcccagctggcctgcaccagctgatgctggactgctggcagaaggagcgggcagagcggcccaagtttgagcagatcgtgggcatcctggacaagatgatccggaaccccaacagcctgaagacccccctgggcacctgcagccggcccatcagccccctgctggaccagaacaccccagacttcaccaccttctgcagcgtgggggagtggctgcaggccatcaagatggagcgctacaaggacaacttcaccgctgctggctacaacagcctggagagcgtggccaggatgaccattgaagatgtgatgagcctgggcatcaccctggtgggccaccagaagaagatcatgagcagcatccagaccatgagggcccagatgctgcacctgcacggcaccggcatccaggtgtag

SEQ ID NO: 34056 - DNA, 687 bp, Artificial Sequence
  Description of Artificial Sequence: Synthetic coding sequence
atgctgcacgtggagatgctgaccctggtgttcctggtgctgtggatgtgtgtgttcagccaggaccccggcagcaaggctgtggccgacagatatgctgtgtactggaacagcagcaacccccgcttccagagaggagactaccacattgatgtgtgcatcaatgactacctggatgtgttctgcccccactatgaggacagcgtgcctgaggacaagacagaaagatatgtgctgtacatggtgaactttgatggctacagcgcctgtgaccacaccagcaagggcttcaagcgctgggagtgcaaccggccccacagccccaacggccccctgaagttcagcgagaagttccagctgttcacccccttcagcctgggctttgagttccggcccggccgggagtacttctacatcagcagcgccatcccagacaatggccgccgcagctgcctgaagctgaaggtgtttgtgcggcccaccaacagctgcatgaagaccatcggcgtgcatgacagagtgtttgatgtgaatgacaaggtggagaacagcctggagccagcagatgacacagtgcatgaatctgctgagcccagcagaggagaaaatgctgcccagaccccccgcatccccagccggctgctggccatcctgctcttcctgctggccatgctgctgaccctgtag

SEQ ID NO: 34057 - DNA, 2595 bp, Artificial Sequence
  Description of Artificial Sequence: Synthetic coding sequence
atggccgcccccctcatccccctgagccagcagatccccaccggcaacagcctgtatgagagctactacaagcaggtggaccctgcctacacaggccgggtgggcgccagcgaggccgccctcttcctgaagaagagcggcctgagtgacatcatcctgggcaagatctgggacctggccgaccctgagggcaagggcttcctggacaagcagggcttctacgtggccctgcggctggtggcctgtgcccagagcggccacgaggtgaccctgagcaacctgaacctgtccatgcccccacccaagttccatgacaccagcagccccctgatggtgaccccacccagcgctgaggcccactgggccgtgcgggtggaggagaaggccaagtttgatggcatctttgagagcctgctgcccatcaatggcctgctgagcggggacaaggtgaagcctgtgctgatgaacagcaagctgcccctggatgtgctgggccgggtgtgggacctgagtgacatcgacaaggatggccacctggacagagatgaatttgctgtggccatgcacctggtgtaccgggccctggagaaggagcctgtgcccagcgccctgccccccagcctcatcccccccagcaagaggaagaagacagtgtttcctggagctgtgcctgtgctgcctgccagccccccacccaaggacagcctgcggagcacccccagccacggctctgtgagcagcctgaacagcacaggcagcctgagccccaagcacagcctgaagcagacccagcccaccgtgaactgggtggtgcctgtggccgacaagatgagatttgatgagatcttcctgaagacagacctggacctggatggctacgtgtctggccaggaggtgaaggagatcttcatgcacagcggcctgacccagaacctgctggcccacatctgggccctggccgacacccggcagacaggcaagctgagcaaggaccagtttgccctggccatgtacttcatccagcagaaggtgtccaagggcatcgaccccccccaggtgctgagcccagacatggtgccccccagcgagcggggcaccccaggccctgacagcagcggcagcctgggcagcggggagttcaccggggtgaaggagctggatgacatcagccaggagatcgcccagctgcagcgggagaagtacagcctggagcaggacatccgggagaaggaggaggccatccggcagaagaccagcgaggtgcaggagctgcagaatgacctggaccgggagaccagcagcctgcaggagctggaggcccagaagcaggatgcccaggaccggctggatgagatggaccagcagaaggccaagctgcgggacatgctgagtgatgtgcggcagaagtgccaggatgagacccagatgatcagcagcctgaagacccagatccagagccaggagagtgacctgaagagccaggaggatgacctgaacagagccaagtctgagctgaaccggctgcagcaggaggagacccagctggagcagagcatccaggccggccgggtgcagctggagaccatcatcaagagcctgaagagcacccaggatgagatcaaccaggcccggagcaagctgagccagctgcacgagagccggcaggaggcccacaggagcctggagcagtatgaccaggtgctggatggagcccacggggccagcctgacagacctggccaacctgtctgaaggagtgtccctggccgagcggggcagctttggagccatggatgaccccttcaagaacaaggccctgctcttcagcaacaacacccaggagctgcacccagaccccttccagacagaggaccccttcaagagtgaccccttcaagggagctgaccccttcaagggggaccccttccagaatgacccctttgctgagcagcagaccaccagcacagacccctttggaggagaccccttcaaggagagtgaccccttccggggcagcgccacagatgacttcttcaagaagcagaccaagaatgaccccttcaccagtgaccccttcaccaagaaccccagcctgcccagcaagctggacccctttgagagcagtgaccccttcagcagcagctctgtgagcagcaaaggaagtgaccccttcggcaccctggaccccttcggcagcggcagcttcaacagcgctgagggctttgctgacttcagccagatgagcaagcccccaccttctggccccttcaccagcagcctgggcggggccggcttcagtgatgaccccttcaagagcaagcaggacaccccagccctgccccccaagaagccagccccaccccggcccaagcccccatctgggaagagcacccctgtgtcccagctgggcagcgctgacttccctgaggccccagaccccttccagcccctgggcgctgacagcggggaccccttccagagcaagaagggctttggagaccccttcagcggcaaggacccctttgtgcccagcagcgctgccaagcccagcaaggccagcgccagcggctttgctgacttcacctctgtgtcctag

SEQ ID NO: 34058 - DNA, 2733 bp, Artificial Sequence
  Description of Artificial Sequence: Synthetic coding sequence
atggccgcccccctcatccccctgagccagcagatccccaccggcaacagcctgtatgagagctactacaagcaggtggaccctgcctacacaggccgggtgggcgccagcgaggccgccctcttcctgaagaagagcggcctgagtgacatcatcctgggcaagatctgggacctggccgaccctgagggcaagggcttcctggacaagcagggcttctacgtggccctgcggctggtggcctgtgcccagagcggccacgaggtgaccctgagcaacctgaacctgtccatgcccccacccaagttccatgacaccagcagccccctgatggtgaccccacccagcgctgaggcccactgggccgtgcgggtggaggagaaggccaagtttgatggcatctttgagagcctgctgcccatcaatggcctgctgagcggggacaaggtgaagcctgtgctgatgaacagcaagctgcccctggatgtgctgggccgggtgtgggacctgagtgacatcgacaaggatggccacctggacagagatgaatttgctgtggccatgcacctggtgtaccgggccctggagaaggagcctgtgcccagcgccctgccccccagcctcatcccccccagcaagaggaagaagacagtgtttcctggagctgtgcctgtgctgcctgccagccccccacccaaggacagcctgcggagcacccccagccacggctctgtgagcagcctgaacagcacaggcagcctgagccccaagcacagcctgaagcagacccagcccaccgtgaactgggtggtgcctgtggccgacaagatgagatttgatgagatcttcctgaagacagacctggacctggatggctacgtgtctggccaggaggtgaaggagatcttcatgcacagcggcctgacccagaacctgctggcccacatctgggccctggccgacacccggcagacaggcaagctgagcaaggaccagtttgccctggccatgtacttcatccagcagaaggtgtccaagggcatcgaccccccccaggtgctgagcccagacatggtgccccccagcgagcggggcaccccaggccctgacagcagcggcagcctgggcagcggggagttcaccggggtgaaggagctggatgacatcagccaggagatcgcccagctgcagcgggagaagtacagcctggagcaggacatccgggagaaggaggaggccatccggcagaagaccagcgaggtgcaggagctgcagaatgacctggaccgggagaccagcagcctgcaggagctggaggcccagaagcaggatgcccaggaccggctggatgagatggaccagcagaaggccaagctgcgggacatgctgagtgatgtgcggcagaagtgccaggatgagacccagatgatcagcagcctgaagacccagatccagagccaggagagtgacctgaagagccaggaggatgacctgaacagagccaagtctgagctgaaccggctgcagcaggaggagacccagctggagcagagcatccaggccggccgggtgcagctggagaccatcatcaagagcctgaagagcacccaggatgagatcaaccaggcccggagcaagctgagccagctgcacgagagccggcaggaggcccacaggagcctggagcagtatgaccaggtgctggatggagcccacggggccagcctgacagacctggccaacctgtctgaaggagtgtccctggccgagcggggcagctttggagccatggatgaccccttcaagaacaaggccctgctcttcagcaacaacacccaggagctgcacccagaccccttccagacagaggaccccttcaagagtgaccccttcaagggagctgaccccttcaagggggaccccttccagaatgacccctttgctgagcagcagaccaccagcacagacccctttggaggagaccccttcaaggagagtgaccccttccggggcagcgccacagatgacttcttcaagaagcagaccaagaatgaccccttcaccagtgaccccttcaccaagaaccccagcctgcccagcaagctggacccctttgagagcagtgaccccttcagcagcagctctgtgagcagcaaaggaagtgaccccttcggcaccctggaccccttcggcagcggcagcttcaacagcgctgagggctttgctgacttcagccagatgagcaagcccccaccttctggccccttcaccagcagcctgggcggggccggcttcagtgatgaccccttcaagagcaagcaggacaccccagccctgccccccaagaagccagccccaccccggcccaagcccccatctgggaagagcacccctgtgtcccagctgggcagcgctgacttccctgaggccccagaccccttccagcccctgggcgctgacagcggggaccccttccagagcaagaagggctttggagaccccttcagcggcaaggacccctttgtgcccagcagcgctgccaagcccagcaaggccagcgccagcggctttgctgacttcaccagctttggaaatgaggagcagcagctggcctgggccaagcgggagagcgagaaggccgagcaggagcggctggcccggctgcggcggcaggagcaggaggacctggagctggccatcgccctgagcaaggctgacatgcctgctgcctag

SEQ ID NO: 34059 - DNA, 2265 bp, Artificial Sequence
  Description of Artificial Sequence: Synthetic coding sequence
atggccgcccccctcatccccctgagccagcagatccccaccggcaacagcctgtatgagagctactacaagcaggtggaccctgcctacacaggccgggtgggcgccagcgaggccgccctcttcctgaagaagagcggcctgagtgacatcatcctgggcaagatctgggacctggccgaccctgagggcaagggcttcctggacaagcagggcttctacgtggccctgcggctggtggcctgtgcccagagcggccacgaggtgaccctgagcaacctgaacctgtccatgcccccacccaagttccatgacaccagcagccccctgatggtgaccccacccagcgctgaggcccactgggccgtgcgggtggaggagaaggccaagtttgatggcatctttgagagcctgctgcccatcaatggcctgctgagcggggacaaggtgaagcctgtgctgatgaacagcaagctgcccctggatgtgctgggccgggtgtgggacctgagtgacatcgacaaggatggccacctggacagagatgaatttgctgtggccatgcacctggtgtaccgggccctggagaaggagcctgtgcccagcgccctgccccccagcctcatcccccccagcaagaggaagaagacagtgtttcctggagctgtgcctgtgctgcctgccagccccccacccaaggacagcctgcggagcacccccagccacggctctgtgagcagcctgaacagcacaggcagcctgagccccaagcacagcctgaagcagacccagcccaccgtgaactgggtggtgcctgtggccgacaagatgagatttgatgagatcttcctgaagacagacctggacctggatggctacgtgtctggccaggaggtgaaggagatcttcatgcacagcggcctgacccagaacctgctggcccacatctgggccctggccgacacccggcagacaggcaagctgagcaaggaccagtttgccctggccatgtacttcatccagcagaaggtgtccaagggcatcgaccccccccaggtgctgagcccagacatggtgccccccagcgagcggggcaccccaggccctgacagcagcggcagcctgggcagcggggagttcaccggggtgaaggagctggatgacatcagccaggagatcgcccagctgcagcgggagaagtacagcctggagcaggacatccgggagaaggaggaggccatccggcagaagaccagcgaggtgcaggagctgcagaatgacctggaccgggagaccagcagcctgcaggagctggaggcccagaagcaggatgcccaggaccggctggatgagatggaccagcagaaggccaagctgcgggacatgctgagtgatgtgcggcagaagtgccaggatgagacccagatgatcagcagcctgaagacccagatccagagccaggagagtgacctgaagagccaggaggatgacctgaacagagccaagtctgagctgaaccggctgcagcaggaggagacccagctggagcagagcatccaggccggccgggtgcagctggagaccatcatcaagagcctgaagagcacccaggatgagatcaaccaggcccggagcaagctgagccagctgcacgagagccggcaggaggcccacaggagcctggagcagtatgaccaggtgctggatggagcccacggggccagcctgacagacctggccaacctgtctgaaggagtgtccctggccgagcggggcagctttggagccatggatgaccccttcaagaacaaggccctgctcttcagcaacaacacccaggagctgcacccagaccccttccagacagaggaccccttcaagagtgaccccttcaagggagctgaccccttcaagggggaccccttccagaatgacccctttgctgagcagcagaccaccagcacagacccctttggaggagaccccttcaaggagagtgaccccttccggggcagcgccacagatgacttcttcaagaagcagaccaagaatgaccccttcaccagtgaccccttcaccaagaaccccagcctgcccagcaagctggacccctttgagagcagtgaccccttcagcagcagctctgtgagcagcaaaggaagtgaccccttcggcaccctggaccccttcggcagcggcagcttcaacagcgctgagggctttgctgacttcagccagatgagcaaggtgaaggtgcacctgtag

SEQ ID NO: 34060 - DNA, 1806 bp, Artificial Sequence
  Description of Artificial Sequence: Synthetic coding sequence
atggccgcccccctcatccccctgagccagcagatccccaccggcaacagcctgtatgagagctactacaagcaggtggaccctgcctacacaggccgggtgggcgccagcgaggccgccctcttcctgaagaagagcggcctgagtgacatcatcctgggcaagatctgggacctggccgaccctgagggcaagggcttcctggacaagcagggcttctacgtggccctgcggctggtggcctgtgcccagagcggccacgaggtgaccctgagcaacctgaacctgtccatgcccccacccaagttccatgacaccagcagccccctgatggtgaccccacccagcgctgaggcccactgggccgtgcgggtggaggagaaggccaagtttgatggcatctttgagagcctgctgcccatcaatggcctgctgagcggggacaaggtgaagcctgtgctgatgaacagcaagctgcccctggatgtgctgggccgggtgtgggacctgagtgacatcgacaaggatggccacctggacagagatgaatttgctgtggccatgcacctggtgtaccgggccctggagaaggagcctgtgcccagcgccctgccccccagcctcatcccccccagcaagaggaagaagacagtgtttcctggagctgtgcctgtgctgcctgccagccccccacccaaggacagcctgcggagcacccccagccacggctctgtgagcagcctgaacagcacaggcagcctgagccccaagcacagcctgaagcagacccagcccaccgtgaactgggtggtgcctgtggccgacaagatgagatttgatgagatcttcctgaagacagacctggacctggatggctacgtgtctggccaggaggtgaaggagatcttcatgcacagcggcctgacccagaacctgctggcccacatctgggccctggccgacacccggcagacaggcaagctgagcaaggaccagtttgccctggccatgtacttcatccagcagaaggtgtccaagggcatcgaccccccccaggtgctgagcccagacatggtgccccccagcgagcggggcaccccaggccctgacagcagcggcagcctgggcagcggggagttcaccggggtgaaggagctggatgacatcagccaggagatcgcccagctgcagcgggagaagtacagcctggagcaggacatccgggagaaggaggaggccatccggcagaagaccagcgaggtgcaggagctgcagaatgacctggaccgggagaccagcagcctgcaggagctggaggcccagaagcaggatgcccaggaccggctggatgagatggaccagcagaaggccaagctgcgggacatgctgagtgatgtgcggcagaagtgccaggatgagacccagatgatcagcagcctgaagacccagatccagagccaggagagtgacctgaagagccaggaggatgacctgaacagagccaagtctgagctgaaccggctgcagcaggaggagacccagctggagcagagcatccaggccggccgggtgcagctggagaccatcatcaagagcctgaagagcacccaggatgagatcaaccaggcccggagcaagctgagccagctgcacgagagccggcaggaggcccacaggagcctggagcagtatgaccaggtgctggatggagcccacggggccagcctgacagacctggccaacctgtctgaaggagtgtccctggccgagcggggcagctttggagccatggtgaaggtggagtag

SEQ ID NO: 34061 - DNA, 1824 bp, Artificial Sequence
  Description of Artificial Sequence: Synthetic coding sequence
atgtggatgacccccaagaggagcaagatggaggtggatgaggccctggtgttccggcctgagtggacccagcgctacctggtggtggagcccccagaaggagatggagccctgtgcctggtgtgcagaagactcatcgtggccacccgggagagagatgtgagaagacactatgaggccgagcacgagtactatgagcgctacgtggctgatggagagagagctgccctggtggagcggctgcggcagggcgacctgcctgtggccagcttcaccccagaggagagagctgcccgggccggcctgggcctgtgccgcctgctggccctgaagggccggggctggggcgagggggactttgtgtaccagtgcatggaggtgctgctgcgggaggtgctgcctgagcacgtgtctgtgctgcagggcgtggacctgagcccagacatcacccggcagaggatcctgagcattgacaggaacctgaggaaccagctgttcaacagagcccgggacttcaaggcctacagcctggccctggatgaccaggcctttgtggcctatgagaactacctgctggtgttcatccggggcgtgggccctgagctggaggtgcaggaggacctgctgaccatcatcaacctgacccaccacttctctgtgggcgccctgatgtctgccatcctggagagcctgcagacagctggcctgagcctgcagaggatggtgggcctgaccaccacccacaccctgaggatgattggagaaaattctggcctggtgtcctacatgagggagaaggctgtgagccccaactgctggaatgtcatccactacagcggcttcctgcacctggagctgctgagcagctatgatgtggatgtgaaccagatcatcaacaccatcagcgagtggatcgtgctgatcaagacccggggcgtgcggcggcctgagttccagaccctgctgacagaaagtgaaagtgaacatggagagcgggtgaatggccgctgcctgaacaactggctgcggcggggcaagaccctgaagctgatcttcagcctgaggaaggagatggaggccttcctggtgtctgtgggcgccaccaccgtgcacttcagtgacaagcagtggctgtgtgactttggcttcctggtggacatcatggagcacctgcgggagctgtctgaggagctgcgggtgtccaaggtgtttgctgctgctgcctttgaccacatctgcacctttgaggtgaagctgaacctcttccagaggcacatcgaggagaagaacctgacagacttccctgccctgcgggaggtggtggatgagctgaagcagcagaacaaggaggatgagaagatctttgatcctgaccgctaccagatggtgatctgccgcctgcagaaggagtttgagcggcacttcaaggacctgcgcttcatcaagaaggacctggagctgttcagcaaccccttcaacttcaagccagaatatgcccccatctctgtgcgggtggagctgaccaagctgcaggccaacaccaacctgtggaatgagtaccgcatcaaggacctgggccagttctacgccggcctgtctgctgagagctaccccatcatcaagggcgtggcctgcaaggtggccagcctgtttgacagcaaccagatctgtgagaaggccttctcctacctgaccaggaaccagcacaccctgagccagcccctgacagatgagcacctgcaggccctcttccgggtggccaccacagagatggagcccggctgggatgacctggtgcgggagagaaatgaaagcaacccctag

SEQ ID NO: 34062 - DNA, 1089 bp, Artificial Sequence
  Description of Artificial Sequence: Synthetic coding sequence
atggcccggctgcgggactgcctgccccggctgatgctgaccctgcggagcctgctcttctggagcctggtgtactgctactgcggcctgtgtgccagcatccacctgctgaagctgctgtggagcctgggcaaaggacctgcccagaccttccggcggcctgcccgggagcaccccccagcctgcctgagtgaccccagcctgggcacccactgctacgtgcgcatcaaggacagcggcctgcgcttccactacgtggccgccggggagcggggcaagcccctgatgctgctgctgcacggcttccctgagttctggtacagctggagataccagctgcgggagttcaagtctgagtacagagtggtggccctggacctgcggggctacggggagacagatgcccccatccaccggcagaactacaagctggactgcctgatcacagacatcaaggacatcctggacagcctgggctacagcaaatgtgtgctgattggacatgactggggcggcatgattgcctggctgattgccatctgctacccagagatggtgatgaagctgattgtcatcaacttcccccaccccaacgtgttcacagagtacatcctgcggcacccagcccagctgctgaagagcagctactactacttcttccagatcccctggttccctgagttcatgttcagcatcaatgacttcaaggtgctgaagcacctgttcaccagccacagcactggaattggaaggaagggctgccagctgaccacagaggacctggaggcctacatctacgtgttcagccagcccggggccctgagcggccccatcaaccactacagaaacatcttcagctgcctgcccctgaagcaccacatggtgaccacccccaccctgctgctgtggggagaaaatgatgccttcatggaggtggagatggccgaggtgaccaagatctacgtgaagaactacttccggctgaccatcctgtctgaggccagccactggctgcagcaggaccagcctgacatcgtgaacaagctgatctggaccttcctgaaggaggagaccaggaagaaggactag

SEQ ID NO: 34063 - DNA, 1974 bp, Artificial Sequence
  Description of Artificial Sequence: Synthetic coding sequence
atgcagtggagggccctggtgctgggcctggtgctgctgcggctgggcctgcacggcgtgctgtggctggtgtttggcctgggccccagcatgggcttctaccagcgcttccccctgagctttggcttccagaggctgcggagcccagatggccctgccagccccaccagcggccctgtgggccggcctggaggagtgtctggccccagctggctgcagcccccaggcactggagctgcccagagccccaggaaggccccccggcggcccggccctggcatgtgtggccctgccaactggggctacgtgctgggcggccggggccggggcccagatgaatatgagaagcgctacagcggggccttccccccccagctgcgggcccagatgagggacctggcccggggcatgtttgtgtttggctatgacaactacatggcccacgccttcccccaggatgagctgaaccccatccactgccggggccggggccctgacagaggagaccccagcaacctgaacatcaatgatgtgctgggcaactacagcctgaccctggtggatgccctggacaccctggccatcatgggcaacagcagcgagttccagaaggctgtgaagctggtgatcaacacagtgtcctttgacaaggacagcacagtgcaggtgtttgaggccaccatccgggtgctgggcagcctgctgagcgcccaccgcatcatcacagacagcaagcagccctttggagacatgaccatcaaggactatgacaatgagctgctgtacatggcccatgacctggccgtgcggctgctgcctgcctttgagaacaccaagacaggcatcccctacccccgggtgaacctgaagacaggagtgcccccagacaccaacaatgagacctgcacagctggggccggcagcctgctggtggagtttggcatcctgagccggctgctgggggacagcacctttgagtgggtggcccggcgggctgtgaaggccctgtggaacctgcggagcaatgacaccggcctgctgggcaatgtggtgaacatccagacaggccactgggtgggcaagcagagcggcctgggcgccggcctggacagcttctatgagtacctgctgaagagctacatcctgtttggagagaaggaggacctggagatgtttaatgctgcctaccagagcatccagaactacctgcggcggggccgggaggcctgcaatgaaggagagggggacccccccctgtatgtgaatgtgaacatgttttctggccagctgatgaacacctggattgacagcctgcaggccttcttccctggcctgcaggtgctgattggagatgtggaggatgccatctgcctgcacgccttctactatgccatctggaagagatatggagccctgcctgagcgctacaactggcagctgcaggccccagatgtgctcttctaccccctgcggcctgagctggtggagagcacctacctgctgtaccaggccaccaagaaccccttctacctgcacgtgggcatggacatcctgcagagcctggagaagtacaccaaggtgaagtgtggctacgccaccctgcaccacgtgattgacaagagcacagaggacaggatggagagcttcttcctgtctgagacctgcaagtacctgtacctgctgtttgatgaggacaaccctgtgcacaagagcggcacccgctacatgttcaccacagagggccacatcgtgtctgtggatgagcacctgcgggagctgccctggaaggagttcttcagcgaggagggcggccaggaccagggcggcaagtctgtgcaccggcccaagccccatgagctgaaggtgatcaacagcagcagcaactgcaacagagtgcctgatgagcggcgctacagcctgcccctgaagagcatctacatgaggcagattgaccagatggtgggcctcatctag

SEQ ID NO: 34064 - DNA, 639 bp, Artificial Sequence
  Description of Artificial Sequence: Synthetic coding sequence
atgcactggatccacctgcaggtgctgggcagcctgctgagcgcccaccgcatcatcacagacagcaagcagccctttggagacatgaccatcaaggactatgacaatgagctgctgtacatggcccatgacctggccgtgcggctgctgcctgcctttgagaacaccaagacaggcatcccctacccccgggtgaacctgaagacaggagtgcccccagacaccaacaatgagacctgcacagctggggccggcagcctgctggtggagtttggcatcctgagccggctgctgggggacagcacctttgagtgggtggcccggcgggctgtgaaggccctgtggaacctgcggagcaatgacaccggcctgctgggcaatgtggtgaacatccagacaggccactgggtgggcaagcagagcggcctgggcgccggcctggacagcttctatgagtacctgctgaagagctacatcctgtttggagagaaggaggacctggagatgtttaatgctgcctaccagagcatccagaactacctgcggcggggccgggaggcctgcaatgaaggagagggggacccccccctgtgccagcgggagcacgtgcagtgggccgcagatgagcacctggactag

SEQ ID NO: 34065 - DNA, 1131 bp, Artificial Sequence
  Description of Artificial Sequence: Synthetic coding sequence
atgggcaacagcagcgagttccagaaggctgtgaagctggtgatcaacacagtgtcctttgacaaggacagcacagtgcaggtgtttgaggccaccatccgggtgctgggcagcctgctgagcgcccaccgcatcatcacagacagcaagcagccctttggagacatgaccatcaaggactatgacaatgagctgctgtacatggcccatgacctggccgtgcggctgctgcctgcctttgagaacaccaagacaggcatcccctacccccgggtgaacctgaagacaggagtgcccccagacaccaacaatgagacctgcacagctggagctggcagcctgctggtggagtttggcatcctgagccggctgctgggggacagcacctttgagtgggtggccaggagagctgtgaaggccctgtggaacctgcggagcaatgacaccggcctgctgggcaatgtggtgaacatccagacaggccactgggtgggcaagcagagcggcctgggcgccggcctggacagcttctatgagtacctgctgaagagctacatcctgtttggagagaaggaggacctggagatgtttaatgctgcctaccagagcatccagaactacctgcggcggggccgggaggcctgcaatgaaggagagggggacccccccctgtatgtgaatgtgaacatgttcagcggccagctgatgaacacctggattgacagcctgcaggccttcttccctggcctgcaggtgctgattggagatgtggaggatgccatctgcctgcacgccttctactatgccatctggaagcgctacggggccctgcctgagcgctacaactggcagctgcaggccccagatgtgctcttctaccccctgcggcctgagctggtggagagcacctacctgctgtaccaggccaccaagaaccccttctacctgcacgtgggcatggacatcctgcagagcctggagaagtacaccaaggtgaagtgtggctacgccaccctgcaccacgtgattgacaagagcacagaggacaggatggagagcttcttcctgtctgagacctgcaagtacctgtacctggtgtgtgtgctgcaggatgagcccaggaacatctag

SEQ ID NO: 34066 - DNA, 2799 bp, Artificial Sequence
  Description of Artificial Sequence: Synthetic coding sequence
atgtctgaggccggcggccggggctgcggcagccctgtgccccagagggcccgctggaggctggtggccgccacagctgccttctgcctggtgtctgccacctctgtgtggacagctggagctgagcccatgagccgggaggagaagcagaagctgggcaaccaggtgctggagatgtttgaccacgcctacggcaactacatggagcacgcctacccagcagatgagctgatgcccctgacctgccggggccgggtgcggggccaggagcccagcagaggagatgtggatgatgccctgggcaagttcagcctgaccctgattgacagcctggacaccctggtggtgctgaacaagaccaaggagtttgaagatgctgtgaggaaggtgctgagagatgtgaacctggacaatgatgtggtggtgtctgtgtttgagaccaacatccgggtgctgggcggcctgctgggcggccacagcctggccatcatgctgaaggagaagggggagtacatgcagtggtacaatgatgagctgctgcagatggccaagcagctgggctacaagctgctgcctgccttcaacaccaccagcggcctgccctacccccgcatcaacctgaagtttggcatcaggaagccagaggccaggactggaacagaaacagacacctgcacagcctgtgccggcaccctcatcctggagtttgctgccctgagccgcttcaccggggccaccatctttgaggagtatgccaggaaggccctggacttcctgtgggagaagaggcagaggagcagcaacctggtgggcgtgaccatcaacatccacactggagactgggtgaggaaggacagcggcgtgggcgccggcatcgacagctactatgagtacctgctgaaggcctacgtgctgctgggagatgacagcttcctggagcgcttcaacacccactatgatgccatcatgagatacatcagccagccccccctgctgctggatgtgcacatccacaagcccatgctgaatgcccggacctggatggatgccctgctggccttcttccctggcctgcaggtgctgaagggggacatccggcctgccatcgagacccatgagatgctgtaccaggtgatcaagaagcacaacttcctgcctgaggccttcaccacagacttccgggtgcactgggcccagcaccccctgcggcctgagtttgctgagagcacctacttcctgtacaaggccactggagacccctactacctggaggtgggcaagaccctgattgagaacctgaacaagtatgcccgggtgccctgtggctttgctgccatgaaggatgtgaggacaggcagccatgaggacaggatggacagcttcttcctggccgagatgttcaagtacctgtacctgctgtttgctgacaaggaggacatcatctttgatattgaggactacatcttcaccacagaggcccacctgctgcccctgtggctgagcaccaccaaccagagcatcagcaagaagaacaccaccagcgagtacacagagctggatgacagcaactttgactggacctgccccaacacccagatcctcttccccaatgaccccctgtatgcccagagcatccgggagcccctgaagaatgtggtggacaagagctgcccccggggcatcatccgggtggaggagagcttccgcagcggggccaagccacccctgcgggcccgggacttcatggccaccaaccctgagcacctggagatcctgaagaagatgggcgtgtccctcatccacctgaaggatggccgggtgcagctggtgcagcacgccatccaggccgccagcagcattgatgctgaagatggcctgcgcttcatgcaggagatgattgagctgagcagccagcagcagaaggagcagcagctgccccccagggctgtgcagatcgtgagccaccccttcttcggccgggtggtgctgacagctggccctgcccagtttggcctggacctgagcaagcacaaggagacccggggctttgtggccagcagcaagcccagcaatggctgcagcgagctgaccaaccctgaggccgtgatgggcaagatcgccctgatccagaggggccagtgcatgtttgctgagaaggccaggaacatccagaatgctggggccatcggcggcatcgtgattgatgacaatgaaggcagcagcagtgacacagcccccctcttccagatggctggagatggcaaggacacagatgacatcaagatccccatgctgttcctgttcagcaaggagggcagcatcatcctggatgccatccgggagtatgaggaggtggaggtgctgctgagtgacaaggccaaggaccgggaccctgagatggagaatgaggagcagcccagcagtgaaaatgacagccagaaccagagcggggagcagatcagcagcagcagccaggaggtggacctggtggaccaggagagcagcgaggagaacagcctgaacagccaccctgagagcctgagcctggccgacatggacaatgctgccagcatcagccccagcgagcagaccagcaaccccacagaaaatcatgagaccaccaacctgaatggagaatgtacagacctggacaaccagctgcaggagcagagcgagacagaggaggacagcaaccccaacgtgtcctggggcaagaaggtgcagcccatcgacagcatcctggccgactggaatgaagatattgaggcctttgagatgatggagaaggatgagctgtag

SEQ ID NO: 34067 - DNA, 2718 bp, Artificial Sequence
  Description of Artificial Sequence: Synthetic coding sequence
atgagccgggaggagaagcagaagctgggcaaccaggtgctggagatgtttgaccacgcctacggcaactacatggagcacgcctacccagcagatgagctgatgcccctgacctgccggggccgggtgcggggccaggagcccagcagaggagatgtggatgatgccctgggcaagttcagcctgaccctgattgacagcctggacaccctggtggtgctgaacaagaccaaggagtttgaagatgctgtgaggaaggtgctgagagatgtgaacctggacaatgatgtggtggtgtctgtgtttgagaccaacatccgggtgctgggcggcctgctgggcggccacagcctggccatcatgctgaaggagaagggggagtacatgcagtggtacaatgatgagctgctgcagatggccaagcagctgggctacaagctgctgcctgccttcaacaccaccagcggcctgccctacccccgcatcaacctgaagtttggcatcaggaagccagaggccaggactggaacagaaacagacacctgcacagcctgtgccggcaccctcatcctggagtttgctgccctgagccgcttcaccggggccaccatctttgaggagtatgccaggaaggccctggacttcctgtgggagaagaggcagaggagcagcaacctggtgggcgtgaccatcaacatccacactggagactgggtgaggaaggacagcggcgtgggcgccggcatcgacagctactatgagtacctgctgaaggcctacgtgctgctgggagatgacagcttcctggagcgcttcaacacccactatgatgccatcatgagatacatcagccagccccccctgctgctggatgtgcacatccacaagcccatgctgaatgcccggacctggatggatgccctgctggccttcttccctggcctgcaggtgctgaagggggacatccggcctgccatcgagacccatgagatgctgtaccaggtgatcaagaagcacaacttcctgcctgaggccttcaccacagacttccgggtgcactgggcccagcaccccctgcggcctgagtttgctgagagcacctacttcctgtacaaggccaccggggacccctactacctggaggtgggcaagaccctgattgagaacctgaacaagtatgcccgggtgccctgtggctttgctgccatgaaggatgtgaggacaggcagccatgaggacaggatggacagcttcttcctggccgagatgttcaagtacctgtacctgctgtttgctgacaaggaggacatcatctttgatattgaggactacatcttcaccacagaggcccacctgctgcccctgtggctgagcaccaccaaccagagcatcagcaagaagaacaccaccagcgagtacacagagctggatgacagcaactttgactggacctgccccaacacccagatcctcttccccaatgaccccctgtatgcccagagcatccgggagcccctgaagaatgtggtggacaagagctgcccccggggcatcatccgggtggaggagagcttccgcagcggggccaagccacccctgcgggcccgggacttcatggccaccaaccctgagcacctggagatcctgaagaagatgggcgtgtccctcatccacctgaaggatggccgggtgcagctggtgcagcacgccatccaggccgccagcagcattgatgctgaagatggcctgcgcttcatgcaggagatgattgagctgagcagccagcagcagaaggagcagcagctgccccccagggctgtgcagatcgtgagccaccccttcttcggccgggtggtgctgacagctggccctgcccagtttggcctggacctgagcaagcacaaggagacccggggctttgtggccagcagcaagcccagcaatggctgcagcgagctgaccaaccctgaggccgtgatgggcaagatcgccctgatccagaggggccagtgcatgtttgctgagaaggccaggaacatccagaatgctggggccatcggcggcatcgtgattgatgacaatgaaggcagcagcagtgacacagcccccctcttccagatggctggagatggcaaggacacagatgacatcaagatccccatgctgttcctgttcagcaaggagggcagcatcatcctggatgccatccgggagtatgaggaggtggaggtgctgctgagtgacaaggccaaggaccgggccgccatcctgaagggcaagatgatccccagctacatcatcaacagcaaccctgagatggagaatgaggagcagcccagcagtgaaaatgacagccagaaccagagcggggagcagatcagcagcagcagccaggaggtggacctggtggaccaggagagcagcgaggagaacagcctgaacagccaccctgagagcctgagcctggccgacatggacaatgctgccagcatcagccccagcgagcagaccagcaaccccacagagaaccacgagaccaccaacctgaatggagagtgcacagacctggacaaccagctgcaggagcagagcgagacagaggaggacagcaaccccaacgtgtcctggggcaagaaggtgcagcccatcgacagcatcctggccgactggaatgaagacatcgaggcctttgagatgatggagaaggatgagctgtag

SEQ ID NO: 34068 - DNA, 1314 bp, Artificial Sequence
  Description of Artificial Sequence: Synthetic coding sequence
atggccgcccccagctggaggggggcccggctggtgcagagcgtgctgcgggtgtggcaggtgggcccccacgtggcccgggagagggtcatccccttcagcagcctgctgggcttccagaggcgctgtgtgtcctgtgtggccggcagcgccttcagcggcccccggctggccagcgccagccgcagcaatggccagggcagcgccctggaccacttcctgggcttcagccagcctgacagctctgtgaccccctgtgtgcctgctgtgtccatgaacagagatgagcaggatgtgctgctggtgcaccacccagacatgcctgagaacagccgggtgctgcgggtggtgctgctgggcgccccaaatgctgggaagagcaccctgagcaaccagctgctgggcaggaaggtgtttcctgtgtccaggaaggtgcacaccacccgctgccaggccctgggcgtcatcacagagaaggagacccaggtgatcctgctggacaccccaggcatcatcagccctgggaagcagaagaggcaccacctggagctgagcctgctggaggacccctggaagtccatggagagcgctgacctggtggtggtgctggtggatgtgtctgacaagtggaccaggaaccagctgagcccccagctgctgcgctgcctgaccaagtacagccagatccccagcgtgctggtgatgaacaaggtggactgcctgaagcagaagtctgtgctgctggagctgacagctgccctgacagaaggagtggtgaatggcaagaagctgaagatgaggcaggccttccacagccaccctggcacccactgccccagccctgctgtgaaggaccccaacacccagagcgtgggcaacccccagagaattggctggccccacttcaaggagatcttcatgctgagcgccctgagccaggaggatgtgaagaccctgaagcagtacctgctgacccaggcccagcccggcccctgggagtaccacagcgctgtgctgaccagccagaccccagaggagatctgtgccaacatcatccgggagaagctgctggagcacctgccccaggaggtgccctacaacgtgcagcagaagacagctgtgtgggaggagggccctggaggagagctggtgatccagcagaagctgctggtgcccaaggagagctatgtgaagctgctgattggccccaagggccacgtgatcagccagatcgcccaggaggccggccatgacctgatggacatcttcctgtgtgatgtggacatccggctgtctgtgaagctgctgaagtag

SEQ ID NO: 34069 - DNA, 732 bp, Artificial Sequence
  Description of Artificial Sequence: Synthetic coding sequence
atgagcaggatgagctcctggagcatcaccctcatctgcctgcgcatccctggcagctatgagtggagctcctgggagcccaggatgcagggcagccagcacagccccaccagctactgggccgagcgctgcagcctcttccctggccgctgcatcctgctggccgccaagctgtggggcagcagccagaggagaagaccccgctggtgggtgcccaccaagggcgtgctggagaccggccagagggtgaagctgcggggcagccccctgcccagcgccctgaagaagatgatggtgaccttcatctacatcctgctggacaccccaggcatcatcagccctgggaagcagaagaggcaccacctggagctgagcctgctggaggacccctggaagtccatggagagcgctgacctggtggtggtgctggtggatgtgtctgacaagtggaccaggaaccagctgagcccccagctgctgcgctgcctgaccaagtacagccagatccccagcgtgctggtgatgaacaaggtggactgcctgaagcagaagtctgtgctgctggagctgacagctgccctgacagaaggagtggtgaatggcaagaagctgaagatgaggcaggccttccacagccaccctggcacccactgccccagccctgctgtgaaggaccccaacacccagagcgtgggcaacccccagagaattggctggccccacttcaagtag

SEQ ID NO: 34070 - DNA, 1167 bp, Artificial Sequence
  Description of Artificial Sequence: Synthetic coding sequence
atggaggccctgggcaagctgaagcagtttgatgcctaccccaagaccctggaggacttccgggtgaagacctgtggcggggccaccgtgaccatcgtgtctggcctgctgatgctgctgctcttcctgtctgagctgcagtactacctgaccacagaggtgcaccctgagctgtatgtggacaagagcagaggagacaagctgaagatcaacattgatgtgctcttcccccacatgccctgtgcctacctgagcattgatgccatggatgtggccggggagcagcagctggatgtggagcacaacctcttcaagcagaggctggacaaggatggcatccctgtgtcctctgaggccgagagacatgagctgggcaaggtggaggtgacagtgtttgatcctgacagcctggaccctgacagatgtgagagctgctacggggctgaggccgaggacatcaagtgctgcaacacctgtgaagatgtgcgggaggcctacagaagaagaggctgggccttcaagaacccagacaccatcgagcagtgcagaagagagggcttcagccagaagatgcaggagcagaagaatgaaggctgccaggtgtatggcttcctggaggtgaacaaggtggccggcaacttccactttgcccctgggaagagcttccagcagagccacgtgcacgtgcagggcgaggaggtgcatgacctgcagagctttggcctggacaacatcaacatgacccactacatccagcacctgagctttggagaggactacccaggcatcgtgaaccccctggaccacaccaacgtgacagccccccaggcctccatgatgttccagtactttgtgaaggtggtgcccaccgtgtacatgaaggtggatggagaggtgctgcggaccaaccagttctctgtgaccaggcatgagaaggtggccaacggcctgctgggggaccagggcctgcccggggtgtttgtgctgtatgagctgagccccatgatggtgaagctgacagagaagcaccgctccttcacccacttcctgactggagtgtgtgccatcattggaggcatgttcaccgtggccggcctgattgacagcctcatctaccacagcgcccgggccatccagaagaagattgacctgggcaagaccacctag

SEQ ID NO: 34071 - DNA, 1152 bp, Artificial Sequence
  Description of Artificial Sequence: Synthetic coding sequence
atggaggccctgggcaagctgaagcagtttgatgcctaccccaagaccctggaggacttccgggtgaagacctgtggcggggccaccgtgaccatcgtgtctggcctgctgatgctgctgctcttcctgtctgagctgcagtactacctgaccacagaggtgcaccctgagctgtatgtggacaagagcagaggagacaagctgaagatcaacattgatgtgctcttcccccacatgccctgtgcctacctgagcattgatgccatggatgtggccggggagcagcagctggatgtggagcacaacctcttcaagcagaggctggacaaggatggcatccctgtgtcctctgaggccgagagacatgagctgggcaaggtggaggtgacagtgtttgatcctgacagcctggaccctgacagatgtgagagctgctacggggctgaggccgaggacatcaagtgctgcaacacctgtgaagatgtgcgggaggcctacagaagaagaggctgggccttcaagaacccagacaccatcgagcagtgcagaagagagggcttcagccagaagatgcaggagcagaagaatgaaggctgccaggtgtatggcttcctggaggtgaacaaggtggccggcaacttccactttgcccctgggaagagcttccagcagagccacgtgcacgtgcatgacctgcagagctttggcctggacaacatcaacatgacccactacatccagcacctgagctttggagaggactacccaggcatcgtgaaccccctggaccacaccaacgtgacagccccccaggcctccatgatgttccagtactttgtgaaggtggtgcccaccgtgtacatgaaggtggatggagaggtgctgcggaccaaccagttctctgtgaccaggcatgagaaggtggccaacggcctgctgggggaccagggcctgcccggggtgtttgtgctgtatgagctgagccccatgatggtgaagctgacagagaagcacaggagcttcacccacttcctgactggagtgtgtgccatcatcggcggcatgttcaccgtggccggcctgattgacagcctcatctaccacagcgcccgggccatccagaagaagattgacctgggcaagaccacctag

SEQ ID NO: 34072 - DNA, 597 bp, Artificial Sequence
  Description of Artificial Sequence: Synthetic coding sequence
ctgtctgtggccttcagctgctgctatggagctgaggccgaggacatcaagtgctgcaacacctgtgaagatgtgcgggaggcctacagaagaagaggctgggccttcaagaacccagacaccatcgagcagtgccggcgggagggcttcagccagaagatgcaggagcagaagaatgaaggctgccaggtgtatggcttcctggaggtgaacaaggtggccggcaacttccactttgcccctgggaagagcttccagcagagccacgtgcacgtgcatgacctgcagagctttggcctggacaacatcaacatgacccactacatccagcacctgagctttggagaggactacccaggcatcgtgaaccccctggaccacaccaacgtgacagccccccaggcctccatgatgttccagtactttgtgaaggtggtgcccaccgtgtacatgaaggtggatggagaggtgctgcggaccaaccagttctctgtgaccaggcatgagaaggtggccaacggcctgctgggggaccagggcctgcccggggtgtttgcccacctgcccctgagcaccagccacccagaagaaaattag

SEQ ID NO: 34073 - DNA, 1167 bp, Artificial Sequence
  Description of Artificial Sequence: Synthetic coding sequence
atggaggccctgggcaagctgaagcagtttgatgcctaccccaagaccctggaggacttccgggtgaagacctgtggcggggccaccgtgaccatcgtgtctggcctgctgatgctgctgctcttcctgtctgagctgcagtactacctgaccacagaggtgcaccctgagctgtatgtggacaagagcagaggagacaagctgaagatcaacattgatgtgctcttcccccacatgccctgtgcctacctgagcattgatgccatggatgtggccggggagcagcagctggatgtggagcacaacctcttcaagcagaggctggacaaggatggcatccctgtgtcctctgaggccgagagacatgagctgggcaaggtggaggtgacagtgtttgatcctgacagcctggaccctgacagatgtgagagctgctacggggctgaggccgaggacatcaagtgctgcaacacctgtgaagatgtgcgggaggcctacagaagaagaggctgggccttcaagaacccagacaccatcgagcagtgcagaagagagggcttcagccagaagatgcaggagcagaagaatgaaggctgccaggtgtatggcttcctggaggtgaacaaggtggccggcaacttccactttgcccctgggaagagcttccagcagagccacgtgcacgtgcatgctgtggagatccatgacctgcagagctttggcctggacaacatcaacatgacccactacatccagcacctgagctttggagaggactacccaggcatcgtgaaccccctggaccacaccaacgtgacagccccccaggcctccatgatgttccagtactttgtgaaggtggtgcccaccgtgtacatgaaggtggatggagaggtgctgcggaccaaccagttctctgtgaccaggcatgagaaggtggccaacggcctgctgggggaccagggcctgcccggggtgtttgtgctgtatgagctgagccccatgatggtgaagctgacagagaagcaccgctccttcacccacttcctgactggagtgtgtgccatcattggaggcatgttcaccgtggccggcctgattgacagcctcatctaccacagcgcccgggccatccagaagaagattgacctgggcaagaccacctag

SEQ ID NO: 34074 - DNA, 1197 bp, Artificial Sequence
  Description of Artificial Sequence: Synthetic coding sequence
atggaggccctgggcaagctgaagcagtttgatgcctaccccaagaccctggaggacttccgggtgaagacctgtggcggggccaccgtgaccatcgtgtctggcctgctgatgctgctgctcttcctgtctgagctgcagtactacctgaccacagaggtgcaccctgagctgtatgtggacaagagcagaggagacaagctgaagatcaacattgatgtgctcttcccccacatgccctgtgcctacctgagcattgatgccatggatgtggccggggagcagcagctggatgtggagcacaacctcttcaagcagaggctggacaaggatggcatccctgtgtcctctgaggccgagagacatgagctgggcaaggtggaggtgacagtgtttgatcctgacagcctggaccctgacagatgtgagagctgctacggggctgaggccgaggacatcaagtgctgcaacacctgtgaagatgtgcgggaggcctacagaagaagaggctgggccttcaagaacccagacaccatcgagcagtgcagaagagagggcttcagccagaagatgcaggagcagaagaatgaaggctgccaggtgtatggcttcctggaggtgaacaaggtggccggcaacttccactttgcccctgggaagagcttccagcagagccacgtgcacggctgtgtgtgccgcctgaagatgattgcccggagcctggcctgtgtgcatgacctgcagagctttggcctggacaacatcaacatgacccactacatccagcacctgagctttggagaggactacccaggcatcgtgaaccccctggaccacaccaacgtgacagccccccaggcctccatgatgttccagtactttgtgaaggtggtgcccaccgtgtacatgaaggtggatggagaggtgctgcggaccaaccagttctctgtgaccaggcatgagaaggtggccaacggcctgctgggggaccagggcctgcccggggtgtttgtgctgtatgagctgagccccatgatggtgaagctgacagagaagcaccgctccttcacccacttcctgactggagtgtgtgccatcattggaggcatgttcaccgtggccggcctgattgacagcctcatctaccacagcgcccgggccatccagaagaagattgacctgggcaagaccacctag

SEQ ID NO: 34075 - DNA, 1407 bp, Artificial Sequence
  Description of Artificial Sequence: Synthetic coding sequence
atgggccggggctggggcttcctgtttggcctgctgggcgctgtgtggctgctgagcagcggccacggggaggagcagcccccagagacagctgcccagcgctgcttctgccaggtgtctggctacctggatgactgcacctgtgatgtggagaccatcgaccgcttcaacaactaccgcctcttcccccggctgcagaagctgctggagagtgactacttccgctactacaaggtgaacctgaagaggccctgccccttctggaatgacatcagccagtgtggccggcgggactgtgctgtgaagccctgccagagtgatgaggtgcctgatggcatcaagagcgccagctacaagtacagcgaggaggccaacaacctgattgaggagtgtgagcaggccgagcggctgggcgctgtggatgagagcctgtctgaggagacccagaaggctgtgctgcagtggaccaagcatgatgacagcagtgacaacttctgtgaggctgatgacatccagagccctgaggccgagtatgtggacctgctgctgaaccctgagcgctacacaggctacaagggcccagatgcctggaagatctggaatgtcatctatgaggagaactgcttcaagccccagaccatcaagaggcccctgaaccccctggccagcggccagggcaccagcgaggagaacaccttctacagctggctggagggcctgtgtgtggagaagagggccttctaccgcctcatcagcggcctgcacgccagcatcaacgtgcacctgagcgcccgctacctgctgcaggagacctggctggagaagaagtggggccacaacatcacagagttccagcagagatttgatggcatcctgacagaaggagagggcccccggcggctgaagaacctgtacttcctgtacctgattgagctgcgggccctgagcaaggtgctgcccttctttgagaggccagacttccagctgttcaccggcaacaagatccaggatgaggagaacaagatgctgctgctggagatcctgcacgagatcaagagcttccccctgcactttgatgagaacagcttctttgctggggacaagaaggaggcccacaagctgaaggaggacttccggctgcacttcaggaacatcagccgcatcatggactgtgtgggctgcttcaagtgccgcctgtggggcaagctgcagacccagggcctgggcacagccctgaagatcctcttcagcgagaagctgattgccaacatgcctgagagcggccccagctatgagttccacctgacccggcaggagatcgtgtccctcttcaatgccttcggccgcatcagcacctctgtgaaggagctggagaacttcaggaacctgctgcagaacatccactag

SEQ ID NO: 34076 - DNA, 522 bp, Artificial Sequence
  Description of Artificial Sequence: Synthetic coding sequence
tggggccccaacatcaaggagttcaagcacagatttgatcctgtggagaccaagggggagggcccccggcggctgaagaacctgtacttcctgtacctgattgagctgcgggccctgagcaaggtggccccctactttgagaggagcatcgtggacctgtacacaggaaatgctgaggaggatgctgacaccaagaccctgctgctgaacatcttccaggacaccaagagcttccccatgcactttgatgagaagtccatgtttgctggggacaagaagggggccaagagcctgaaggaggagttccggctgcacttcaagaacatcagccgcatcatggactgtgtgggctgtgacaagtgccgcctgtggggcaagctgcagacccagggcctgggcacagccctgaagatcctcttcagcgagaaggagatccagaagctgcctgagaacagccccagcaagggcttccagctgacccggcaggagatcgtggccctgctgaatgcctttggaagatag

SEQ ID NO: 34077 - DNA, 435 bp, Artificial Sequence
  Description of Artificial Sequence: Synthetic coding sequence
atgagccagggcgtgcggcgggccggggccggccagggcgtggccgctgctgtgcagctgctggtgaccctgtccttcctgcggtctgtggtggaggcccaggtgactggagtgctggatgactgcctgtgtgacatcgacagcattgacaacttcaacacctacaagatcttccccaagatcaagaagctgcaggagcgggactacttccgctactacaaggtgaacctgaagaggccctgccccttctgggccgaggatggccactgcagcatcaaggactgccacgtggagccctgcccagagagcaagatccctgtgggcatcaaggccggccacagcaacaagtacctgaagatggccaacaacaccaaggagctggaggactgtgagcaggccaacaagctgggcgccatcaacagcaccctgaggtag

SEQ ID NO: 34078 - DNA, 1404 bp, Artificial Sequence
  Description of Artificial Sequence: Synthetic coding sequence
atgagccagggcgtgcggcgggccggggccggccagggcgtggccgctgctgtgcagctgctggtgaccctgtccttcctgcggtctgtggtggaggcccaggtgactggagtgctggatgactgcctgtgtgacatcgacagcattgacaacttcaacacctacaagatcttccccaagatcaagaagctgcaggagcgggactacttccgctactacaaggtgaacctgaagaggccctgccccttctgggccgaggatggccactgcagcatcaaggactgccacgtggagccctgcccagagagcaagatccctgtgggcatcaaggccggccacagcaacaagtacctgaagatggccaacaacaccaaggagctggaggactgtgagcaggccaacaagctgggcgccatcaacagcaccctgagcaaccagagcaaggaggccttcatcgactgggcccgctatgatgacagccgggaccacttctgtgagctggatgatgagaggagccctgctgcccagtatgtggacctgctgctgaaccctgagcgctacacaggctacaagggcaccagcgcctggagggtgtggaacagcatctatgaggagaactgcttcaagcccaggtctgtgtaccggcccctgaaccccctggcccccagcagaggagaagatgatggagagagcttctacacctggctggagggcctgtgcctggagaagagggtcttctacaagctgatcagcggcctgcacgccagcatcaacctgcacctgtgtgccaactacctgctggaggagacctggggcaagcccagctggggccccaacatcaaggagttcaagcacagatttgatcctgtggagaccaagggggagggcccccggcggctgaagaacctgtacttcctgtacctgattgagctgcgggccctgagcaaggtggccccctactttgagaggagcatcgtggacctgtacacaggaaatgcagaagaagatgctgacaccaagaccctgctgctgaacatcttccaggacaccaagagcttccccatgcactttgatgagaagtccatgtttgctggggacaagaagggggccaagagcctgaaggaggagttccggctgcacttcaagaacatcagccgcatcatggactgtgtgggctgtgacaagtgccgcctgtggggcaagctgcagacccagggcctgggcacagccctgaagatcctcttcagcgagaaggagatccagaagctgcctgagaacagccccagcaagggcttccagctgacccggcaggagatcgtggccctgctgaatgccttcggccgcctgagcaccagcatccgggacctgcagaacttcaaggtgctgctgcagcacagcaggtag

SEQ ID NO: 34079 - DNA, 216 bp, Artificial Sequence
  Description of Artificial Sequence: Synthetic coding sequence
atggccaacaacaccaaggagctggaggactgtgagcaggccaacaagctgggcgccatcaacagcaccctgagcaaccagagcaaggaggccttcatcgactgggcccgctatgatgacagccgggaccacttctgtgagctggatgatgagaggagccctgctgcccagtatgtggacctgctgctgaaccctgagcgctacacaggctactag

SEQ ID NO: 34080 - DNA, 702 bp, Artificial Sequence
  Description of Artificial Sequence: Synthetic coding sequence
atggagctgcccaccaagccaggcacctttgacctgggcctggccacctggagccccagcttccagggcgagacccaccgggcccaggcccggaggagagatgtgggccggcagctgcctgagtacaaggctgtggtggtgggcgccagcggcgtgggcaagagcgccctgaccatccagctgaaccaccagtgctttgtggaggaccatgaccccaccatccaggacagctactggaaggagctgaccctggacagcggggactgcatcctgaatgtgctggacacagctggccaggccatccaccgggccctgcgggaccagtgcctggccgtgtgtgatggagtgctgggcgtgtttgccctggatgaccccagcagcctcatccagctgcagcagatctgggccacctggggcccccacccagcccagcccctggtgctggtgggcaacaagtgtgacctggtgaccacagctggagatgcccacgccgctgctgctgccctggcccacagctggggcgcccactttgtggagaccagcgccaagacccggcagggcgtggaggaggccttcagcctgctggtgcatgagatccagagggtgcaggaggccatggccaaggagcccatggcccggagctgccgggagaagaccaggcaccagaaggccacctgccactgcggctgcagcgtggcctag

SEQ ID NO: 34081 - DNA, 2178 bp, Artificial Sequence
  Description of Artificial Sequence: Synthetic coding sequence
atggccatggccatgtctgacagcggggccagccggctgcggcggcagctggagagcggcggctttgaggcccggctgtatgtgaagcagctgagccagcagagtgatggagaccgggacctgcaggagcaccggcagaggatccaggccctggccgaggagacagcccagaacctgaagagaaatgtgtaccagaactaccggcagttcattgaaacagcccgggagatctcctacctggagagcgagatgtaccagctgagccacctgctgacagagcagaagagcagcctggagagcatccccctgaccctgctgcctgctgctgctgctgctggagctgctgctgccagcggcggggaggagggcgtgggcggggccggcggccgggaccacctgcggggccaggccggcttcttcagcaccccaggaggagccagcagagatggcagcggccctggagaggagggcaagcagaggaccctgaccaccctgctggagaaggtggagggctgccgccacctgctggagaccccaggccagtacctggtgtacaacggggacctggtggagtatgatgctgaccacatggcccagctgcagagggtgcacggcttcctgatgaatgactgcctgctggtggccacctggctgccccagaggcggggcatgtaccgctacaatgccctgtacagcctggatggcctggccgtggtgaatgtgaaggacaacccccccatgaaggacatgttcaagctgctgatgtttcctgagagccgcatcttccaggctgaaaatgccaagatcaagcgggagtggctggaggtgctggaggacaccaagagggccctgtctgagaagagaagaagagagcaggaggaggccgccgccccccggggccccccccaggtgaccagcaaggccaccaacccctttgaagatgatgaggaggaggagcctgctgtgcctgaggtggaggaggagaaggtggacctgtccatggagtggatccaggagctgcctgaggacctggatgtgtgcatcgcccagagggactttgaaggagctgtggacctgctggacaagctgaaccactacctggaggacaagcccagccccccacctgtgaaggagctgcgggccaaggtggaggagcgggtgcggcagctgacagaggtgctggtgtttgagctgagcccagacaggagcctgcggggcggccccaaggccacccggcgggctgtgtcccagctgatccggctgggccagtgcaccaaggcctgtgagctgttcctgaggaacagagctgctgctgtgcacacagccatccggcagctgcgcatcgagggcgccaccctgctgtacatccacaagctgtgccacgtgttcttcaccagcctgctggagacagcccgggagtttgaaattgactttgctggaacagattctggctgctacagcgcctttgtggtgtgggcccggagcgccatgggcatgtttgtggatgccttcagcaagcaggtgtttgacagcaaggagagcctgagcacagctgctgaatgtgtgaaggtggccaaggagcactgccagcagctgggggacatcggcctggacctgaccttcatcatccacgccctgctggtgaaggacatccagggcgccctgcacagctacaaggagatcatcatcgaggccaccaagcacagaaattctgaggagatgtggaggaggatgaacctgatgaccccagaggccctgggcaagctgaaggaggagatgaagagctgtggggtgagcaactttgagcagtacacaggagatgactgctgggtgaacctgagctacacagtggtggccttcaccaagcagaccatgggcttcctggaggaggccctgaagctgtacttccctgagctgcacatggtgctgctggagagcctggtggagatcatcctggtggccgtgcagcacgtggactacagcctgcgctgtgagcaggaccctgagaagaaggccttcatccggcagaatgccagcttcctgtatgagaccgtgctgcctgtggtggagaagagatttgaggagggcgtgggcaagccagccaagcagctgcaggacctgagaaatgccagccgcctcatccgggtgaaccctgagagcaccacctctgtggtgtag

SEQ ID NO: 34082 - DNA, 2166 bp, Artificial Sequence
  Description of Artificial Sequence: Synthetic coding sequence
atgtctgacagcggggccagccggctgcggcggcagctggagagcggcggctttgaggcccggctgtatgtgaagcagctgagccagcagagtgatggagaccgggacctgcaggagcaccggcagaggatccaggccctggccgaggagacagcccagaacctgaagagaaatgtgtaccagaactaccggcagttcattgaaacagcccgggagatctcctacctggagagcgagatgtaccagctgagccacctgctgacagagcagaagagcagcctggagagcatccccctgaccctgctgcctgctgctgctgctgctggagctgctgctgccagcggcggggaggagggcgtgggcggggccggcggccgggaccacctgcggggccaggccggcttcttcagcaccccaggaggagccagcagagatggcagcggccctggagaggagggcaagcagaggaccctgaccaccctgctggagaaggtggagggctgccgccacctgctggagaccccaggccagtacctggtgtacaacggggacctggtggagtatgatgctgaccacatggcccagctgcagagggtgcacggcttcctgatgaatgactgcctgctggtggccacctggctgccccagaggcggggcatgtaccgctacaatgccctgtacagcctggatggcctggccgtggtgaatgtgaaggacaacccccccatgaaggacatgttcaagctgctgatgtttcctgagagccgcatcttccaggctgaaaatgccaagatcaagcgggagtggctggaggtgctggaggacaccaagagggccctgtctgagaagagaagaagagagcaggaggaggccgccgccccccggggccccccccaggtgaccagcaaggccaccaacccctttgaagatgatgaggaggaggagcctgctgtgcctgaggtggaggaggagaaggtggacctgtccatggagtggatccaggagctgcctgaggacctggatgtgtgcatcgcccagagggactttgaaggagctgtggacctgctggacaagctgaaccactacctggaggacaagcccagccccccacctgtgaaggagctgcgggccaaggtggaggagcgggtgcggcagctgacagaggtgctggtgtttgagctgagcccagacaggagcctgcggggcggccccaaggccacccggcgggctgtgtcccagctgatccggctgggccagtgcaccaaggcctgtgagctgttcctgaggaacagagctgctgctgtgcacacagccatccggcagctgcgcatcgagggcgccaccctgctgtacatccacaagctgtgccacgtgttcttcaccagcctgctggagacagcccgggagtttgaaattgactttgctggaacagattctggctgctacagcgcctttgtggtgtgggcccggagcgccatgggcatgtttgtggatgccttcagcaagcaggtgtttgacagcaaggagagcctgagcacagctgctgaatgtgtgaaggtggccaaggagcactgccagcagctgggggacatcggcctggacctgaccttcatcatccacgccctgctggtgaaggacatccagggcgccctgcacagctacaaggagatcatcatcgaggccaccaagcacagaaattctgaggagatgtggaggaggatgaacctgatgaccccagaggccctgggcaagctgaaggaggagatgaagagctgtggggtgagcaactttgagcagtacacaggagatgactgctgggtgaacctgagctacacagtggtggccttcaccaagcagaccatgggcttcctggaggaggccctgaagctgtacttccctgagctgcacatggtgctgctggagagcctggtggagatcatcctggtggccgtgcagcacgtggactacagcctgcgctgtgagcaggaccctgagaagaaggccttcatccggcagaatgccagcttcctgtatgagaccgtgctgcctgtggtggagaagagatttgaggagggcgtgggcaagccagccaagcagctgcaggacctgagaaatgccagccgcctcatccgggtgaaccctgagagcaccacctctgtggtgtag

SEQ ID NO: 34083 - DNA, 3345 bp, Artificial Sequence
  Description of Artificial Sequence: Synthetic coding sequence
atggagaggagccctggagagggccccagccccagccccatggaccagcccagcgcccccagcgaccccacagaccagcccccagctgcccacgccaagccagaccccggcagcggcggccagcctgctggccctggagctgctggggaggccctggccgtgctgaccagctttggccggcggctgctggtgctgatccctgtgtacctggccggggctgtgggcctgtctgtgggctttgtgctgtttggcctggccctgtacctgggctggaggagagtgagagatgagaaggagaggagcctgcgggccgcccggcagctgctggatgatgaggagcagctgacagccaagaccctgtacatgagccaccgggagctgcctgcctgggtgtccttcccagatgtggagaaggccgagtggctgaacaagatcgtggcccaggtgtggcccttcctgggccagtacatggagaagctgctggccgagaccgtggccccagctgtgcggggcagcaacccccacctgcagaccttcaccttcaccagggtggagctgggggagaagcccctgcgcatcatcggcgtgaaggtgcaccctggccagaggaaggagcagatcctgctggacctgaacatctcctatgtgggagatgtgcagattgatgtggaggtgaagaagtacttctgcaaggccggcgtgaagggcatgcagctgcacggcgtgctgcgggtcatcctggagcccctgattggagacctgccctttgtgggcgctgtgtccatgttcttcatccggcggcccaccctggacatcaactggacaggcatgaccaacctgctggacatccctggcctgagcagcctgagtgacaccatgatcatggacagcattgctgccttcctggtgctgcccaaccggctgctggtgcccctggtgcctgacctgcaggatgtggcccagctgcggagccccctgccccggggcatcatccgcatccacctgctggccgcccggggcctgagcagcaaggacaagtatgtgaagggcctcatcgagggcaagagtgacccctatgccctggtgcggctgggcacccagaccttctgcagccgggtgattgatgaggagctgaacccccagtggggcgagacctatgaggtgatggtgcatgaggtgcccggccaggagattgaggtggaggtgtttgacaaggaccctgacaaggatgacttcctgggccgcatgaagctggatgtgggcaaggtgctgcaggcctctgtgctggatgactggttccccctgcagggcggccagggccaggtgcacctgcggctggagtggctgagcctgctgagtgatgctgagaagctggagcaggtgctgcagtggaactggggcgtgagcagcaggccagacccccccagcgctgccatcctggtggtgtacctggaccgggcccaggacctgcccatggtgaccagcgagctgtacccaccccagctgaagaagggcaacaaggagcccaaccccatggtgcagctgagcatccaggatgtgacccaggagagcaaggctgtgtacagcaccaactgccctgtgtgggaggaggccttccgcttcttcctgcaggacccccagagccaggagctggatgtgcaggtgaaggatgacagccgggccctgaccctgggcgccctgaccctgcccctggcccggctgctgacagcccctgagctgatcctggaccagtggttccagctgagcagcagcggccccaacagccggctgtacatgaagctggtgatgaggatcctgtacctggacagcagcgagatctgcttccccaccgtgcccggctgccctggggcctgggatgtggacagcgagaacccccagaggggcagctctgtggatgccccaccccggccctgccacaccaccccagacagccagtttggaacagaacatgtgctgcgcatccacgtgctggaggcccaggacctgattgccaaggaccgcttcctgggcggcctggtgaagggcaagagtgacccctacgtgaagctgaagctggccggccgctccttccgcagccacgtggtgcgggaggacctgaacccccgctggaatgaggtgtttgaggtgattgtgacctctgtgcccggccaggagctggaggtggaggtgtttgacaaggacctggacaaggatgacttcctgggccgctgcaaggtgcggctgaccaccgtgctgaacagcggcttcctggatgagtggctgaccctggaggatgtgcccagcggccgcctgcacctgcggctggagcggctgaccccccggcccacagctgctgagctggaggaggtgctgcaggtgaacagcctcatccagacccagaagtctgctgagctggccgccgccctgctgagcatctacatggagagagctgaggacctgcccctgaggaagggcaccaagcacctgagcccctatgccaccctgactgtgggggacagcagccacaagaccaagaccatcagccagaccagcgcccctgtgtgggatgagagcgccagcttcctgatcaggaagccccacacagagagcctggagctgcaggtgcggggggagggcaccggggtgctgggcagcctgagcctgcccctgtctgagctgctggtggccgaccagctgtgcctggaccgctggttcaccctgagcagcggccagggccaggtgctgctgcgggcccagctgggcatcctggtgtcccagcacagcggcgtggaggcccacagccacagctacagccacagcagcagcagcctgtctgaggagcctgagctgagcggcggccccccccacatcaccagcagcgcccctgagctgcggcagaggctgacccacgtggacagccccctggaggccccagctggccccctgggccaggtgaagctgaccctgtggtactacagcgaggagaggaagctggtgtccatcgtgcacggctgccgcagcctgcggcagaatggccgggaccccccagacccctacgtgtccctgctgctgctgcctgacaagaacagaggcaccaagaggaggaccagccagaagaagaggaccctgagccctgagttcaatgaaagatttgagtgggagctgcccctggatgaggcccagaggaggaagctggatgtgtctgtgaagagcaacagcagcttcatgagccgggagcgggagctgctgggcaaggtgcagctggacctggccgagacagacctgagccagggcgtggcccgctggtatgacctgatggacaacaaggacaagggcagcagctag

SEQ ID NO: 34084 - DNA, 3315 bp, Artificial Sequence
  Description of Artificial Sequence: Synthetic coding sequence
atggagaggagccctggagagggccccagccccagccccatggaccagcccagcgcccccagcgaccccacagaccagcccccagctgcccacgccaagccagaccccggcagcggcggccagcctgctggccctggagctgctggggaggccctggccgtgctgaccagctttggccggcggctgctggtgctgatccctgtgtacctggccggggctgtgggcctgtctgtgggctttgtgctgtttggcctggccctgtacctgggctggaggagagtgagagatgagaaggagaggagcctgcgggccgcccggcagctgctggatgatgaggagcagctgacagccaagaccctgtacatgagccaccgggagctgcctgcctgggtgtccttcccagatgtggagaaggccgagtggctgaacaagatcgtggcccaggtgtggcccttcctgggccagtacatggagaagctgctggccgagaccgtggccccagctgtgcggggcagcaacccccacctgcagaccttcaccttcaccagggtggagctgggggagaagcccctgcgcatcatcggcgtgaaggtgcaccctggccagaggaaggagcagatcctgctggacctgaacatctcctatgtgggagatgtgcagattgatgtggaggtgaagaagtacttctgcaaggccggcgtgaagggcatgcagctgcacggcgtgctgcgggtcatcctggagcccctgattggagacctgccctttgtgggcgctgtgtccatgttcttcatccggcggcccaccctggacatcaactggacaggcatgaccaacctgctggacatccctggcctgagcagcctgagtgacaccatgatcatggacagcattgctgccttcctggtgctgcccaaccggctgctggtgcccctggtgcctgacctgcaggatgtggcccagctgcggagccccctgccccggggcatcatccgcatccacctgctggccgcccggggcctgagcagcaaggacaagtatgtgaagggcctcatcgagggcaagagtgacccctatgccctggtgcggctgggcacccagaccttctgcagccgggtgattgatgaggagctgaacccccagtggggcgagacctatgaggtgatggtgcatgaggtgcccggccaggagattgaggtggaggtgtttgacaaggaccctgacaaggatgacttcctgggccgcatgaagctggatgtgggcaaggtgctgcaggcctctgtgctggatgactggttccccctgcagggcggccagggccaggtgcacctgcggctggagtggctgagcctgctgagtgatgctgagaagctggagcaggtgctgcagtggaactggggcgtgagcagcaggccagacccccccagcgctgccatcctggtggtgtacctggaccgggcccaggacctgcccctgaagaagggcaacaaggagcccaaccccatggtgcagctgagcatccaggatgtgacccaggagagcaaggctgtgtacagcaccaactgccctgtgtgggaggaggccttccgcttcttcctgcaggacccccagagccaggagctggatgtgcaggtgaaggatgacagccgggccctgaccctgggcgccctgaccctgcccctggcccggctgctgacagcccctgagctgatcctggaccagtggttccagctgagcagcagcggccccaacagccggctgtacatgaagctggtgatgaggatcctgtacctggacagcagcgagatctgcttccccaccgtgcccggctgccctggggcctgggatgtggacagcgagaacccccagaggggcagctctgtggatgccccaccccggccctgccacaccaccccagacagccagtttggaacagaacatgtgctgcgcatccacgtgctggaggcccaggacctgattgccaaggaccgcttcctgggcggcctggtgaagggcaagagtgacccctacgtgaagctgaagctggccggccgctccttccgcagccacgtggtgcgggaggacctgaacccccgctggaatgaggtgtttgaggtgattgtgacctctgtgcccggccaggagctggaggtggaggtgtttgacaaggacctggacaaggatgacttcctgggccgctgcaaggtgcggctgaccaccgtgctgaacagcggcttcctggatgagtggctgaccctggaggatgtgcccagcggccgcctgcacctgcggctggagcggctgaccccccggcccacagctgctgagctggaggaggtgctgcaggtgaacagcctcatccagacccagaagtctgctgagctggccgccgccctgctgagcatctacatggagagagctgaggacctgcccctgaggaagggcaccaagcacctgagcccctatgccaccctgactgtgggggacagcagccacaagaccaagaccatcagccagaccagcgcccctgtgtgggatgagagcgccagcttcctgatcaggaagccccacacagagagcctggagctgcaggtgcggggggagggcaccggggtgctgggcagcctgagcctgcccctgtctgagctgctggtggccgaccagctgtgcctggaccgctggttcaccctgagcagcggccagggccaggtgctgctgcgggcccagctgggcatcctggtgtcccagcacagcggcgtggaggcccacagccacagctacagccacagcagcagcagcctgtctgaggagcctgagctgagcggcggccccccccacatcaccagcagcgcccctgagctgcggcagaggctgacccacgtggacagccccctggaggccccagctggccccctgggccaggtgaagctgaccctgtggtactacagcgaggagaggaagctggtgtccatcgtgcacggctgccgcagcctgcggcagaatggccgggaccccccagacccctacgtgtccctgctgctgctgcctgacaagaacagaggcaccaagaggaggaccagccagaagaagaggaccctgagccctgagttcaatgaaagatttgagtgggagctgcccctggatgaggcccagaggaggaagctggatgtgtctgtgaagagcaacagcagcttcatgagccgggagcgggagctgctgggcaaggtgcagctggacctggccgagacagacctgagccagggcgtggcccgctggtatgacctgatggacaacaaggacaagggcagcagctag

SEQ ID NO: 34085 - DNA, 3177 bp, Artificial Sequence
  Description of Artificial Sequence: Synthetic coding sequence
atggagaggagccctggagagggccccagccccagccccatggaccagcccagcgcccccagcgaccccacagaccagcccccagctgcccacgccaagccagaccccggcagcggcggccagcctgctggccctggagctgctggggaggccctggccgtgctgaccagctttggccggcggctgctggtgctgatccctgtgtacctggccggggctgtgggcctgtctgtgggctttgtgctgtttggcctggccctgtacctgggctggaggagagtgagagatgagaaggagaggagcctgcgggccgcccggcagctgctggatgatgagaagctgctggccgagaccgtggccccagctgtgcggggcagcaacccccacctgcagaccttcaccttcaccagggtggagctgggggagaagcccctgcgcatcatcggcgtgaaggtgcaccctggccagaggaaggagcagatcctgctggacctgaacatctcctatgtgggagatgtgcagattgatgtggaggtgaagaagtacttctgcaaggccggcgtgaagggcatgcagctgcacggcgtgctgcgggtcatcctggagcccctgattggagacctgccctttgtgggcgctgtgtccatgttcttcatccggcggcccaccctggacatcaactggacaggcatgaccaacctgctggacatccctggcctgagcagcctgagtgacaccatgatcatggacagcattgctgccttcctggtgctgcccaaccggctgctggtgcccctggtgcctgacctgcaggatgtggcccagctgcggagccccctgccccggggcatcatccgcatccacctgctggccgcccggggcctgagcagcaaggacaagtatgtgaagggcctcatcgagggcaagagtgacccctatgccctggtgcggctgggcacccagaccttctgcagccgggtgattgatgaggagctgaacccccagtggggcgagacctatgaggtgatggtgcatgaggtgcccggccaggagattgaggtggaggtgtttgacaaggaccctgacaaggatgacttcctgggccgcatgaagctggatgtgggcaaggtgctgcaggcctctgtgctggatgactggttccccctgcagggcggccagggccaggtgcacctgcggctggagtggctgagcctgctgagtgatgctgagaagctggagcaggtgctgcagtggaactggggcgtgagcagcaggccagacccccccagcgctgccatcctggtggtgtacctggaccgggcccaggacctgcccctgaagaagggcaacaaggagcccaaccccatggtgcagctgagcatccaggatgtgacccaggagagcaaggctgtgtacagcaccaactgccctgtgtgggaggaggccttccgcttcttcctgcaggacccccagagccaggagctggatgtgcaggtgaaggatgacagccgggccctgaccctgggcgccctgaccctgcccctggcccggctgctgacagcccctgagctgatcctggaccagtggttccagctgagcagcagcggccccaacagccggctgtacatgaagctggtgatgaggatcctgtacctggacagcagcgagatctgcttccccaccgtgcccggctgccctggggcctgggatgtggacagcgagaacccccagaggggcagctctgtggatgccccaccccggccctgccacaccaccccagacagccagtttggaacagaacatgtgctgcgcatccacgtgctggaggcccaggacctgattgccaaggaccgcttcctgggcggcctggtgaagggcaagagtgacccctacgtgaagctgaagctggccggccgctccttccgcagccacgtggtgcgggaggacctgaacccccgctggaatgaggtgtttgaggtgattgtgacctctgtgcccggccaggagctggaggtggaggtgtttgacaaggacctggacaaggatgacttcctgggccgctgcaaggtgcggctgaccaccgtgctgaacagcggcttcctggatgagtggctgaccctggaggatgtgcccagcggccgcctgcacctgcggctggagcggctgaccccccggcccacagctgctgagctggaggaggtgctgcaggtgaacagcctcatccagacccagaagtctgctgagctggccgccgccctgctgagcatctacatggagagagctgaggacctgcccctgaggaagggcaccaagcacctgagcccctatgccaccctgactgtgggggacagcagccacaagaccaagaccatcagccagaccagcgcccctgtgtgggatgagagcgccagcttcctgatcaggaagccccacacagagagcctggagctgcaggtgcggggggagggcaccggggtgctgggcagcctgagcctgcccctgtctgagctgctggtggccgaccagctgtgcctggaccgctggttcaccctgagcagcggccagggccaggtgctgctgcgggcccagctgggcatcctggtgtcccagcacagcggcgtggaggcccacagccacagctacagccacagcagcagcagcctgtctgaggagcctgagctgagcggcggccccccccacatcaccagcagcgcccctgagctgcggcagaggctgacccacgtggacagccccctggaggccccagctggccccctgggccaggtgaagctgaccctgtggtactacagcgaggagaggaagctggtgtccatcgtgcacggctgccgcagcctgcggcagaatggccgggaccccccagacccctacgtgtccctgctgctgctgcctgacaagaacagaggcaccaagaggaggaccagccagaagaagaggaccctgagccctgagttcaatgaaagatttgagtgggagctgcccctggatgaggcccagaggaggaagctggatgtgtctgtgaagagcaacagcagcttcatgagccgggagcgggagctgctgggcaaggtgcagctggacctggccgagacagacctgagccagggcgtggcccgctggtatgacctgatggacaacaaggacaagggcagcagctag

SEQ ID NO: 34086 - DNA, 3345 bp, Artificial Sequence; identical to SEQ ID NO: 34083
  Description of Artificial Sequence: Synthetic coding sequence

SEQ ID NO: 34087 - DNA, 2661 bp, Artificial Sequence
  Description of Artificial Sequence: Synthetic coding sequence
atgagagctgaggagccctgtgcccctggggcccccagcgccctgggcgcccagaggaccccaggccctgagctgcggctgagcagccagctgctgcctgagctgtgcacctttgtggtgcgggtgctcttctacctgggccctgtgtacctggccggctacctgggcctgagcatcacctggctgctgctgggcgccctgctgtggatgtggtggaggaggaacagaagaggcaagctgggccgcctggccgccgcctttgagttcctggacaatgaaagagagttcatcagccgggagctgcggggccagcacctgcctgcctggatccacttcccagatgtggagcgggtggagtgggccaacaagatcatcagccagacctggccctacctgtccatgatcatggagagcaagttccgggagaagctggagcccaagatccgggagaagagcatccacctgcggaccttcaccttcaccaagctgtacttcggccagaagtgcccccgggtgaatggagtgaaggcccacaccaacacctgcaacagaagaagagtgacagtggacctgcagatctgctacatcggggactgtgagatctctgtggagctgcagaagatccaggccggcgtgaatggcatccagctgcagggcaccctgcgggtcatcctggagcccctgctggtggacaagccctttgtgggcgctgtgacagtgttcttcctgcagaagccccacctgcagatcaactggacaggcctgaccaacctgctggatgcccctggcatcaatgatgtgtctgacagcctgctggaggacctgattgccacccacctggtgctgcccaacagagtgacagtgcctgtgaagaagggcctggacctgaccaacctgcgcttccccctgccctgtggggtcatccgggtgcacctgctggaggccgagcagctggcccagaaggacaacttcctgggcctgcggggcaagagtgacccctatgccaaggtgtccatcggcctgcagcacttccgcagcaggaccatctacagaaacctgaaccccacctggaatgaggtgtttgagttcatggtgtatgaggtgcccggccaggacctggaggtggacctgtatgatgaggacacagacagagatgacttcctgggcagcctgcagatctgcctgggagatgtgatgaccaacagagtggtggatgagtggtttgtgctgaatgacaccaccagcggccgcctgcacctgcggctggagtggctgagcctgctgacagaccaggaggtgctgacagaggaccacggcggcctgagcacagccatcctggtggtgttcctggagagcgcctgcaacctgcccaggaacccctttgactacctgaatggagagtaccgggccaagaagctgagcagatttgccaggaacaaggtgtccaaggaccccagcagctatgtgaagctgtctgtgggcaagaagacccacaccagcaagacctgcccccacaacaaggaccctgtgtggagccaggtgttctccttctttgtgcacaacgtggccacagagcggctgcacctgaaggtgctggatgatgaccaggagtgtgccctgggcatgctggaggtgcccctgtgccagatcctgccctatgctgacctgaccctggagcagcgcttccagctggaccacagcggcctggacagcctcatctccatgaggctggtgctgcgcttcctgcaggtggaggagcgggagctgggcagcccctacacaggccctgaggccctgaagaagggccccctgctgatcaagaaggtggccaccaaccagggccccaaggcccagccccaggaggagggccccacagacctgccctgccccccagaccctgccagtgacaccaaggatgtgagccgcagcaccaccaccaccaccagcgccaccaccgtggccacagagcccaccagccaggagaccggccctgagcccaagggcaaggacagcgccaagcgcttctgtgagcccatcggggagaagaagagccctgccaccatcttcctgactgtgcccggcccccacagccctggccccatcaagagcccccggcccatgaagtgcccagccagcccctttgcctggccacccaagaggctggcccccagcatgagcagcctgaacagcctggccagcagctgctttgacctggccgacatcagcctgaacattgaaggaggagacctgcggcggcggcagctgggggagatccagctgactgtgcgctacgtgtgcctgcggcgctgcctgtctgtgctgatcaatggctgcaggaacctgaccccctgcaccagcagtggagctgacccctacgtgcgggtgtacctgctgcctgagaggaagtgggcctgcaggaagaagacctctgtgaagaggaagaccctggagcccctgtttgatgagacctttgagttctttgtgcccatggaggaggtgaagaagaggagcctggatgtggccgtgaagaacagccggcccctgggcagccacaggaggaaggagctgggcaaggtgctgattgacctgagcaaggaggacctgatcaagggcttcagccagtggtatgagctgaccccaaatggccagcccaggagctag

SEQ ID NO: 34088 - DNA, 2463 bp, Artificial Sequence
  Description of Artificial Sequence: Synthetic coding sequence
atgctgcggctgggcctgtgtgccgccgccctgctgtgtgtgtgcaggcctggagctgtgcgggctgactgctggctgattgaaggagacaagggctacgtgtggctggccatctgcagccagaaccagcccccctatgagaccatcccccagcacatcaacagcacagtgcatgacctgcggctgaatgaaaacaagctgaaggctgtgctgtacagcagcctgaaccgcttcggcaacctgacagacctgaacctgaccaagaatgagatctcctacattgaagatggagccttcctgggccagagcagcctgcaggtgctgcagctgggctacaacaagctgagcaacctgacagagggcatgctgcggggcatgagccggctgcagttcctgtttgtgcagcacaacctgattgaggtggtgacccccacagccttctctgaatgtcccagcctcatcagcattgacctgagcagcaaccggctgagccggctggatggagccacctttgccagcctggccagcctgatggtgtgtgagctggccggcaaccccttcaactgtgaatgtgacctgtttggcttcctggcctggctggtggtgttcaacaacgtgaccaagaactatgaccggctgcagtgtgagagcccccgggagtttgctggctaccccctgctggtgccccggccctaccacagcctgaatgccatcaccgtgctgcaggccaagtgcagaaatggcagcctgcctgcccggcctgtgagccaccccaccccctacagcacagatgcccagcgggagccagatgaaaattctggcttcaacccagatgagatcctgtctgtggagcccccagccagcagcaccacagatgccagcgctggccctgccatcaagctgcaccacgtgaccttcaccagcgccaccctggtggtgatcatcccccacccctacagcaagatgtacatcctggtgcagtacaacaacagctacttcagtgatgtgatgaccctgaagaacaagaaggagatcgtgaccctggacaagctgcgggcccacacagagtacaccttctgtgtgaccagcctgaggaacagccgccgcttcaaccacacctgcctgaccttcaccacccgggaccctgtgcctggggacctggcccccagcaccagcaccaccacccactacatcatgaccatcctgggctgcctgtttggcatggtgattgtgctgggcgctgtgtactactgcctgaggaagaggaggatgcaggaggagaagcagaagtctgtgaatgtgaagaagaccatcctggagatgagatatggagcagatgtggatgctggcagcatcgtgcatgctgcccagaagctgggggagccccctgtgctgcctgtgtccaggatggccagcatccccagcatgattggagagaagctgcccacagccaagggcctggaggccggcctggacacccccaaggtggccaccaagggcaactacatcgaggtgaggactggagctggaggagatggcctggcccggccagaagatgacctgcctgacctggagaatggccagggcagcgctgctgagatcagcaccatcgccaaggaggtggacaaggtgaaccagatcatcaacaactgcattgatgccctgaagctggacagcgccagcttcctgggcggcggcagcagcagcggggaccctgagctggcctttgagtgccagagcctgcctgctgctgctgctgccagcagcgccactggacctggggccctggagcggcccagcttcctgagccccccctacaaggagagcagccaccaccccctgcagaggcagctgtctgcagatgctgctgtgaccaggaagacctgcagcgtgagcagcagcggcagcatcaagagcgccaaggtgttcagcctggatgtgcctgaccaccctgctgccaccggcctggccaagggggacagcaagtacatcgagaagggcagccccctgaacagccccctggaccggctgcccctggtgcctgctggcagcggcggcggcagcggcggcggcggcggcatccaccacctggaggtgaagccagcctaccactgcagcgagcaccgccacagcttccctgccctgtactatgaggagggcgctgacagcctgagccagagggtgtccttcctgaagcccctgaccaggagcaagagggacagcacctacagccagctgagccccaggcactactacagcggctacagcagcagccctgagtacagcagcgagagcacccacaagatctgggagcgcttccggccctacaagaagcaccaccgggaggaggtgtacatggccgccggccacgccctgaggaagaaggtgcagtttgccaaggatgaggacctgcatgacatcctggactactggaagggcgtgtctgcccagcagaagctgtag

SEQ ID NO: 34089 - DNA, 2463 bp, Artificial Sequence; identical to SEQ ID NO: 34088
  Description of Artificial Sequence: Synthetic coding sequence

SEQ ID NO: 34090 - DNA, 558 bp, Artificial Sequence
  Description of Artificial Sequence: Synthetic coding sequence
atggtgggcctgcgctggtggaaccacattgatgaagatggcaagagccactgggtgtttgagagcaggaaggagagcagccaggagaacaagacagtgtctgaggccgagagccgcatcttctggctgggcctcatcgcctgcagcgtgctgtgggtgatctttgccttcagcgccctcttctccttcaccgtgaagtggctggccgtggtgatcatgggcgtggtgctgcagggcgccaacctgtatggctacatccgctgcaaggtgcgcagcaggaagcacctgacctccatggccaccagctactttgggaagcagttcctgcggcagaggaggagccgccacatcgcccagacaggcctgaaggtgctgggcagccgggaccccccagccagcgccttccagagcgctggcatcactggagtgagccgctgccccggccaccccagcaggaagttccaccaggacagccagaagaccctggacttccctggcagctacctgaagaacatgaccccaggccggcccatgagccccatccccctgcggcagtag

SEQ ID NO: 34091 - DNA, 864 bp, Artificial Sequence
  Description of Artificial Sequence: Synthetic coding sequence
atgccacccctgtgggccctgctggccctgggctgcctgcgctttggatctgctgtgaacctgcagccccagctggcctctgtgacctttgccaccaacaaccccaccctgaccaccgtggccctggagaagcccctgtgcatgtttgacagcaaggaggccctgaccggcacccatgaggtgtacctgtatgtgctggtggacagcgccatcagcagaaatgcctctgtgcaggacagcaccaacacccccctgggcagcaccttcctgcagacagagggcggccgcacaggcccctacaaggctgtggcctttgacctgatcccctgcagcgacctgcccagcctggatgccatcggagatgtgtccaaggccagccagatcctgaatgcctacctggtgcgggtgggcgccaacggcacctgcctgtgggaccccaacttccagggcctgtgcaatgcccccctgtctgctgccacagagtaccgcttcaagtatgtgctggtgaacatgagcacaggcctggtggaggaccagaccctgtggagcgaccccatccgcaccaaccagctgaccccctacagcaccatcgacacctggccaggaagaagaagtggcggcatgatcgtcatcaccagcatcctgggcagcctgcccttcttcctgctggtgggctttgctggggccatcgccctgagcctggtggacatgggcagcagtgatggagagaccacccatgacagccagatcacccaggaggccgtgcccaagagcctgggcgccagcgagagcagctacacctctgtgaacagaggcccccccctggacagagctgaggtgtacagcagcaagctgcaggactag

SEQ ID NO: 34092 - DNA, 528 bp, Artificial Sequence
  Description of Artificial Sequence: Synthetic coding sequence
atgaagtatggagtgctgcacatccacggcctgtacacagacccctgtggggtggtgctggaccccagcggctacaaggatgtgacccaggatgctgaggtgatggaggtgctgcagaacctgtaccgcaccaagagcttcctgtttgtgggctgtggggagaccctgcgggaccagatcttccaggccctcttcctgtacagcgtgcccaacaaggtggacctggagcactacatgctggtgctgaaggaaaatgaagaccacttcttcaagcaccaggccgacatgctgctgcacggcatcaaggtggtgtcctatggagactgctttgaccacttccctggctacgtgcaggacctggccacccagatctgcaagcagcagagcccagatgctgacagagtggacagcaccaccctgctgggcaatgcctgccaggactgtgccaagaggaagctggaggagaatggcatcgaggtgtccaagaagaggacccagagcgacacagatgatgctgggggcagctag

SEQ ID NO: 34093 - DNA, 420 bp, Artificial Sequence
  Description of Artificial Sequence: Synthetic coding sequence
atggattctgtggagaagaccaccaacagaagtgagcagaagagcaggaagttcctgaagagcctcatcaggaagcagccccaggagctgctgctggtgattggcaccggggtgtctgctgctgtggcccctggcatcccagccctgtgctcctggaggagctgcatcgaggccgtcatcgaggccgctgagcagctggaggtgctgcaccctggagatgtggccgagttccggaggaaggtgaccaaggaccgggacctgctggtggtggcccatgacctgatcaggaagatgagccccaggactggagatgccaagcccagcttcttccaggactgcctgatggaggtgtttgatgacctggagcagcacatccgcagccctgtggtgctgcagagcatcctgagcctgatggactag

SEQ ID NO: 34094 - DNA, 1074 bp, Artificial Sequence
  Description of Artificial Sequence: Synthetic coding sequence
atggattctgtggagaagaccaccaacagaagtgagcagaagagcaggaagttcctgaagagcctcatcaggaagcagccccaggagctgctgctggtgattggcaccggggtgtctgctgctgtggcccctggcatcccagccctgtgctcctggaggagctgcatcgaggccgtcatcgaggccgctgagcagctggaggtgctgcaccctggagatgtggccgagttccggaggaaggtgaccaaggaccgggacctgctggtggtggcccatgacctgatcaggaagatgagccccaggactggagatgccaagcccagcttcttccaggactgcctgatggaggtgtttgatgacctggagcagcacatccgcagccctgtggtgctgcagagcatcctgagcctgatggacagaggagccatggtgctgaccaccaactatgacaacctgctggaggccttcggccggcggcagaacaagcccatggagagcctggacctgaaggacaagaccaaggtgctggagtgggcccggggccacatgaagtatggagtgctgcacatccacggcctgtacacagacccctgtggggtggtgctggaccccagcggctacaaggatgtgacccaggatgctgaggtgatggaggtgctgcagaacctgtaccgcaccaagagcttcctgtttgtgggctgtggggagaccctgcgggaccagatcttccaggccctcttcctgtacagcgtgcccaacaaggtggacctggagcactacatgctggtgctgaaggaaaatgaagaccacttcttcaagcaccaggccgacatgctgctgcacggcatcaaggtggtgtcctatggagactgctttgaccacttccctggctacgtgcaggacctggccacccagatctgcaagcagcagagcccagatgctgacagagtggacagcaccaccctgctgggcaatgcctgccaggactgtgccaagaggaagctggaggagaatggcatcgaggtgtccaagaagaggacccagagcgacacagatgatgctgggggcagctag

SEQ ID NO: 34095 - DNA, 822 bp, Artificial Sequence
  Description of Artificial Sequence: Synthetic coding sequence
atggaccctgtgcctggaacagattctgcccccctggccggcctggcctggagcagcgccagcgcccccccaccccggggcttcagcgccatcagctgcaccgtggagggcgccccagccagctttgggaagagctttgcccagaagagcggctacttcctgtgcctgagcagcctgggcagcctggagaacccccaggagaatgtggtggccgacatccagatcgtggtggacaagagccccctgcccctgggcttcagccctgtgtgtgaccccatggacagcaaggcctctgtgtccaagaagaagaggatgtgtgtgaagctgctgcccctgggcgccacagacacagctgtgtttgatgtgcggctgagcggcaagaccaagacagtgcccggctacctgagaattggagacatgggcggctttgccatctggtgcaagaaggccaaggcccccaggcctgtgcccaagccccggggcctgagccgggacatgcagggcctgagcctggatgctgccagccagcccagcaaaggaggcctgctggagaggacagccagccggctgggcagccgggccagcaccctgcggagaaatgacagcatctatgaggccagcagcctgtatggcatcagcgccatggatggagtgcccttcaccctgcaccccaggtttgagggcaagagctgcagccccctggccttcagcgcctttggagacctgaccatcaagagcctggccgacatcgaggaggagtacaactacggctttgtggtggagaagacagctgctgcccggctgcccccatctgtgtcctag

SEQ ID NO: 34096 - DNA, 702 bp, Artificial Sequence
  Description of Artificial Sequence: Synthetic coding sequence
atggaccctgtgcctggaacagattctgcccccctggccggcctggcctggagcagcgccagcgcccccccaccccggggcttcagcgccatcagctgcaccgtggagggcgccccagccagctttgggaagagctttgcccagaagagcggctacttcctgtgcctgagcagcctgggcagcctggagaacccccaggagaatgtggtggccgacatccagatcgtggtggacaagagccccctgcccctgggcttcagccctgtgtgtgaccccatggacagcaaggcctctgtgtccaagaagaagaggatgtgtgtgaagctgctgcccctgggcgccacagacacagctgtgtttgatgtgcggctgagcggcaagaccaagacagtgcccggctacctgagaattggaaaaggaggcctgctggagaggacagccagccggctgggcagccgggccagcaccctgcggagaaatgacagcatctatgaggccagcagcctgtatggcatcagcgccatggatggagtgcccttcaccctgcaccccaggtttgagggcaagagctgcagccccctggccttcagcgcctttggagacctgaccatcaagagcctggccgacatcgaggaggagtacaactacggctttgtggtggagaagacagctgctgcccggctgcccccatctgtgtcctag

SEQ ID NO: 34097 - DNA, 822 bp, Artificial Sequence; identical to SEQ ID NO: 34095
  Description of Artificial Sequence: Synthetic coding sequence

SEQ ID NO: 34098 - DNA, 960 bp, Artificial Sequence
  Description of Artificial Sequence: Synthetic coding sequence
atgaggagctgcttctgtgtgcggcgcagccgggaccccccaccaccccagcccccacctcctccaccccagaggggcacagaccagagcaccatgcctgaggtgaaggacctgtctgaggccctgcctgagacctccatggaccccatcactggagtgggcgtggtggccagcaggaacagagcccccaccggctatgatgtggtggcccagacagcagatggagtggatgctgacctgtggaaggatggcctcttcaagagcaaggtgacccgctacctgtgcttcaccaggagcttcagcaaagaaaacagccacctgggcaatgtgctggtggacatgaagctgattgacatcaaggacaccctgcctgtgggcttcatccccatccaggagaccgtggacacccaggaggtggccttcaggaagaagaggctgtgcatcaagttcatcccccgggacagcacagaggccgccatctgtgacatccgcatcatgggccgcaccaagcaggccccaccccagtacaccttcatcggggagctgaacagcatgggcatctggtacaggatgggccgggtgcccaggaaccacgacagcagccagcccaccacccccagccagagcagcgctgccagcaccccagcccccaacctgcccaggcacatcagcctgaccctgcctgccaccttccggggcaggaacagcaccaggacagattatgagtaccagcacagcaacctgtatgccatcagcgccatggatggagtgcccttcatgatcagcgagaagttcagctgtgtgcctgagagcatgcagccctttgacctgctgggcatcaccatcaagagcctggccgagattgagaaggagtatgagtacagcttcagaacagagcagagcgctgctgcccggctgccccccagccccacccgctgccagcagatcccccagagctag

SEQ ID NO: 34099 - DNA, 618 bp, Artificial Sequence
  Description of Artificial Sequence: Synthetic coding sequence
atggacaccggcctgagcagccagcccagcgaggaggaccagagcaccatgcctgaggtgaaggacctgtctgaggccctgcctgagacctccatggaccccatcaccggggtgggcgtggtggccagcaggaacagagcccccaccggctatgatgtggtggcccagacagcagatggagtggatgctgacctgtggaaggatggcctcttcaagagcaaggtgacccgctacctgtgcttcaccaggagcttcagcaaggagaacagccacctgggcaatgtgctggtggacatgaagctgattgacatcaaggacaccctgcctgtgggcttcatccccatccaggagaccgtggacacccaggaggtggccttcaggaagaagaggctgtgcatcaagttcatcccccgggacagcacagaagctgccatctgtgacatccgcatcatgggccgcaccaagcaggccccaccccagtacaccttcatcggggagctgaacagcatgggcatctggtacaggatgggccgggtgcccagaaatcatgacagcagccagcccaccacccccagccagagcagcgctgccagcaccccagcccccaacctgccctag

SEQ ID NO: 34100 - DNA, 915 bp, Artificial Sequence
  Description of Artificial Sequence: Synthetic coding sequence
atggacaccggcctgagcagccagcccagcgaggaggaccagagcaccatgcctgaggtgaaggacctgtctgaggccctgcctgagacctccatggaccccatcaccggggtgggcgtggtggccagcaggaacagagcccccaccggctatgatgtggtggcccagacagcagatggagtggatgctgacctgtggaaggatggcctcttcaagagcaaggtgacccgctacctgtgcttcaccaggagcttcagcaaggagaacagccacctgggcaatgtgctggtggacatgaagctgattgacatcaaggacaccctgcctgtgggcttcatccccatccaggagaccgtggacacccaggaggtggccttcaggaagaagaggctgtgcatcaagttcatcccccgggacagcacagaagctgccatctgtgacatccgcatcatgggccgcaccaagcaggccccaccccagtacaccttcatcggggagctgaacagcatgggcatctggtacaggatgggccgggtgcccagaaatcatgacagcagccagcccaccacccccagccagagcagcgctgccagcaccccagcccccaacctgcccaggcacatcagcctgaccctgcctgccaccttccggggcaggaacagcaccaggacagattatgagtaccagcacagcaacctgtatgccatcagcgccatggatggagtgcccttcatgatcagcgagaagttcagctgtgtgcctgagagcatgcagccctttgacctgctgggcatcaccatcaagagcctggccgagattgagaaggagtatgagtacagcttcagaacagagcagagcgctgctgcccggctgccccccagccccacccgctgccagcagatcccccagagctag

SEQ ID NO: 34101 - DNA, 645 bp, Artificial Sequence
  Description of Artificial Sequence: Synthetic coding sequence
atggaggccccagcccacggcctggagccctgtggctggggcgcctgctggctggtgtgctacacagtgggcagaagagctggctcctggctgcgctcctgggccggccccccctggaggtttcctgagaccaagcccagcgtgtcctctgtgcagggccggcggctggaggcccggcggcgggtggcccagacagcagatggagtggatgctgacctgtggaaggatggcctcttcaagagcaaggtgacccgctacctgtgcttcaccaggagcttcagcaaggagaacagccacctgggcaatgtgctggtggacatgaagctgattgacatcaaggacaccctgcctgtgggcttcatccccatccaggagaccgtggacacccaggaggtggccttcaggaagaagaggctgtgcatcaagttcatcccccgggacagcacagaagctgccatctgtgacatccgcatcatgggccgcaccaagcaggccccaccccagtacaccttcatcggggagctgaacagcatgggcatctggtacaggatgggccgggtgcccagaaatcatgacagcagccagcccaccacccccagccagagcagcgctgccagcaccccagcccccaacctgcccaggtag

SEQ ID NO: 34102 - DNA, 666 bp, Artificial Sequence
  Description of Artificial Sequence: Synthetic coding sequence
atgaggagctgcttctgtgtgcggcgcagccgggaccccccaccaccccagcccccacctcctccaccccagaggggcacagaccagagcaccatgcctgaggtgaaggacctgtctgaggccctgcctgagacctccatggaccccatcactggagtgggcgtggtggccagcaggaacagagcccccaccggctatgatgtggtggcccagacagcagatggagtggatgctgacctgtggaaggatggcctcttcaagagcaaggtgacccgctacctgtgcttcaccaggagcttcagcaaagaaaacagccacctgggcaatgtgctggtggacatgaagctgattgacatcaaggacaccctgcctgtgggcttcatccccatccaggagaccgtggacacccaggaggtggccttcaggaagaagaggctgtgcatcaagttcatcccccgggacagcacagaggccgccatctgtgacatccgcatcatgggccgcaccaagcaggccccaccccagtacaccttcatcggggagctgaacagcatgggcatctggtacaggatgggccgggtgcccaggaaccacgacagcagccagcccaccacccccagccagagcagcgctgccagcaccccagcccccaacctgcccaggtag

SEQ ID NO: 34103 - DNA, 2787 bp, Artificial Sequence
  Description of Artificial Sequence: Synthetic coding sequence
atgggcggcagcgccagcagccagctggatgagggcaaatgtgcctacatccggggcaagacagaagctgccatcaagaacttcagcccctactacagccggcagtacagcgtggccttctgcaaccacgtgaggacagaggtggagcagcagagggacctgaccagccagttcctgaagaccaagccacccctggcccctggcaccatcctgtatgaggccgagctgagccagttcagcgaggacatcaagaagtggaaggagcgctacgtggtggtgaagaatgactatgctgtggagagctatgagaacaaggaggcctaccagagaggagctgcccccaagtgccgcatcctgcctgctgggggcaaggtgctgaccagtgaagatgagtacaacctgctgagtgacagacacttcccagaccccctggccagcagcgagaaggagaacacccagccctttgtggtgctgcccaaggagttccctgtgtacctgtggcagcccttcttcagacatggctacttctgcttccatgaagctgctgaccagaagcgcttcagcgccctgctgagtgactgtgtgcgccacctgaaccacgactacatgaagcagatgacctttgaggcccaggccttcctggaggccgtgcagttcttccggcaggagaagggccactacggctcctgggagatgatcactggagatgagatccagatcctgagcaacctggtgatggaggagctgctgcccaccctgcagacagacctgctgcccaagatgaagggcaagaagaatgacaggaagaggacctggctgggcctgctggaggaggcctacaccctggtgcagcaccaggtgtctgagggcctgagcgccctgaaggaggagtgccgggccctgaccaagggcctggagggcaccatccgcagtgacatggaccagatcgtgaacagcaagaactacctgattggcaagatcaaggccatggtggcccagcctgctgagaagagctgcctggagagcgtgcagcccttcctggccagcatcctggaggagctgatgggccctgtgagcagcggcttcagcgaggtgcgggtgctgtttgagaaggaggtgaatgaggtgtcccagaacttccagaccaccaaggacagcgtgcagctgaaggagcacctggaccggctgatgaacctgcccctgcacagcgtgaagatggagccctgctacaccaaggtgaacctgctgcacgagcggctgcaggacctgaagagccgcttccgcttcccccacatcgacctggtggtgcagaggacccagaactacatgcaggagctgatggagaatgctgtgttcacctttgagcagctgctgagcccccacctgcagggcgaggccagcaagacagctgtggccatcgagaaggtgaagctgcgggtgctgaagcagtatgactatgacagcagcaccatcaggaagaagatcttccaggaggccctggtgcagatcaccctgcccaccgtgcagaaggccctggccagcacctgcaagccagagctgcagaagtatgagcagttcatctttgctgaccacaccaacatgatccacgtggagaatgtgtatgaggagatcctgcaccagatcctgctggatgagaccctgaaggtgatcaaggaggccgccatcctgaagaagcacaacctgtttgaggacaacatggccctgcccagcgagagcgtgagcagcctgacagacctgaagccacccaccggcagcaaccaggccagccctgcccggcgggccagcgccatcctgcccggggtgctgggcagcgagaccctgagcaatgaggtgttccaggagagcgaggaggagaagcagcctgaggtgcccagcagcctggccaagggggagagcctgagcctgcccggccccagccccccaccagatggaacagagcaggtgatcatcagccgggtggatgatcctgtggtgaaccctgtggccacagaggacacagctggcctgcccggcacctgcagcagcgagctggagtttggaggcaccctggaggatgaggagcccgcccaggaggagcctgagcccatcacagccagcggcagcctgaaggccctgaggaagctgctgacagcctctgtggaggtgcctgtggacagcgcccctgtgatggaggaggacaccaatggagagagccacgtgccccaggagaatgaggaggaggaggagaaggagcccagccaggccgccgccatccacccagacaactgtgaggagagcgaggtgtctgagcgggaggcccagcccccctgcccagaggcccatggagaggagctgggcggcttccctgaggtgggcagccctgccagccccccagccagcggcggcctgacagaggagcccctgggccccatggagggggagctgcccggggaggcctgcaccctgacagcccacgagggccggggcggcaaatgtacagaggagggagatgccagccagcaggagggctgcaccctgggcagtgaccccatctgcctgtctgagagccaggtgtctgaggagcaggaggagatgggcggccagagcagcgctgcccaggccacagcctctgtgaatgctgaggagatcaaggtggcccgcatccacgagtgccagtgggtggtggaggatgcccccaacccagatgtgctgctgagccacaaggatgatgtgaaggagggggagggcggccaggagagcttccctgagctgcccagcgaggagtag

SEQ ID NO: 34104 - DNA, 303 bp, Artificial Sequence
  Description of Artificial Sequence: Synthetic coding sequence
tgagctgtggccatcgagaaggtgaagctgcgggtgctgaagcagtatgactatgacagcagcaccatcaggaagaagatcttccaggaggccctggtgcagatcaccctgcccaccgtgcagaaggccctggccagcacctgcaagccagagctgcagaagtatgagcagttcatctttgctgaccacaccaacatgatccacgtggagaatgtgtatgaggagatcctgcaccagatcctgctggatgagaccctgaagggggcctacatccccatcaagtgcagcagcctgaagagctag

SEQ ID NO: 34105 - DNA, 1632 bp, Artificial Sequence
  Description of Artificial Sequence: Synthetic coding sequence
atggccagcggcggcggcggcggcaacacaggagctgggggcggccctggcatgggcctgagcctgggcctgggcctgggcctgagcctgggcatgtctgaggccaccagcgaggccgaggaggaggccgccacagctgaggccgtgggccgcctggccaccaccctgtggctgcggctgcggggctgggaggccgtgctggccgccgcccagaggctgctggtgtgggagaagcccctgcacagcctggtgacagctgctgccctgaatggcctcttctggctgctgagcagcagcagcctgcggcccttcttcctgctgtctgtgtccctgctggcctacttcctgctggacctgtggcagccccgcttcctgcctgatgtgtctgccagcagccctgaggagccccacagcgacagcgagggcgccggcagcggggcccggccccacctgctgtctgtgcctgagctgtgccgctacctggccgagagctggctgaccttccagatccacctgcaggagctgctgcagtacaagaggcagaacccagcccagttctgtgtgcgggtgtgcagcggctgtgctgtgctggccgtgctgggccactacgtgcccggcatcatgatctcctacatcgtgctgctgagcatcctgctgtggcccctggtggtgtaccacgagctgatccagaggatgtacacccggctggagcccctgctgatgcagctggactacagcatgaaggccgaggccaatgccctgcaccacaagcatgacaagaggaagaggcagggcaagaatgcccctcctggaggagatgagcccctggccgagacagaaagtgaaagtgaagctgagctggccggcttcagccctgtggtggatgtgaagaagacagccctggccctggccatcacagacagcgagctgagtgatgaggaggccagcatcctggagagcggcggcttctctgtgtcccgggccaccaccccccagctgacagatgtgtctgaggacctggaccagcagagcctgcccagcgagcctgaggagaccctgagccgggacctgggggagggggaggagggggagctggcccccccagaggacctgctgggccggccccaggccctgagccggcaggccctggacagcgaggaggaggaggaggatgtggccgccaaggagaccctgctgcggctgagcagccccctgcactttgtgaacacccacttcaatggagctggcagccccccagatggagtgaagtgcagccctgggggccctgtggagaccctgagccctgagaccgtgtctgggggcctgacagccctgcccggcaccctgagcccccccctgtgcctggtgggcagtgaccctgcccccagccccagcatcctgccccctgtgccccaggacagcccccagcccctgcctgcccctgaggaggaggaggccctgaccacagaggactttgagctgctggaccagggcgagctggagcagctgaatgctgagctgggcctggagcctgagaccccacccaagcccccagatgccccacccctgggccctgacatccacagcctggtgcagagcgaccaggaggcccaggccgtggccgagccctag

SEQ ID NO: 34106 - DNA, 906 bp, Artificial Sequence
  Description of Artificial Sequence: Synthetic coding sequence
atgatctcctacatcgtgctgctgagcatcctgctgtggcccctggtggtgtaccacgagctgatccagaggatgtacacccggctggagcccctgctgatgcagctggactacagcatgaaggccgaggccaatgccctgcaccacaagcatgacaagaggaagaggcagggcaagaatgcccctcctggaggagatgagcccctggccgagacagagagcgagagcgaggccgagctggccggcttcagccctgtggtggatgtgaagaagacagccctggccctggccatcacagattctgagctgagtgatgaggaggccagcatcctggagagcggcggcttctctgtgtcccgggccaccaccccccagctgacagatgtgtctgaggacctggaccagcagagcctgcccagcgagcctgaggagaccctgagccgggacctgggggagggggaggagggggagctggcccctcctgaggacctgctgggccggccccaggccctgagccggcaggccctggacagcgaggaggaggaggaggatgtggccgccaaggagaccctgctgcggctgagcagccccctgcactttgtgaacacccacttcaacggggccggcagccccccagatggagtgaagtgcagccctgggggccctgtggagaccctgagccctgagacagacagcccccagcccctgcctgcccctgaggaggaggaggccctgaccacagaggactttgagctgctggaccagggcgagctggagcagctgaatgctgagctgggcctggagcctgagaccccacccaagcccccagatgccccacccctgggccctgacatccacagcctggtgcagagcgaccaggaggcccaggccgtggccgagccctag

SEQ ID NO: 34107 - DNA, 1401 bp, Artificial Sequence
  Description of Artificial Sequence: Synthetic coding sequence
atggccgaggccgagggcgtgcccaccaccccaggccctgccagcggcagcaccttccggggcagaagagatgtgtctggctcctgggagcgggaccagcaggtggaggccgcccagagggccctggtggaggtgctgggcccctatgagcccctgctgagccgggtgcaggccgccctggtgtgggagaggcctgcccggagcgccctgtggtgcctgggcctgaatgctgccttctggttctttgccctgaccagcctgcggctggtgttcctgctggccttcggcctgatgatcatcgtgtgcatcgaccagtggaagaacaagatctggccagagatcaaggtgcccaggccagatgccctggacaatgaatcctggggctttgtgcacccccggctgctgtctgtgcctgagctgtgccaccacgtggccgaggtgtgggtgtctggcaccatcttcatcagaaatgtgctgctcttcaagaagcagaaccctgggaagttctgcctgctgagctgtggcatcctgaccttcctggccgtgctgggccgctacgtgcccggcctgctgctgagctacctgatgctggtgacagtgatgatgtggcccctggccgtgtaccaccggctgtgggaccgggcctacgtgcggctgaagccagccctgcagaggctggacttctctgtgcggggctacatgatgagcaagcagcgggagcggcagctgcggcggcgggccctgcaccctgagcgggccatggacaaccacagcgacagcgaggaggagctggccgccttctgcccccagctggatgacagcacagtggcccgggagctggccatcacagattctgagcacagtgatgctgaggtgtcctgcacagacaatggcaccttcaacctgagccggggccagacccccctgacagagggcagcgaggacctggatggccacagcgaccctgaggagagctttgcccgggacctgcctgacttccccagcatcaacatggaccctgctggcctggatgatgaagatgacaccagcatcggcatgcccagcctgatgtaccgcagccccccaggagctgaggagccccaggcccccccagccagcagagatgaagctgccctgcctgagctgctgctgggcgccctgcctgtgggcagcaacctgaccagcaacctggccagcctggtgtcccagggcatgatccagctggccctgagcggggccagccagcccggccccagcggggccccagcccagagggccacccggggcttcctgcggagccccagcagtgacctggacacagatgctgaaggagatgactttgagctgctggaccagagcgagctgagccagctggaccctgccagcagccgcagccactag

SEQ ID NO: 34108 - DNA, 816 bp, Artificial Sequence
  Description of Artificial Sequence: Synthetic coding sequence
atgctggtgacagtgatgatgtggcccctggccgtgtaccaccggctgtgggaccgggcctacgtgcggctgaagccagccctgcagaggctggacttctctgtgcggggctacatgatgagcaagcagcgggagcggcagctgcggcggcgggccctgcaccctgagcgggccatggacaaccacagcgacagcgaggaggagctggccgccttctgcccccagctggatgacagcacagtggcccgggagctggccatcacagacagcgagcacagtgatgctgaggtgtcctgcacagacaatggcaccttcaacctgagccggggccagacccccctgacagagggcagcgaggacctggatggccacagcgaccctgaggagagctttgcccgggacctgcctgacttccccagcatcaacatggaccctgctggcctggatgatgaagatgacaccagcatcggcatgcccagcctgatgtaccgcagccccccaggagctgaggagccccaggcccccccagccagcagagatgaggccgccctgcctgagctgctgctgggcgccctgcctgtgggcagcaacctgaccagcaacctggccagcctggtgtcccagggcatgatccagctggccctgagcggggccagccagcccggccccagcggggccccagcccagagggccacccggggcttcctgcggagccccagcagtgacctggacacagatgctgaaggagatgactttgagctgctggaccagagcgagctgagccagctggaccctgccagcagccgcagccactag

SEQ ID NO: 34109 - DNA, 3960 bp, Artificial Sequence
  Description of Artificial Sequence: Synthetic coding sequence
atgacagaggtgcaggccatggtggagttctctgtggagctgaacaagttctacaacgtggacctcttccagaggggcttctaccagatccgggcctccatgaagatccccagccgcatcccccaccgggtggaggccagcctgctgcacgccaccggcatgaccctggccttccctgcctctgtgcatgacagcctcatctgcagcaagaccttccagatcctgtacaagaatgaggaggtggtgctgaatgatgtgatgatcttcaaggtgaagatgctgctggatgagaggaagattgaggagaccctggaggagatgaacttcctgctgagcctggacctgcacttcacagatggagactacagcgcagatgacctgaatgccctgcagctgatcagcagcaggaccctgaagctgcacttcagcccccaccggggcctgcaccaccacgtgaatgtgatgtttgactacttccacctgtctgtggtgtctgtgacagtgcacgccagcctggtggccctgcaccagcccctcatctccttccccaggcctgtgaagaccacctggctgaacagaaatgccccagcccagaacaaggacagcgtcatccccaccctggagagcgtggtgtttggcatcaactacaccaagcagctgagcccagatggctgcagcttcatcatcgctgacagcttcctgcaccacgcctaccgcttccactacaccctgtgtgccaccctgctgctggccttcaagggcctgcacagctacttcatcaccgtgacagaggagatccccagctgccagaagctggagctggaggagatggatgtggaggcccggctgacagagctgtgtgaggaggtgaagaagattgagaacccagatgagctggccgagctgatcaacatgaacctggcccagctgtgcagcctgctgatggccctgtggggccagttcctggaggtgatcaccctgcacgaggagctgcgcatcctgctggcccaggagcaccacaccctgcgggtgcggcgcttcagcgaggccttcttctgctttgagcacccccgggaggccgccatcgcctaccaggagctgcacgcccagagccacctgcagatgtgcacagccatcaagaacaccagcttctgcagcagcctgccccccctgcccatcgagtgcagcgagctggatggagacctgaacagcctgcccatcatctttgaggaccgctacctggacagcgtgacagagggcaagctggacatcagccaggatgattctgagatcacccagatggagcacaacctggccagcagaagaagcagtgatgactgccacgaccaccagaccacccccagcctgggcgtgaggaccatcgagatcaagcccagcaacaaggaccccttcagcggggagaacatcaccgtgaagctgggcccctggacagagctgcggcaggaggagatcctggtggacaacctgctgcccaactttgagagcctggagagcaatggcaagagcaagagcattgagatcacctttgagaaggaggccctgcaggaggccaagtgcctgagcattggagagagcctgaccaagctgcggagcaacctgcctgcccccagcaccaaggagtaccacgtggtggtgtctggggacaccatcaagctgcctgacatcagcgccacctacgccagcagccgcttcagtgacagcggcgtggagagcgagcccagcagctttgccacccaccccaacacagacctggtgtttgaaacagtgcagggccagggcccctgcaacagcgagcggctcttcccccagctgctgatgaagccagactacaacgtgaagttcagcctgggcaaccactgcacagagagcaccagcgccatcagcgagatccagagcagcctgaccagcatcaacagcctgcccagtgatgatgagctgagcccagatgagaacagcaagaagtctgtggtgcctgagtgccacctgaatgacagcaagacagtgctgaacctgggcaccacagacctgcccaagtgtgatgacaccaagaagagcagcatcaccctgcagcagcagagcgtggtgttcagcggcaacctggacaatgaaacagtggccatccacagcctgaacagcagcatcaaggaccccctgcagtttgtgttcagtgatgaggagaccagcagtgatgtgaagagcagctgcagcagcaagcccaacctggacaccatgtgcaagggcttccagagcccagacaagagcaacaacagcactggaacagccatcaccctgaacagcaagctgatctgcctgggcaccccctgcgtcatcagcggcagcatcagcagcaacacagatgtgtctgaggacaggaccatgaagaagaacagtgatgtgctgaacctgacccagatgtacagcgagatccccaccgtggagagcgagacccacctgggcaccagtgaccccttcagcgccagcacagacatcgtgaagcagggcctggtggagaactacttcggcagccagagcagcacagacatcagtgacacctgtgctgtgtcctacagcaatgccctgagcccccagaaggagaccagcgagaaggagatcagcaacctgcagcaggagcaggacaaggaggatgaggaggaggagcaggaccagcagatggtgcagaatggctactatgaggagacagactacagcgccctggatggcaccatcaatgcccactacaccagcagagatgagctgatggaggagcggctgaccaagtctgagaagatcaacagcgactacctgagagatggcatcaacatgcccaccgtgtgcaccagcggctgcctgtccttccccagcgccccccgggagagcccctgcaatgtgaagtacagcagcaagagcaagtttgatgccatcaccaagcagcccagcagcaccagctacaacttcaccagcagcatctcctggtatgagagcagccccaagccccagatccaggccttcctgcaggccaaggaggagctgaagctgctgaagctgcccggcttcatgtacagcgaggtgcccctgctggccagctctgtgccctacttctctgtggaggaggaggatggctctgaagatggagtgcacctgattgtgtgtgtgcacggcctggatggcaacagcgctgacctgcggctggtgaagacctacatcgagctgggcctgcccggcggcagaattgacttcctgatgtctgaaagaaaccagaatgacacctttgctgactttgacagcatgacagaccggctgctggatgagatcatccagtacatccagatctacagcctgactgtgtccaagatctccttcatcggccacagcctgggcaacctgatcatccgctctgtgctgacccggccccgcttcaagtactacctgaacaagctgcacaccttcctgagcctgagcggcccccacctgggcaccctgtacaacagcagcgccctggtgaacacaggcctgtggttcatgcagaagtggaagaagagcggcagcctgctgcagctgacctgccgggaccacagcgacccccggcagaccttcctgtacaagctgagcaacaaggccggcctgcactacttcaagaatgtggtgctggtgggcagcctgcaggacagatatgtgccctaccacagcgccagaattgagatgtgcaagacagccctgaaggacaagcagagcggccagatctacagcgagatgatccacaacctgctgcggcctgtgctgcagagcaaggactgcaacctggtgcgctacaacgtcatcaatgccctgcccaacacagctgacagcctgattggccgggccgcccacatcgctgtgctggacagcgagatcttcctggagaagttcttcctggtggccgccctgaagtacttccagtag

SEQ ID NO: 34110 - DNA, 3909 bp, Artificial Sequence
  Description of Artificial Sequence: Synthetic coding sequence
atgacagaggtgcaggccatggtggagttctctgtggagctgaacaagttctacaacgtggacctcttccagaggggcaagaccttccagatcctgtacaagaatgaggaggtggtgctgaatgatgtgatgatcttcaaggtgaagatgctgctggatgagaggaagattgaggagaccctggaggagatgaacttcctgctgagcctggacctgcacttcacagatggagactacagcgcagatgacctgaatgccctgcagctgatcagcagcaggaccctgaagctgcacttcagcccccaccggggcctgcaccaccacgtgaatgtgatgtttgactacttccacctgtctgtggtgtctgtgacagtgcacgccagcctggtggccctgcaccagcccctcatctccttccccaggcctgtgaagaccacctggctgaacagaaatgccccagcccagaacaaggacagcgtcatccccaccctggagagcgtggtgtttggcatcaactacaccaagcagctgagcccagatggctgcagcttcatcatcgctgacagcttcctgcaccacgcctaccgcttccactacaccctgtgtgccaccctgctgctggccttcaagggcctgcacagctacttcatcaccgtgacagaggagatccccagctgccagaagctggagctggccaaggccaacatgcagctgctgtatgaaaggctgctgcggaggaagcagctgcggacccagaaggacaaccacctggaggagatggatgtggaggcccggctgacagagctgtgtgaggaggtgaagaagattgaaaatccagatgagctggccgagctgatcaacatgaacctggcccagctgtgcagcctgctgatggccctgtggggccagttcctggaggtgatcaccctgcacgaggagctgcgcatcctgctggcccaggagcaccacaccctgcgggtgcggcgcttcagcgaggccttcttctgctttgagcacccccgggaggccgccatcgcctaccaggagctgcacgcccagagccacctgcagatgtgcacagccatcaagaacaccagcttctgcagcagcctgccccccctgcccattgaatgttctgagctggatggagacctgaacagcctgcccatcatctttgaagatcgctacctggacagcgtgacagagggcaagctggacatcagccaggatgacagcgagatcacccagatggagcacaacctggccagccgccgcagcagtgatgactgccacgaccaccagaccacccccagcctgggcgtgaggaccatcgagatcaagcccagcaacaaggaccccttctctggagagaacatcaccgtgaagctgggcccctggacagagctgcggcaggaggagatcctggtggacaacctgctgcccaactttgagagcctggagagcaatggcaagagcaagagcattgagatcacctttgagaaggaggccctgcaggaggccaagtgcctgagcatcggggagagcctgaccaagctgcggagcaacctgcctgcccccagcaccaaggagtaccacgtggtggtgtctggggacaccatcaagctgcctgacatcagcgccacctacgccagcagccgcttcagtgacagcggcgtggagagcgagcccagcagctttgccacccaccccaacacagacctggtgtttgagaccgtgcagggccagggcccctgcaacagcgagcggctcttcccccagctgctgatgaagccagactacaacgtgaagttcagcctgggcaaccactgcacagagagcaccagcgccatcagcgagatccagagcagcctgaccagcatcaacagcctgcccagtgatgatgagctgagcccagatgagaacagcaagaagtctgtggtgcctgagtgccacctgaatgacagcaagacagtgctgaacctgggcaccacagacctgcccaagtgtgatgacaccaagaagagcagcatcaccctgcagcagcagagcgtggtgttttctggcaacctggacaatgagaccgtggccatccacagcctgaacagcagcatcaaggaccccctgcagtttgtgttcagtgatgaggagaccagcagtgatgtgaagagcagctgcagcagcaagcccaacctggacaccatgtgcaagggcttccagagcccagacaagagcaacaacagcactggaacagccatcaccctgaacagcaagctgatctgcctgggcaccccctgtgtgatcagcggcagcatcagcagcaacacagatgtgtctgaggacaggaccatgaagaagaacagtgatgtgctgaacctgacccagatgtacagcgagatccccaccgtggagagcgagacccacctgggcaccagtgaccccttcagcgccagcacagacatcgtgaagcagggcctggtggagaactacttcggcagccagagcagcacagacatcagtgacacctgtgctgtgtcctacagcaatgccctgagcccccagaaggagaccagcgagaaggagatcagcaacctgcagcaggagcaggacaaggaggatgaggaggaggagcaggaccagcagatggtgcagaatggctactatgaggagacagactacagcgccctggatggcaccatcaatgcccactacaccagcagagatgagctgatggaggagcggctgaccaagtctgagaagatcaacagcgactacctgagagatggcatcaacatgcccaccgtgtgcaccagcggctgcctgtccttccccagcgccccccgggagagcccctgcaatgtgaagtacagcagcaagagcaagtttgatgccatcaccaagcagcccagcagcaccagctacaacttcaccagcagcatctcctggtatgagagcagccccaagccccagatccaggccttcctgcaggccaaggaggagctgaagctgctgaagctgcccggcttcatgtacagcgaggtgcccctgctggccagctctgtgccctacttctctgtggaggaggaggatggctctgaagatggagtgcacctgattgtgtgtgtgcacggcctggatggcaacagcgctgacctgcggctggtgaagacctacatcgagctgggcctgcccggcggcagaattgacttcctgatgtctgagaggaaccagaatgacacctttgctgactttgacagcatgacagaccggctgctggatgagatcatccagtacatccagatctacagcctgactgtgtccaagatctccttcatcggccacagcctgggcaacctgatcatccgctctgtgctgacccggccccgcttcaagtactacctgaacaagctgcacaccttcctgagcctgagcggcccccacctgggcaccctgtacaacagcagcgccctggtgaacacaggcctgtggttcatgcagaagtggaagaagagcggcagcctgctgcagctgacctgccgggaccacagcgacccccggcagaccttcctgtacaagctgagcaacaaggccggcctgcactacttcaagaatgtggtgctggtgggcagcctgcaggaccgctacgtgccctaccacagcgcccgcatcgagatgtgcaagacagccctgaaggacaagcagagcggccagatctacagcgagatgatccacaacctgctgcggcctgtgctgcagagcaaggactgcaacctggtgcgctacaacgtcatcaatgccctgcccaacacagctgacagcctcatcggccgggccgcccacatcgctgtgctggacagcgagatcttcctggagaagttcttcctggtggccgccctgaagtacttccagtag

SEQ ID NO: 34111 - DNA, 4548 bp, Artificial Sequence
  Description of Artificial Sequence: Synthetic coding sequence
atgacagaggtgcaggccatggtggagttctctgtggagctgaacaagttctacaacgtggacctcttccagaggggcttctaccagatccgggcctccatgaagatccccagccgcatcccccaccgggtggaggccagcctgctgcacgccaccggcatgaccctggccttccctgcctctgtgcatgacagcctcatctgcagcaagaccttccagatcctgtacaagaatgaggaggtggtgctgaatgatgtgatgatcttcaaggtgaagatgctgctggatgagaggaagattgaggagaccctggaggagatgaacttcctgctgagcctggacctgcacttcacagatggagactacagcgcagatgacctgaatgccctgcagctgatcagcagcaggaccctgaagctgcacttcagcccccaccggggcctgcaccaccacgtgaatgtgatgtttgactacttccacctgtctgtggtgtctgtgacagtgcacgccagcctggtggccctgcaccagcccctcatctccttccccaggcctgtgaagaccacctggctgaacagaaatgccccagcccagaacaaggacagcgtcatccccaccctggagagcgtggtgtttggcatcaactacaccaagcagctgagcccagatggctgcagcttcatcatcgctgacagcttcctgcaccacgcctaccgcttccactacaccctgtgtgccaccctgctgctggccttcaagggcctgcacagctacttcatcaccgtgacagaggagatccccagctgccagaagctggagctggaggagatggatgtggaggcccggctgacagagctgtgtgaggaggtgaagaagattgagaacccagatgagctggccgagctgatcaacatgaacctggcccagctgtgcagcctgctgatggccctgtggggccagttcctggaggtgatcaccctgcacgaggagctgcgcatcctgctggcccaggagcaccacaccctgcgggtgcggcgcttcagcgaggccttcttctgctttgagcacccccgggaggccgccatcgcctaccaggagctgcacgcccagagccacctgcagatgtgcacagccatcaagaacaccagcttctgcagcagcctgccccccctgcccatcgagtgcagcgagctggatggagacctgaacagcctgcccatcatctttgaggaccgctacctggacagcgtgacagaggacctggatgccccctggatgggcatccagaacctgcagaggtctgagagcagcaagatggacaagtatgaaacagaggagagctctgtggccggcctgagcagccctgagctgaaggtgcggcctgctggggccagcagcatctggtacacagaaggagagaagcagctgaccaagagcctgaagggcaagaatgaggagagcaacaagagcaaggtgaaggtgaccaagctgatgaagaccatgaagtctgagaacaccaagaagctgatcaagcagaacagcaaggacagcgtggtgctggtgggctacaagtgcctgaagagcacagccagcaatgacctgatcaagtgctttgagggcaaccccagccacagccagaaggagggcctggaccccaccatctgtggctacaactttgaccccaagacctacatgaggcagaccagccagaaggaggccagctgcctgcccaccaacacagagaggacagagcagaagagcccagacattgaaaatgtgcagcctgaccagtttgaccccctgaacagcggcaacctgaacctgtgtgccaacctgagcatcagcggcaagctggacatcagccaggatgattctgagatcacccagatggagcacaacctggccagcagaagaagcagtgatgactgccacgaccaccagaccacccccagcctgggcgtgaggaccatcgagatcaagcccagcaacaaggaccccttcagcggggagaacatcaccgtgaagctgggcccctggacagagctgcggcaggaggagatcctggtggacaacctgctgcccaactttgagagcctggagagcaatggcaagagcaagagcattgagatcacctttgagaaggaggccctgcaggaggccaagtgcctgagcattggagagagcctgaccaagctgcggagcaacctgcctgcccccagcaccaaggagtaccacgtggtggtgtctggggacaccatcaagctgcctgacatcagcgccacctacgccagcagccgcttcagtgacagcggcgtggagagcgagcccagcagctttgccacccaccccaacacagacctggtgtttgaaacagtgcagggccagggcccctgcaacagcgagcggctcttcccccagctgctgatgaagccagactacaacgtgaagttcagcctgggcaaccactgcacagagagcaccagcgccatcagcgagatccagagcagcctgaccagcatcaacagcctgcccagtgatgatgagctgagcccagatgagaacagcaagaagtctgtggtgcctgagtgccacctgaatgacagcaagacagtgctgaacctgggcaccacagacctgcccaagtgtgatgacaccaagaagagcagcatcaccctgcagcagcagagcgtggtgttcagcggcaacctggacaatgaaacagtggccatccacagcctgaacagcagcatcaaggaccccctgcagtttgtgttcagtgatgaggagaccagcagtgatgtgaagagcagctgcagcagcaagcccaacctggacaccatgtgcaagggcttccagagcccagacaagagcaacaacagcactggaacagccatcaccctgaacagcaagctgatctgcctgggcaccccctgcgtcatcagcggcagcatcagcagcaacacagatgtgtctgaggacaggaccatgaagaagaacagtgatgtgctgaacctgacccagatgtacagcgagatccccaccgtggagagcgagacccacctgggcaccagtgaccccttcagcgccagcacagacatcgtgaagcagggcctggtggagaactacttcggcagccagagcagcacagacatcagtgacacctgtgctgtgtcctacagcaatgccctgagcccccagaaggagaccagcgagaaggagatcagcaacctgcagcaggagcaggacaaggaggatgaggaggaggagcaggaccagcagatggtgcagaatggctactatgaggagacagactacagcgccctggatggcaccatcaatgcccactacaccagcagagatgagctgatggaggagcggctgaccaagtctgagaagatcaacagcgactacctgagagatggcatcaacatgcccaccgtgtgcaccagcggctgcctgtccttccccagcgccccccgggagagcccctgcaatgtgaagtacagcagcaagagcaagtttgatgccatcaccaagcagcccagcagcaccagctacaacttcaccagcagcatctcctggtatgagagcagccccaagccccagatccaggccttcctgcaggccaaggaggagctgaagctgctgaagctgcccggcttcatgtacagcgaggtgcccctgctggccagctctgtgccctacttctctgtggaggaggaggatggctctgaagatggagtgcacctgattgtgtgtgtgcacggcctggatggcaacagcgctgacctgcggctggtgaagacctacatcgagctgggcctgcccggcggcagaattgacttcctgatgtctgaaagaaaccagaatgacacctttgctgactttgacagcatgacagaccggctgctggatgagatcatccagtacatccagatctacagcctgactgtgtccaagatctccttcatcggccacagcctgggcaacctgatcatccgctctgtgctgacccggccccgcttcaagtactacctgaacaagctgcacaccttcctgagcctgagcggcccccacctgggcaccctgtacaacagcagcgccctggtgaacacaggcctgtggttcatgcagaagtggaagaagagcggcagcctgctgcagctgacctgccgggaccacagcgacccccggcagaccttcctgtacaagctgagcaacaaggccggcctgcactacttcaagaatgtggtgctggtgggcagcctgcaggacagatatgtgccctaccacagcgccagaattgagatgtgcaagacagccctgaaggacaagcagagcggccagatctacagcgagatgatccacaacctgctgcggcctgtgctgcagagcaaggactgcaacctggtgcgctacaacgtcatcaatgccctgcccaacacagctgacagcctgattggccgggccgcccacatcgctgtgctggacagcgagatcttcctggagaagttcttcctggtggccgccctgaagtacttccagtag

SEQ ID NO: 34112 - DNA, 3909 bp, Artificial Sequence; identical to SEQ ID NO: 34110
  Description of Artificial Sequence: Synthetic coding sequence

SEQ ID NO: 34113 - DNA, 153 bp, Artificial Sequence
  Description of Artificial Sequence: Synthetic coding sequence
atgacagaggtgcaggccatggtggagttctctgtggagctgaacaagttctacaacgtggacctcttccagaggggcttctaccagatccgggcctccatgaagatccccagccgcatcccccaccgggtggaggccagcctgctgcactag

SEQ ID NO: 34114 - DNA, 96 bp, Artificial Sequence
  Description of Artificial Sequence: Synthetic coding sequence
atgacagaggtgcaggccatggtggagttctctgtggagctgaacaagttctacaacgtggacctcttccagaggggcttctaccagatcagatag

SEQ ID NO: 34115 - DNA, 1518 bp, Artificial Sequence
  Description of Artificial Sequence: Synthetic coding sequence
atgacagaggtgcaggccatggtggagttctctgtggagctgaacaagttctacaacgtggacctcttccagaggggcttctaccagatccgggcctccatgaagatccccagccgcatcccccaccgggtggaggccagcctgctgcacgccaccggcatgaccctggccttccctgcctctgtgcatgacagcctcatctgcagcaagaccttccagatcctgtacaagaatgaggaggtggtgctgaatgatgtgatgatcttcaaggtgaagatgctgctggatgagaggaagattgaggagaccctggaggagatgaacttcctgctgagcctggacctgcacttcacagatggagactacagcgcagatgacctgaatgccctgcagctgatcagcagcaggaccctgaagctgcacttcagcccccaccggggcctgcaccaccacgtgaatgtgatgtttgactacttccacctgtctgtggtgtctgtgacagtgcacgccagcctggtggccctgcaccagcccctcatctccttccccaggcctgtgaagaccacctggctgaacagaaatgccccagcccagaacaaggacagcgtcatccccaccctggagagcgtggtgtttggcatcaactacaccaagcagctgagcccagatggctgcagcttcatcatcgctgacagcttcctgcaccacgcctaccgcttccactacaccctgtgtgccaccctgctgctggccttcaagggcctgcacagctacttcatcaccgtgacagaggagatccccagctgccagaagctggagctggaggagatggatgtggaggcccggctgacagagctgtgtgaggaggtgaagaagattgagaacccagatgagctggccgagctgatcaacatgaacctggcccagctgtgcagcctgctgatggccctgtggggccagttcctggaggtgatcaccctgcacgaggagctgcgcatcctgctggcccaggagcaccacaccctgcgggtgcggcgcttcagcgaggccttcttctgctttgagcacccccgggaggccgccatcgcctaccaggagctgcacgcccagagccacctgcagatgtgcacagccatcaagaacaccagcttctgcagcagcctgccccccctgcccatcgagtgcagcgagctggatggagacctgaacagcctgcccatcatctttgaggaccgctacctggacagcgtgacagaggacctggatgccccctggatgggcatccagaacctgcagaggtctgagagcagcaagatggacaagtatgaaacagaggagagctctgtggccggcctgagcagccctgagctgaaggtgcggcctgctggggccagcagcatctggtacacagaaggagagaagcagctgaccaagagcctgaagggcaagaatgaggagagcaacaagagcaaggtgaaggtgaccaagctgatgaagaccatgaagtctgagaactag

SEQ ID NO: 34116 - DNA, 462 bp, Artificial Sequence
  Description of Artificial Sequence: Synthetic coding sequence
atgtctgagatccagggcaccgtggagttctctgtggagctgcacaagttctacaacgtggacctcttccagaggggctactaccagatccgggtgaccctgaaggtgagcagccgcatcccccaccggctgagcgccagcattgctggccagacagagagcagcagcctgcacagcgcctgtgtgcatgacagcacagtgcacagcagggtcttccagatcctgtacagaaatgaggaggtgcccatcaatgatgctgtggtgttccgggtgcacctgctgctgggcggggagaggatggaggatgccctgtctgaggtggacttccagctgaaggtggacctgcacttcacagacagcgagcagcagctgagagatgtggccggggcccccatggtgagcagcaggaccctgggcctgcacttccaccccagaaatggcctgcaccaccaggtgccctag

SEQ ID NO: 34117 - DNA, 4221 bp, Artificial Sequence
  Description of Artificial Sequence: Synthetic coding sequence
atgtctgagatccagggcaccgtggagttctctgtggagctgcacaagttctacaacgtggacctcttccagaggggctactaccagatccgggtgaccctgaaggtgagcagccgcatcccccaccggctgagcgccagcattgctggccagacagagagcagcagcctgcacagcgcctgtgtgcatgacagcacagtgcacagcagggtcttccagatcctgtacagaaatgaggaggtgcccatcaatgatgctgtggtgttccgggtgcacctgctgctgggcggggagaggatggaggatgccctgtctgaggtggacttccagctgaaggtggacctgcacttcacagacagcgagcagcagctgagagatgtggccggggcccccatggtgagcagcaggaccctgggcctgcacttccaccccagaaatggcctgcaccaccaggtgcctgtgatgtttgactacttccacctgagcgtcatctctgtgacagtgcacgccgccctggtggccctgcagcagcccctcatctccttcaccaggcctggccggggctcctggctgggcaaaggaggccctgacaccggccaggagcagagcatcatcagcctggagaacctggtgtttggagctggctactgcaagcccaccagcagcgagggcagcttctacatcaccagcgagaactgcatgcagcacgcccacaagtggcaccgggacctgtgcctgctgctgctgcacgcctaccggggcctgcggctgcacttcctggtgatcatgagggacatccctgagctgccccacacagagctggaggccctggccgtggaggagaccctgagccagctgtgcagcgagctgcagatgctgaacaaccctgagaagattgctgagcagatcagcaaggacctggcctggctgaccagccacatgatgaccctgtggacccagttcctggacacagtgaccctgcacagccaggtgaccacctacctgacccaggagcaccacaccctgcgggtgcggcgcttcagcgaggccttcttctacatggagcaccagaagctggccgtgctgaccttccaggagaacctgatccagacccacagccagctgagcctggacatccggaacagcgagtacctgacctccatgccacccctgcctgctgagtgcctggacattgatggagactggaacaccctgcccgtcatctttgaggacagatatgtggactgcccagccaccggccacaacctgtctgtgtaccccaactttgatgtgcctgtgaccagccccaccatcatgaacctgaaggacaaggaggacaactgcatggtgaacagcaacctgtccttccgggaggacctggtgctgagcaccatcaagcccagccagatggacagtgatgaggaggtgatccgctgcccagagcccggggagaatgtggccacccagaaccacatggacatgtgcagcgagagccaggtgtacatcagcatcggggagttccagaacaaggccggcgtgcctgaagatgagtgctggacaggccagaccagtgatgctggcacctaccctgtggctgatgtggacaccagccgccgcagccctggcccagaagatggccaggcccctgtgctgacctacattgatgtgaagagcagcaacaagaaccccagcagagctgagcccctggtggccttcaatgcccagcacgagagccgcagcagccgggacaagtatggcctggacagaacaggcctgagcaaggtggtggtgggcggcagccaccagaatgccatcagcagtgacaagaccaccctgcacgagctgagcaccctgggcaagggcatcgaccaggagggcaagatggtgctgctgagcctgaagctgacccccagcgagccctgtgaccccctgagcagcaccctgcgggagcccctggacatccgcagcagcctgaaggacagccacacagaggagcaggaggagctgtctgtgctgtctggagtcatcaagaggagcagcagcatcatcagtgacagcggcatcgagagcgagcccagctctgtggcctggagcgaggcccggagccgggccctggagctgcccagcgaccgggaggtgctgcacccctttgtgagaagacatgccctgcacaggaacagcctggagggcggccacacagagagcaacaccagcctgcccagcggcatccaggccagcctgaccagcatcagcagcctgccctttgaagaagatgagcgggaggtggccctgaccaagctgaccaagtctgtgtctgccccccacatcagcagccctgaggaggccgcagaagatgctgacaccaagcagcaggacggcggctttgctgagcccagcgacatgcacagcaagagccagggcagccctggcagctgcagccagctgtgtggggacagcggcacagatgctggagctgaccaccccctggtggagatcgtgctggatgctgacaaccagcagggccctggctacatcgacatccccaagggcaagggcaagcagtttgatgcccagggccactgcctgcctgatggccgcacagagaacaccccaggagtggagaccaagggcctgaacctgaagatccccagggtcatcgccctggagaaccccaggaccaggagcctgcaccgggccctggaggagacccccaagggcatgcccaaggacctgaatgtgggccagcaggccctgagcaacagcggcatcagcgaggtggagggcctgagccagcaccaggtgcctgagctgagctgcaccagcgctgctgatgccatcaacagaaacagcacaggccagcagagccagagcggcagcccctgcatcatggatgacacagccttcaacagaggagtgaatgccttccctgaggccaagcacaaggccggcaccgtgtgccccaccgtgacccacagcgtgcacagccaggtgctgaagaaccaggagctgaaggccggcaccagcatcatgggcagccacctgaccagcgctgagaccttcaccctggacagcctgaaggctgtggaggtggtgaacctgtctgtgtcctgcacagccacctgcctgcccttcagctctgtgcccaaggagaccccagcccgggccggcttcagcagcaagcagaccctcttccccatcacccaccagcccctgggcagctttggagtggtgtccacccacagcagcaccctggatgaggaggtgtctgagaggatgttctccttctaccaggccaaggagaagttcaagaaggagctgaagattgagggcttcctgtacagcgacctgactgtgctggccagtgacatcccctacttccccccagaggaggaggaggagaacctggaggatggcatccacctggtggtgtgtgtgcacggcctggatggcaacagcgctgacctgcggctggtgaagaccttcatcgagctgggcctgcccggcggcaagctggacttcctgatgtctgagaagaaccagatggacacctttgctgactttgacaccatgacagaccggctgctggatgagatcatccagcacatccagctgtacaacctgagcatcagccgcatctccttcatcggccacagcctgggcaacatcatcatccgctctgtgctgacccggccccgcttccgctactacctgaacaagctgcacaccttcctgagcctgagcggcccccacctgggcaccctgtacaacaacagcaccctggtgtccacaggcctgtggctgatgcagaagctgaagaagagcggcagcctgctgcagctgaccttccgggacaatgctgacctgaggaagtgcttcctgtaccagctgagccagaagacaggcctgcagtacttcaagaatgtggtgctggtggccagcccccaggaccgctacgtgcccttccacagcgcccgcatcgagatgtgcaagacagccctgaaggacagacacacaggccctgtgtatgcagagatgatcaacaacctgctgggccccctggtggaggccaaggactgcaccctcatccgccacaacgtgttccacgccctgcccaacacagccaacaccctcatcggccgggccgcccacatcgctgtgctggacagcgagctgttcctggagaagttcttcctggtggccggcctgaactacttcaagtag

SEQ ID NO: 34118 - DNA, 207 bp, Artificial Sequence
  Description of Artificial Sequence: Synthetic coding sequence
atgtctgagatccagggcaccgtggagttctctgtggagctgcacaagttctacaacgtggacctcttccagaggggctactaccagatccgggtgaccctgaaggtgagcagccgcatcccccaccggctgagcgccagcattgctggccagacagaggtgctgaacatccacatgtctgagcaggagcccgcccagggcaagtag

SEQ ID NO: 34119 - DNA, 1197 bp, Artificial Sequence
  Description of Artificial Sequence: Synthetic coding sequence
atggtgtgccgggagcagctgagcaagaaccaggtgaagtgggtgtttgctggcatcacctgtgtgtctgtggtggtgattgctgccatcgtgctggccatcaccctgcggcggcccggctgtgagctggaggcctgcagcccagatgctgacatgctggactacctgctgagcctgggccagatcagcagaagagatgccctggaggtgacctggtaccacgccgccaacagcaagaaggccatgacagctgccctgaacagcaacatcaccgtgctggaggctgatgtgaatgtggagggcctgggcacagccaatgagaccggggtgcccatcatggcccacccccccaccatctacagcgacaacaccctggagcagtggctggatgctgtgctgggcagcagccagaagggcatcaagctggacttcaagaacatcaaggctgtgggccccagcctggacctgctgcggcagctgacagaggagggcaaggtgagaagacccatctggatcaatgctgacatcctgaagggccccaacatgctgatcagcacagaggtgaatgccacccagttcctggccctggtgcaggagaagtaccccaaggccaccctgagccctggctggaccaccttctacatgagcaccagccccaacagaacctacacccaggccatggtggagaagatgcatgagctggtgggcggcgtgccccagagggtgaccttccctgtgcgcagctccatggtgcgggccgcctggccccacttctcctggctgctgagccagagcgagcgctacagcctgaccctgtggcaggccgccagtgaccccatgtctgtggaggacctgctgtatgtgcgggacaacacagctgtgcaccaggtgtactatgacatctttgagcccctgctgctgacagacatgctggagctgtgccagggcctgtggcagcctgtgtccttccagatgcaggccatgctgctgggccacagcacagctggggccatcggccgcctgctggccagcagcccccgggccaccgtgacagtggagcacaacccagctggaggagactatgcctctgtgaggacagccctgctggccgcccgggctgtggacaggaccagggtgtactaccgcctgccccagggctaccacaaggacctgctggcccacgtgggcagaaattag

SEQ ID NO: 34120 - DNA, 1758 bp, Artificial Sequence
  Description of Artificial Sequence: Synthetic coding sequence
atggtgtgccgggagcagctgagcaagaaccaggtgaagtgggtgtttgctggcatcacctgtgtgtctgtggtggtgattgctgccatcgtgctggccatcaccctgcggcggcccggctgtgagctggaggcctgcagcccagatgctgacatgctggactacctgctgagcctgggccagatcagcagaagagatgccctggaggtgacctggtaccacgccgccaacagcaagaaggccatgacagctgccctgaacagcaacatcaccgtgctggaggctgatgtgaatgtggagggcctgggcacagccaatgagaccggggtgcccatcatggcccacccccccaccatctacagcgacaacaccctggagcagtggctggatgctgtgctgggcagcagccagaagggcatcaagctggacttcaagaacatcaaggctgtgggccccagcctggacctgctgcggcagctgacagaggagggcaaggtgagaagacccatctggatcaatgctgacatcctgaagggccccaacatgctgatcagcacagaggtgaatgccacccagttcctggccctggtgcaggagaagtaccccaaggccaccctgagccctggctggaccaccttctacatgagcaccagccccaacagaacctacacccaggccatggtggagaagatgcatgagctggtgggcggcgtgccccagagggtgaccttccctgtgcgcagctccatggtgcgggccgcctggccccacttctcctggctgctgagccagagcgagcgctacagcctgaccctgtggcaggccgccagtgaccccatgtctgtggaggacctgctgtatgtgcgggacaacacagctgtgcaccaggtgtactatgacatctttgagcccctgctgagccagttcaagcagctggccctgaatgccaccaggaagcccatgtactacacaggaggcagcctcatccccctgctgcagctgcctggagatgatggcctgaatgtggagtggctggtgcctgatgtgcagggcagcggcaagacagccaccatgaccctgcctgacacagagggcatgatcctgctgaacacaggcctggagggcaccgtggctgaaaatcctgtgcccatcgtgcacaccccatctggcaacatcctgaccctggagagctgcctgcagcagctggccacccaccctggccactggggcatccacctgcagattgctgagcctgctgccctgcggcccagcctggccctgctggcccggctgagcagcctgggcctgctgcactggcctgtgtgggtgggcgccaagatcagccacggcagcttctctgtgcccggccacgtggccggccgggagctgctgacagctgtggccgaggtgttcccccacgtgacagtggcccctggctggccagaggaggtgctgggcagcggctaccgggagcagctgctgacagacatgctggagctgtgccagggcctgtggcagcctgtgtccttccagatgcaggccatgctgctgggccacagcacagctggggccatcggccgcctgctggccagcagcccccgggccaccgtgacagtggagcacaacccagctggaggagactatgcctctgtgaggacagccctgctggccgcccgggctgtggacaggaccagggtgtactaccgcctgccccagggctaccacaaggacctgctggcccacgtgggcaggaactag

SEQ ID NO: 34121 - DNA, 936 bp, Artificial Sequence
  Description of Artificial Sequence: Synthetic coding sequence
atggtgtgccgggagcagctgagcaagaaccaggtgaagtgggtgtttgctggcatcacctgtgtgtctgtggtggtgattgctgccatcgtgctggccatcaccctgcggcggcccggctgtgagctggaggcctgcagcccagatgctgacatgctggactacctgctgagcctgggccagatcagcagaagagatgccctggaggtgacctggtaccacgccgccaacagcaagaaggccatgacagctgccctgaacagcaacatcaccgtgctggaggctgatgtgaatgtggagggcctgggcacagccaatgagaccggggtgcccatcatggcccacccccccaccatctacagcgacaacaccctggagcagtggctggatgctgtgctgggcagcagccagaagggcatcaagctggacttcaagaacatcaaggctgtgggccccagcctggacctgctgcggcagctgacagaggagggcaaggtgagaagacccatctggatcaatgctgacatcctgaagggccccaacatgctgatcagcacagaggtgaatgccacccagttcctggccctggtgcaggagaagtaccccaaggccaccctgagccctggctggaccaccttctacatgagcaccagccccaacagaacctacacccaggccatggtggagaagatgcatgagctggtgggcggcgtgccccagagggtgaccttccctgtgcgcagctccatggtgcgggccgcctggccccacttctcctggctgctgagccagagcgagcgctacagcctgaccctgtggcaggccgccagtgaccccatgtctgtggaggacctgctgtatgtgcgggacaacacagctgtgcaccaggtgtactatgacatctttgagcccctgctgtgcagccagatctgctag

SEQ ID NO: 34122 - DNA, 1377 bp, Artificial Sequence
  Description of Artificial Sequence: Synthetic coding sequence
atgaccaggggggcctggatgtgccggcagtatgatgatggcctgaagatctggctggccgccccccgggagaatgagaagcccttcatcgacagcgagcgggcccagaagtggaggctgagcctggccagcctgctcttcttcaccgtgctgctgagtgaccacctgtggttctgtgccgaggccaagctgacccgggcccgggacaaggagcaccagcagcagcagaggcagcagcagcagcagcagcagcagcagaggcagaggcagcagcagcagcagcagaggcggcagcaggagcccagctggccagccctgctggcctccatgggagagagcagccctgctgcccaggcccaccggctgctgagcgccagcagcagccccaccctgccccccagccctggagatggcggcggcggcggcggcaagggcaacagaggcaaggatgaccggggcaaggccctcttcctgggcaacagcgccaagcctgtgtggaggctggagacctgctacccccagggcgccagcagcggccagtgcttcaccgtggagaatgctgatgctgtgtgtgccaggaactggagcagaggagctgctggaggagatggccaggaggtgcgcagcaagcaccccacccccctgtggaacctgagtgacttctacctgtccttctgcaacagctacaccctgtgggagctgttcagcggcctgagcagccccaacaccctgaactgcagcctggatgtggtgctgaaggagggcggggagatgaccacctgccggcagtgtgtggaggcctaccaggactatgaccaccacgcccaggagaagtatgaggagtttgagagcgtgctgcacaagtacctgcagagcgaggagtacagcgtgaagagctgcccagaggactgcaagatcgtgtacaaggcctggctgtgcagccagtactttgaggtgacccagttcaactgcaggaagaccatcccctgcaagcagtactgcctggaggtgcagacccgctgccccttcatcctgcctgacaatgatgaagtcatctatggaggcctgagcagcttcatctgcaccggcctgtatgagaccttcctgaccaatgatgagcctgagtgctgtgatgtgcggcgggaggagaagagcaacaaccccagcaagggcaccgtggagaagagcggcagctgccacaggaccagcctgactgtgagcagcgccacccggctgtgcaacagccggctgaagctgtgtgtgctggtgctgatcctgctgcacacagtgctgacagccagcgctgcccagaacacagctggcctgagctttggaggcatcaacaccctggaggagaacagcaccaatgaggagtag

SEQ ID NO: 34123 - DNA, 1419 bp, Artificial Sequence
  Description of Artificial Sequence: Synthetic coding sequence
atgttccggggggcctggatgtggccaggcaaggatgctgctgccctgaccatctgctgctgctgctgctgctgggccccccggcccagcgacaagccctgtgccgacagcgagcgggcccagcgctggaggctgagcctggccagcctgctcttcttcaccgtgctgctggccgaccacctgtggctgtgtgccggggcccggccccgggcccgggagctgagcagcgccatgaggcctccctggggcgccggccgggagcggcagcctgtgccccccagggctgtgctgcccctgcccccacctcctcctggagagcccagcgcccctcctggcacctgtggcccccgctacagcaacctgaccaaggccgccccagctgctggcagcaggcctgtgtgtggcggcgtgcctgagcccaccggcctggatgctgcctgcaccaagctgcagagcctgcagaggctgtttgagcccaccaccccagccccacccctgcggcccccagacagcctgagccgggccccagctgagttccccagcgccaagaagaacctgctgaagggccacttcaggaacttcaccctgtccttctgtgacacctacacagtgtgggacctgctgctgggcatggacagaccagacagcctggactgcagcctggacaccctgatgggagacctgctggccgtggtggccagccctggcagcggggcctgggaggcctgcagcaactgcatcgaggcctaccagaggctggacagacatgcccaggagaagtatgatgaatttgacctggtgctgcacaagtacctgcaggccgaggagtacagcatccgcagctgcaccaagggctgcaaggctgtgtacaaggcctggctgtgcagcgagtacttctctgtgacccagcaggagtgccagcgctgggtgccctgcaagcagtactgcctggaggtgcagacccgctgccccttcatcctgcctgacaatgaggagatggtgtatggaggcctgcccggcttcatctgcaccggcctgctggacaccagccccaagaggctggagaccaagtgctgtgatgtgcagtgggtgtcctgtgaggccaagaagaagaagttcaaggagagcgaggcccccaagacccaccagcagcagttccaccacagctacttccaccactaccaccagcagtaccaccactaccacccccaccacgaccccccaggccgggtgagcaacaagccagccctgctgcctgtgtctgggggcagccggctgagccccagccgcatccggctgtgtgtgctggtgctgatgctgctgcacacagtggtgtccttcagcagcaaccagggcggcggcggcctgggcctggagaccctgcctgccctggaggagggcctgacccgggaggagtag

SEQ ID NO: 34124 - DNA, 642 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcccgcatcagccccctgggggacaggagccagaaccgcttccgctgtgaatgtcgctactgccagagccaccggcccaacctgagcggcatccctggagagagcaacagagccccccaccccagctcctgggagaccctggtgcagggcctgagcggcctgaccctgagcctgggcaccaaccagcccggccccctgcctgaggccgccctgcagccccaggagacagaggagaagaggcagcgggagcggcagcaggagagcaagatcatgttccagaggctgctgaagcagtggctggaggagaactag

SEQ ID NO: 34125 - DNA, 642 bp, Artificial Sequence; identical to SEQ ID NO: 34124
  Description of Artificial Sequence: Synthetic coding sequence

SEQ ID NO: 34126 - DNA, 642 bp, Artificial Sequence; identical to SEQ ID NO: 34124
  Description of Artificial Sequence: Synthetic coding sequence

SEQ ID NO: 34127 - DNA, 381 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcccgcatcagccccctgggggacaggagccagaaccgcttccgctgctag

SEQ ID NO: 34128 - DNA, 555 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcccgcatcagccccctgggggacaggagccagaaccgcttccgctgtgaatgtcgctactgccagagccaccggcccaacctgagcggcatccctggagagagcaacagagccccccaccccagctcctgggagaccctggtgcagggcctgagcggcctgaccctgagcctgggcaccaaccagcccggccccctgcctgaggccgccctgcagccccagtag

SEQ ID NO: 34129 - DNA, 642 bp, Artificial Sequence; identical to SEQ ID NO: 34124
  Description of Artificial Sequence: Synthetic coding sequence

SEQ ID NO: 34130 - DNA, 33 bp, Artificial Sequence
  Description of Artificial Sequence: Synthetic coding sequence
atggaccccctgcagaagagaaatcctgcctag

SEQ ID NO: 34131 - DNA, 567 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcccgcatcagccccctgggggacaggagccagaaccgcttccgctgtgaatgtcgctactgccagagccaccggcccaacctgagcggcatccctggagagagcaacagagccccccaccccagctcctgggagaccctggtgcagggcctgagcggcctgaccctgagcctgggcaccaaccagcccggccccctgcctgaggccgccctgcagccccaggagacagaggagtag

SEQ ID NO: 34132 - DNA, 327 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggctag

SEQ ID NO: 34133 - DNA, 336 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcctag

SEQ ID NO: 34134 - DNA, 396 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagaggaagaaggccttcctgcggcacgtgagaagaagacaccgggaccacatggccccctatgctgtgggccgggaggcccgcatcagccccctgggggacaggagccagaaccgcttccgctgtgaatgtcgctactgctag

SEQ ID NO: 34135 - DNA, 12 bp, Artificial Sequence
  Description of Artificial Sequence: Synthetic coding sequence
atggacccctag

SEQ ID NO: 34136 - DNA, 258 bp, Artificial Sequence
  Description of Artificial Sequence: Synthetic coding sequence
atggaccccctgcagaagagaaatcctgccagccccagcaagagcagccccatgacagctgctgagaccagccaggagggccctgcccccagccagcccagctacagcgagcagcccatgatgggcctgagcaacctgagccctggccctggccccagccaggccgtgcccctgcctgagggcctgctgcggcagcgctaccgggaggagaagaccctggaggagcggcgctgggagcggctggagttcctgcagtag

SEQ ID NO: 34137 - DNA, 642 bp, Artificial Sequence; identical to SEQ ID NO: 34124
  Description of Artificial Sequence: Synthetic coding sequence

SEQ ID NO: 34138 - DNA, 642 bp, Artificial Sequence; identical to SEQ ID NO: 34124
  Description of Artificial Sequence: Synthetic coding sequence

SEQ ID NO: 34139 - DNA, 642 bp, Artificial Sequence; identical to SEQ ID NO: 34124
  Description of Artificial Sequence: Synthetic coding sequence

SEQ ID NO: 34140 - DNA, 642 bp, Artificial Sequence; identical to SEQ ID NO: 34124
  Description of Artificial Sequence: Synthetic coding sequence

SEQ ID NO: 34141 - DNA, 642 bp, Artificial Sequence; identical to SEQ ID NO: 34124
  Description of Artificial Sequence: Synthetic coding sequence

SEQ ID NO: 34142 - DNA, 642 bp, Artificial Sequence; identical to SEQ ID NO: 34124
  Description of Artificial Sequence: Synthetic coding sequence

SEQ ID NO: 34143 - DNA, 642 bp, Artificial Sequence; identical to SEQ ID NO: 34124
  Description of Artificial Sequence: Synthetic coding sequence

SEQ ID NO: 34144 - DNA, 573 bp, Artificial Sequence
  Description of Artificial Sequence: Synthetic coding sequence
atgtctggggcctgcaccagctatgtgtctgctgagcaggaggtggtgcggggcttcagctgccccaggcctggaggagaggccgctgctgtgttctgctgcggcttccgggaccacaagtactgctgtgatgacccccacagcttcttcccctatgagcacagctacatgtggtggctgagcatcggggccctgattggcctgtctgtggccgctgtggtgctgctggccttcatcgtgacagcctgtgtgctgtgctacctgttcatcagcagcaagccccacaccaagctggacctgggcctgagcctgcagacagctggccctgaggaggtgtccccagactgccagggcgtgaacacaggcatggctgctgaggtgcccaaggtgagccccctgcagcagagctacagctgcctgaacccccagctggagagcaatgaaggccaggccgtgaacagcaagaggctgctgcaccactgcttcatggccaccgtgaccaccagtgacatccctggcagccctgaggaggcctctgtgcccaacccagacctgtgtggccctgtgccctag

SEQ ID NO: 34145 - DNA, 510 bp, Artificial Sequence
  Description of Artificial Sequence: Synthetic coding sequence
atgggcagcctgagcggcctgcggctggccgccggcagctgcttccggctgtgtgaaagagatgtgagcagcagcctgcggctgaccaggagcagtgacctgaagaggatcaatggcttctgcaccaagccccaggagagccctggggcccccagccgccacctgcagcagagcgccttcacccagacctacggcctggccgagaaggacccccacatggtgcgcagcctgcaggaggatgagatccctgagaccgtgtccctggagatgctggatgctgccaagaacaagatgagggtgaagatctcctacctgatgattgccctgactgtggtgggctgcatcttctggctgctgcgggcccggagctgccccaagacccgggacttcaacaagctggagctgaggaaggagagcagcagcgagcggggcagcagctatgagggccagaacagagtggccgaggtgtctgtgctggccatcctgaagatccaggagctgtgctactag

SEQ ID NO: 34146 - DNA, 465 bp, Artificial Sequence
  Description of Artificial Sequence: Synthetic coding sequence
atgggcagcctgagcggcctgcggctggccgccggcagctgcttccggctgtgtgaaagagatgtgagcagcagcctgcggctgaccaggagcagtgacctgaagaggatcaatggcttctgcaccaagccccaggagagccctggggcccccagcaggacctacaacagagtgcccctgcacaagcccacagactggcagaagaagatcctgatctggagcggccgcttcaagaaggaggatgagatccctgagaccgtgtccctggagatgctggatgctgccaagaacaagatgagggtgaagatctcctacctgatgattgccctgactgtggtgggctgcatcttcatggtgattgagggcaagaaggccgcccagagacatgagaccctgaccagcctgaacctggagaagaaggcccggctgaaggaggaggccgccatgaaggccaagacagaatag

SEQ ID NO: 34147 - DNA, 489 bp, Artificial Sequence
  Description of Artificial Sequence: Synthetic coding sequence
atgctgcgggctgtgggcagcctgctgcggctgggccggggcctgactgtgcgctgtggccctggggcccccctggaggccaccaggaggcctgccccagccctgcccccccggggcctgccctgctacagcagtggaggagcccccagcaacagcggcccccagggccatggagagatccaccgggtgcccacccagaggcggcccagccagtttgacaagaagatcctgctgtggacaggccgcttcaagtccatggaggagatccccccacgcatccccccagagatgattgacacagccaggaacaaggcccgggtgaaggcctgctacatcatgattggcctgaccatcatcgcctgctttgctgtgattgtgtctgccaagagagctgtggagagacatgagagcctgacctcctggaacctggccaagaaggccaagtggagggaggaggccgccctggccgcccaggccaaggccaagtag

SEQ ID NO: 34148 - DNA, 504 bp, Artificial Sequence
  Description of Artificial Sequence: Synthetic coding sequence
atgacagctggcaccgtggtgatcactggaggcatcctggccaccgtcatcctgctgtgcatcatcgctgtgctgtgctactgccgcctgcagtactactgctgcaagaagagcggcacagaggtggctgatgaggaggaggagcgggagcatgacctgcccacccacccccggggccccacctgcaatgcctgcagcagccaggccctggatggccggggcagcctggcccccctgaccagcgagccctgcagccagccctgtggggtggccgccagccactgcaccacctgcagcccctacagcagccccttctacatcagaacagctgacatggtgcccaatggaggcggcggggagcggctgagctttgcccccacctactacaaggagggcggcccccccagcctgaagctggccgccccccagagctaccctgtgacctggccaggcagcggccgggaggccttcaccaacccccgggccatcagcacagatgtgtag

SEQ ID NO: 34149 - DNA, 501 bp, Artificial Sequence
  Description of Artificial Sequence: Synthetic coding sequence
atgacagctggcaccgtggtgatcactggaggcatcctggccaccgtcatcctgctgtgcatcatcgctgtgctgtgctactgccgcctgcagtactactgctgcaagaaggatgagagcgaggaggatgaggaggagccagactttgctgtgcacagccacctgccccccctgcacagcaacagaaacctggtgctgaccaacggccctgccctgtaccccacagccagcaccagcttcagccagaagagcccccaggcccgggccctgtgccgcagctgcagccactgtgagccccccaccttcttcctgcaggagcccccagaggaggaggaggatgtgctgaatggaggagagcgggtgctgtacaagtctgtgtcccaggaggatgtggagctgcccccaggcggctttggaggcctgcaggccctgaaccccaaccggctgagcgccatgagggaggcctttgcccggagccgcagcatcagcacagatgtgtag

SEQ ID NO: 34150 - DNA, 501 bp, Artificial Sequence; identical to SEQ ID NO: 34149
  Description of Artificial Sequence: Synthetic coding sequence

SEQ ID NO: 34151 - DNA, 177 bp, Artificial Sequence
  Description of Artificial Sequence: Synthetic coding sequence
atgaactggaaggtgctggagcacgtgcacctgctgctgtacatcctggccgccaagaccctcatcctgtgcctggcctttgctggggtgaagatctaccagaggaagaggctggaggccaagcagcagaagctggaggccgagaggaagaagcagagcgagaagaaggacaactag

SEQ ID NO: 34152 - DNA, 177 bp, Artificial Sequence
  Description of Artificial Sequence: Synthetic coding sequence
atgaactggaaggtgctggagcacgtgcccctgctgctgtacatcctggccgccaagaccctcatcctgtgcctgacctttgctggggtgaagatgtaccagaggaagaggctggaggccaagcagcagaagctggaggccgagaggaagaagcagagcgagaagaaggacaactag

SEQ ID NO: 34153 - DNA, 177 bp, Artificial Sequence; identical to SEQ ID NO: 34152
  Description of Artificial Sequence: Synthetic coding sequence

SEQ ID NO: 34154 - DNA, 597 bp, Artificial Sequence
  Description of Artificial Sequence: Synthetic coding sequence
atgagccgcagcgccaccctgctgctgtgcctgctgggctgccacgtgtggaaggctgtgaccaagaccctgcgggagcctggagctggggcccaggaggtgaccctgaaggtgcacatcagtgatgccagcacccaccagcctgtggctgatgccctgattgagatcttcaccaaccaggccagcatcgccagcggcaccagcggcacagatggagtggccttcatcaagttccagtacaagctgggcagccagctgattgtgacagccagcaagcacgcctacgtgcccaacagcgccccctggaagcccatccggctgcccgtcttcagcagcctgagcctgggcctgctgcctgagaggtctgccaccctgatggtgtatgaagatgtggtgcagatcgtgtctggcttccagggcaacagcaccaggcatgacctgacccctgtgacagctgtgtctgtgcacctgctgagcagcaatggcacccctgtgctggtggatggccccatctacgtgacagtgcccctggccacccagagcagcctgcggcacaatgcctacgtggccgcctggaggtttgaccagaagctgtag

SEQ ID NO: 34155 - DNA, 2673 bp, Artificial Sequence
  Description of Artificial Sequence: Synthetic coding sequence
atgagccgcagcgccaccctgctgctgtgcctgctgggctgccacgtgtggaaggctgtgaccaagaccctgcgggagcctggagctggggcccaggaggtgaccctgaaggtgcacatcagtgatgccagcacccaccagcctgtggctgatgccctgattgagatcttcaccaaccaggccagcatcgccagcggcaccagcggcacagatggagtggccttcatcaagttccagtacaagctgggcagccagctgattgtgacagccagcaagcacgcctacgtgcccaacagcgccccctggaagcccatccggctgcccgtcttcagcagcctgagcctgggcctgctgcctgagaggtctgccaccctgatggtgtatgaagatgtggtgcagatcgtgtctggcttccagggcgcccggccccagccccgggtgcacttccagaggcgggccctgcggctgcctgagaacaccagctacagcgacctgacagccttcctgacagctgccagcagccccagcgaggtggacagcttcccctacctgcggggcctggatggaaatggcaccggcaacagcaccaggcatgacctgacccctgtgacagctgtgtctgtgcacctgctgagcagcaatggcacccctgtgctggtggatggccccatctacgtgacagtgcccctggccacccagagcagcctgcggcacaatgcctacgtggccgcctggaggtttgaccagaagctgggcacctggctgaagagcggcctgggcctggtgcaccaggagggcagccagctgacctggacctacatcgccccccagctgggctactgggtggccgccatgagcccccccatccctggccctgtggtgacccaggacatcaccacctaccacacagtgttcctgctggccatcctgggcggcatggccttcatcctgctggtgctgctgtgcctgctgctgtactactgcaggaggaagtgcctgaagccccggcagcaccacaggaagctgcagctgcctgctggcctggagagcagcaagagggaccagagcacctccatgagccacatcaacctgctcttcagccggcgggccagcgagttccctggccccctgtctgtgaccagccacggccggcctgaggcccctggcaccaaggagctgatgtctggagtgcacctggagatgatgagccctggaggagagggggacctgcacacccccatgctgaagctgagctacagcaccagccaggagttcagcagccgggaggagctgctgagctgcaaggaggaggacaagagccagatcagctttgacaacctgacccccagcggcaccctgggcaaggactaccacaagtctgtggaggtgttccccctgaaggccaggaagtccatggagcgggagggctatgagagcagtggaaatgatgactaccggggcagctacaacacagtgctgagccagcccctgtttgagaagcaggaccgggagggccctgccagcacaggcagcaagctgaccatccaggagcacctgtacccagcccccagcagccctgagaaggagcagctgctggaccggcggcccacagagtgcatgatgagccgctctgtggaccacctggagcggcccaccagcttccccaggcctggccagctgatctgctgcagctctgtggaccaggtgaatgacagcgtgtacaggaaggtgctgcctgccctggtgatcccagcccactacatgaagctgcccggggaccacagctatgtgtcccagcccctggtggtgcctgctgaccagcagctggagattgagcggctgcaggccgagctgagcaacccccatgctggcatcttcccccaccccagcagccagatccagccccagcccctgagcagccaggccatcagccagcagcacctgcaggatgctggcacccgggagtggagcccccagaatgcctccatgtctgagagcctgagcatcccagccagcctgaatgatgctgccctggcccagatgaacagcgaggtgcagctgctgacagagaaggccctgatggagctgggcggcggcaagcccctgccccacccccgggcctggtttgtgtccctggatggccgcagcaatgcccacgtgcgccacagctacatcgacctgcagagagctggaagaaatggcagcaatgatgccagcctggacagcggcgtggacatgaatgagcccaagagcgccaggaagggcagaggagatgccctgagcctgcagcagaactacccacctgtgcaggagcaccagcagaaggagccccgggccccagacagcacagcctacacccagctggtgtacctggatgatgtggagcagagcggctctgaatgtggcaccaccgtgtgcaccccagaagattctgccctgcgctgcctgctggagggcagcagccgccgcagcggcggccagctgcccagcctgcaggaggagaccaccaggagaacagcagatgcccccagcgagcctgctgccagcccccaccagaggagaagtgcccacgaggaggaggaggatgatgatgatgatgaccagggcgaggacaagaagagcccctggcagaagcgggaggagcggcccctgatggccttcaacatcaagtag

SEQ ID NO: 34156 - DNA, 2670 bp, Artificial Sequence
  Description of Artificial Sequence: Synthetic coding sequence
gggggagatgagcaggtgagagatgctgctgctgtgcctgctggcctgccccggctggagggcggggacaccctgcgggagcccggggccggggcccaggaggtgaccctgaaggtgcacatcagtgatgccagcacccaccagcctgtggctgatgccctgattgagatcttcaccaaccaggccagcatcgccagcggcaccagcggcacagatggagtggccttcatcaagttccagtacaagctgggcagccagctgattgtgacagccagcaagcacgcctacgtgcccaacagcgccccctggaagcccatccggctgcctgtgttcagcagcctgagcctgggcctgctgcctgagaggtctgccaccctgatggtgtatgaagatgtggtgcagatcgtgtctggcttccagggcgcccggccccagccccgggtgcacttccagaggcgggccctgcggctgcctgagaacaccagctacagcgacctgacagccttcctgacagctgccagcagccccagcgaggtggacagcttcccctacctgcggggcctggatggaaatggaactggaaacagcaccaggcatgacctgacccctgtgacagctgtgtctgtgcacctgctgagcagcaatggcacccctgtgctggtggatggccccatctacgtgacagtgcccctggccacccagagcagcctgcggcacaatgcctacgtggccgcctggaggtttgaccagaagctgggcacctggctgaagagcggcctgggcctggtgcaccaggagggcagccagctgacctggacctacatcgccccccagctgggctactgggtggccgccatgagcccccccatccctggccctgtggtgacccaggacatcaccacctaccacacagtgttcctgctggccatcctgggcggcatggccttcatcctgctggtgctgctgtgcctgctgctgtactactgcaggaggaagtgcctgaagccccggcagcaccacaggaagctgcagctgcctgctggcctggagagcagcaagagggaccagagcacctccatgagccacatcaacctgctcttcagcagaagagccagcgagttccctggccccctgtctgtgaccagccacggccggcctgaggcccctggcaccaaggagctgatgtctggagtgcacctggagatgatgagccctggaggagagggggacctgcacacccccatgctgaagctgagctacagcaccagccaggagttcagcagccgggaggagctgctgagctgcaaggaggaggacaagagccagatcagctttgacaacctgaccccatctggcaccctgggcaaggactaccacaagtctgtggaggtgttccccctgaaggccaggaagtccatggagcgggagggctatgagagctccatgatgaccactggagtggtgaccaccccctgcagccacagcctgtacctgaagagcaggacagagaaggtgcagcccccccgggaggccaacagccccttcaggaacatctgcaccccccggctgcaccacctgaggaagaacagctgctggacagctgaccccctgaacatgatgagccgctctgtggaccacctggagcggcccaccagcttcccccggcccggccagctgatctgctgcagctctgtggaccaggtgaatgattctgtgtacaggaaggtgctgcctgccctggtgatcccagcccactacatgaagctgcccggggaccacagctatgtgtcccagcccctggtggtgcctgctgaccagcagctggagattgaaaggctgcaggccgagctgagcaacccccacgccggcatcttcccccaccccagcagccagatccagccccagcccctgagcagccaggccatcagccagcagcacctgcaggatgctggcacccgggagtggagcccccagaatgcctccatgtctgagagcctgagcatcccagccagcctgaatgatgctgccctggcccagatgaacagcgaggtgcagctgctgacagagaaggccctgatggagctgggcggcggcaagcccctgccccacccccgggcctggtttgtgtccctggatggccgcagcaatgcccacgtgcgccacagctacatcgacctgcagagagctggaagaaatggcagcaatgatgccagcctggacagcggcgtggacatgaatgagcccaagagcgccaggaagggcagaggagatgccctgagcctgcagcagaactacccacctgtgcaggagcaccagcagaaggagccccgggccccagacagcacagcctacacccagctggtgtacctggatgatgtggagcagagcggctctgaatgtggcaccaccgtgtgcaccccagaggacagcgccctgcgctgcctgctggagggcagcagcagaagaagtggcggccagctgcccagcctgcaggaggagaccaccaggagaacagcagatgcccccagcgagcctgctgccagcccccaccagaggagaagtgcccacgaggaggaggaggatgatgatgatgatgaccagggcgaggacaagaagagcccctggcagaagcgggaggagcggcccctgatggccttcaacatcaagtag

SEQ ID NO: 34157 - DNA, 597 bp, Artificial Sequence; identical to SEQ ID NO: 34154
  Description of Artificial Sequence: Synthetic coding sequence

SEQ ID NO: 34158 - DNA, 2481 bp, Artificial Sequence
  Description of Artificial Sequence: Synthetic coding sequence
atgcccccagccagcggccccagcgtgctggcccggctgctgcccctgctgggcctgctgctgggcagcgccagccgggcccctgggaagagccccccagagccccccagcccccaggagatcctgatcaaggtgcaggtgtatgtgtctggagagctggtgcccctggcccgggcctctgtggatgtgtttggaaacagaaccctgctggccgccggcaccacagattctgaaggagtggccaccctgcccctgagctaccgcctgggcacctgggtgctggtgacagctgcccggcccggcttcctgaccaacagcgtgccctggagggtggacaagctgcccctgtatgcctctgtgtccctgtacctgctgcctgagaggcctgccaccctcatcctgtatgaggacctggtgcacatcctgctgggcagccctggggcccggagccagcccctggtgcagttccagaggcgggccgcccggctgcctgtgagcagcacctacagccagctgtgggccagcctgaccccagccagcacccagcaggagatgagggccttccctgccttcctgggcacagaggccagcagcagtggaaatggctcctggctggagctgatgcccctgacagctgtgtctgtgcacctgctgactggaaatggaacagaggtgcccctgagcggccccatccacctgagcctgcctgtgcccagcgagacccgggccctgactgtgggcaccagcatcccagcctggaggtttgaccccaagagcggcctgtgggtgagaaatggaactggagtcatcaggaaggagggccggcagctgtactggacctttgtgagcccccagctgggctactgggtggccgccatggccagccccacagctggcctggtgaccatcaccagcggcatccaggacatcggcacctaccacaccatcttcctgctgaccatcctggccgccctggccctgctggtgctgatcctgctgtgcctgctgatctactactgcagaagacgctgcctgaagccccggcagcagcacaggaagctgcagctgagcggccccagtgatggcaacaagagggaccaggccacctccatgagccagctgcacctgatctgtggcggccccctggagcccgcccccagcggggaccctgaggcccctcctcctggccccctgcacagcgccttcagcagcagccgggacctggccagcagcagagatgacttcttccgcaccaagcccaggtctgccagcaggcctgctgctgagcccagcggggcccggggcggggagagcgctggcctgaagggggcccggtctgctgagggccctgggggcctggagcccggcctggaggagcacagaagaggccccagcggggccgccgccttcctgcacgagccccccagccccccacctccatttgaccactacctgggccacaagggagctgctgagggcaagaccccagacttcctgctgagccagagcgtggaccagctggcccggccccccagcctgggccaggccggccagctgatcttctgtggcagcattgaccacctgaaggacaacgtgtacagaaatgtgatgcccaccctggtgatcccagcccactacgtgcggctgggcggggaggccggggccgccggcgtgggagatgagcccgcccctcctgagggcacagcccctggccctgcccgggccttcccccagcctgacccccagaggccccagatgcctggccacagcggccctggaggagagggcggcggcggcggcggggagggctggggcgccggccgggccgcccctgtgtctggctctgtgaccatccctgtgctcttcaatgaaagcaccatggcccagctgaatggagagctgcaggccctgacagagaagaagctgctggagctgggcgtgaagccccacccccgggcctggtttgtgtccctggatggccgcagcaacagccaggtgcgccacagctacatcgacctgcaggccggcggcggggcccggagcacagatgccagcctggacagcggcgtggatgtgcatgaggcccggcctgcccggcggcggcctgcccgggaggagcgggagcgggcccctcctgctgcccctcctcctcctccagccccaccccggctggccctgtctgaggacacagagcccagcagcagcgagagcaggacaggcctgtgcagccctgaggacaacagcctgacccccctgctggatgaggtggccgcccctgagggccgggccgccaccgtgccccggggccggggccgcagcagaggagacagcagccgcagcagcgccagcgagctgcggcgggacagcctgaccagcccagaagatgagctgggcgctgaggtgggagatgaagctggggacaagaagagcccctggcagaggcgggaggagcggcccctgatggtgttcaacgtgaagtag

SEQ ID NO: 34159 - DNA, 1284 bp, Artificial Sequence
  Description of Artificial Sequence: Synthetic coding sequence
atggcccggctgtgccggcgggtgccctgcaccctgctgctgggcctggccgtggtgctgctgaaggcccggctggtgcctgctgctgcccgggcagagctgagcagaagtgacctgagcctcatccagcagcagcagcagcagcagcagcagcagcagcagcagcagaagcagctggaggaggccgaggaggagaggacagaggtgcctggggccaccagcaccctgactgtgcctgtgtctgtgttcatgctgaaggtgcaggtgaatgacatcatcagccggcagtacctgagccaggccgtggtggaggtgtttgtgaactacaccaagaccaacagcacagtgaccaagagcaatggagctgtgctgatcaaggtgccctacaagctgggcctgagcctgaccatcatcgcctacaaggatggctacgtgctgacccccctgccctggaagaccaggaggatgcccatctacagctctgtgaccctgagcctcttcccccagagccaggccaacatctggctgtttgaggacacagtgctgatcaccgggaagctggctgatgccaagagccagcccagcgtgcagttcagcaaggccctgatcaagctgcctgacaaccaccacatcagcaatgtgacaggctacctgactgtgctgcagcagttcctgaaggtggacaacttcctgcacaccaccggcatcaccctgaacaagccaggctttgagaacatcgagctgacccccctggccgccatctgtgtgaagatctacagcggcggcaaggagctgaaggtgaatggcagcatccaggtgtccctgcccctgctgcggctgaatgacatctctgctggggaccgcatcccagcctggacctttgacatgaacacaggagcctgggtgaaccacggccggggcatggtgaaggagcacaacaaccacctgatctggacctatgatgccccccacctgggctactggattgctgcccccctgcccggcacccggggcagcggcatcaatgaagacagcaaggacatcacagcctaccacacagtgttcctgacagccatcctgggcggcaccatcgtcatcgtcatcggcttctttgctgtgctgctgtgctactgccgggacaagtgtggcaccccccagaagcgggagaggaacatcaccaagctggaggtgctgaagagggaccagaccaccagcaccacccacatcaaccacatccggaacagaaggaagagcttccacggcaagaacagcggccgcttctag

SEQ ID NO: 34160 - DNA, 2481 bp, Artificial Sequence
  Description of Artificial Sequence: Synthetic coding sequence
atggcccggctgtgccggcgggtgccctgcaccctgctgctgggcctggccgtggtgctgctgaaggcccggctggtgcctgctgctgcccgggcagagctgagcagaagtgacctgagcctcatccagcagcagcagcagcagcagcagcagcagcagcagcagcagaagcagctggaggaggccgaggaggagaggacagaggtgcctggggccaccagcaccctgactgtgcctgtgtctgtgttcatgctgaaggtgcaggtgaatgacatcatcagccggcagtacctgagccaggccgtggtggaggtgtttgtgaactacaccaagaccaacagcacagtgaccaagagcaatggagctgtgctgatcaaggtgccctacaagctgggcctgagcctgaccatcatcgcctacaaggatggctacgtgctgacccccctgccctggaagaccaggaggatgcccatctacagctctgtgaccctgagcctcttcccccagagccaggccaacatctggctgtttgaggacacagtgctgatcaccgggaagctggctgatgccaagagccagcccagcgtgcagttcagcaaggccctgatcaagctgcctgacaaccaccacatcagcaatgtgacaggctacctgactgtgctgcagcagttcctgaaggtggacaacttcctgcacaccaccggcatcaccctgaacaagccaggctttgagaacatcgagctgacccccctggccgccatctgtgtgaagatctacagcggcggcaaggagctgaaggtgaatggcagcatccaggtgtccctgcccctgctgcggctgaatgacatctctgctggggaccgcatcccagcctggacctttgacatgaacacaggagcctgggtgaaccacggccggggcatggtgaaggagcacaacaaccacctgatctggacctatgatgccccccacctgggctactggattgctgcccccctgcccggcacccggggcagcggcatcaatgaagacagcaaggacatcacagcctaccacacagtgttcctgacagccatcctgggcggcaccatcgtcatcgtcatcggcttctttgctgtgctgctgtgctactgccgggacaagtgtggcaccccccagaagcgggagaggaacatcaccaagctggaggtgctgaagagggaccagaccaccagcaccacccacatcaaccacatcagcacagtgaaggtggccctgaaggccgaggacaagagccagctgttcaatgccaagaacagcagctacagcccccagaagaaggagcccagcaaggccgagacagaggagcgggtgtccatggtgaagaccagagatgacttcaagatctacaatgaagatgtgtccttcctgtctgtgaaccagaacaactacagcaggaaccccacccagagcctggagcccaacgtgggcagcaagcagcccaagcacatcaacaacaacctgagcagcagcctgggagatgcccaggatgagaagcgctacctgactggaaatgaggaggcctacggccgcagccacatccctgagcagctgatgcacatctacagccagcccatcgccatcctgcagaccagtgacctcttcagcaccccagagcagctgcacacagccaagagcgccaccctgcccaggaagggccagctggtgtatggccagctgatggagcctgtgaaccgggagaacttcacccagaccctgcccaagatgcccatccacagccacgcccagcccccagatgcccgggaggaggacatcatcctggagggccagcagagcctgcccagccaggccagtgactggagccgctacagcagcagcctgctggagagcgtgtctgtgcccggcaccctgaatgaggccgtggtgatgacccccttcagcagcgagctgcagggcatcagcgagcagaccctgctggagctgagcaagggcaagcccagcccccacccccgggcctggtttgtgtccctggatggcaagcctgtggcccaggtgcgccacagcttcatcgacctgaagaagggcaagaggacccagagcaatgacaccagcctggacagcggcgtggacatgaatgagctgcacagcagcaggaagctggagcgggagaagaccttcatcaagtccatgcaccagcccaagatcctgtacctggaggacctggacctgagcagcagcgagagcggcaccaccgtgtgcagccctgaggaccctgccctgcggcacatcctggatggcggcagcggggtcatcatggagcaccctggagaggagagccctggcaggaagagcacagtggaggactttgaggccaacaccagccccaccaagaggcggggccggccccccctggccaagagggacagcaagaccaacatctggaagaagcgggaggagcggcccctcatccccatcaactag

SEQ ID NO: 34161 - DNA, 708 bp, Artificial Sequence
  Description of Artificial Sequence: Synthetic coding sequence
atggagcaggatgatcctgtggaggccctgacagagctgcgggagcggcggctgggcgccctggagctgctgcaggccgccgccggcagcggcctggccgcctatgctgtgtgggccctgctgctgcagcccggcttcagaagagtgcccctgcggctgcaggtgccctacgtgggcgccagcgcccggcaggtggagcacgtgctgagcctgctgcggggccggcctgggaagacagtggacctgggcagcggagatggaagaattgtgctggccgcccaccgctgtggcctgcggcctgctgtgggctatgagctgaacccctggctggtggccctggcccggctgcacgcctggagggctggctgtgccggctctgtgtgctacagaaggaaggacctgtggaaggtgtccctgcgggactgcagaaatgtgtctgtgttcctggcccccagcgtgctgcccctgctggaggacaagctgaggacagagctgcctgctggggcccgggtggtgtctggccgcttccccctgcccacctggcagcctgtgacagctgtgggggagggcctggacagagtgtgggcctatgatgtgcctgagggcggccaggccggggaggccgccagcagccgcatccccatccaggccgcccctggccccagcagcgcccccatccctgggggcctcatcagccaggccagctag

SEQ ID NO: 34162 - DNA, 879 bp, Artificial Sequence
  Description of Artificial Sequence: Synthetic coding sequence
atggcccagcccccaccagatgtggagggagatgactgcctgcctgcctaccgccacctgttctgcccagacctgctgcgggacaaggtggccttcatcaccggcggcggcagcggcatcggcttcagaattgctgagatcttcatgagacatggctgccacacagtgattgccagccgcagcctgccccgggtgctgacagctgccaggaagctggccggggccaccggccgccgctgcctgcccctgtccatggatgtgcgggcccccccagctgtgatggctgctgtggaccaggccctgaaggagtttggaagaattgacatcctgatcaactgtgccgccggcaacttcctgtgcccagctggggccctgtccttcaatgccttcaagacagtgatggacatcgacaccagcggcaccttcaacgtgtcccgggtgctgtatgagaagttcttccgggaccacggcggcgtcatcgtgaacatcacagccaccctgggcaacagaggccaggccctgcaggtgcacgccggcagcgccaaggctgctgtggatgccatgaccaggcacctggccgtggagtggggcccccagaacatccgggtgaacagcctggcccctggccccatcagcggcacagagggcctgcggcggctgggcggcccccaggccagcctgagcaccaaggtgacagccagccccctgcagaggctgggcaacaagacagaaattgcccacagcgtgctgtacctggccagccccctggccagctatgtgactggagctgtgctggtggctgatggaggagcctggctgaccttccccaatggagtgaagggcctgcctgactttgccagcttcagcgccaagctgtag

SEQ ID NO: 34163 - DNA, 702 bp, Artificial Sequence
  Description of Artificial Sequence: Synthetic coding sequence
atggagggcggcggcggcatccccctggagaccctgaaggaggagagccagagccgccacgtgctgcctgccagctttgaggtgaacagcctgcagaagagcaactggggcttcctgctgaccggcctggtgggcggcaccctggtggccgtgtatgctgtggccaccccatttgtgaccccagccctgaggaaggtgtgcctgccctttgtgcctgccaccaccaagcagattgaaaatgtggtgaagatgctgcgctgccggcggggcagcctggtggacatcggcagcggagatggccgcatcgtgattgctgctgccaagaagggcttcaccgctgtgggctatgagctgaacccctggctggtgtggtacagccgctaccgggcctggagggagggcgtgcacggcagcgccaagttctacatcagtgacctgtggaaggtgaccttcagccagtacagcaatgtggtgatcttcggcgtgccccagatgatgctgcagctggagaagaagctggagcgggagctggaggatgatgcccgggtcatcgcctgccgcttccccttcccccactggaccccagaccacgtgactggagagggcatcgacacagtgtgggcctatgatgccagcaccttccggggccgggagaagaggccctgcacctccatgcacttccagctgcccatccaggcctag

SEQ ID NO: 34164 - DNA, 573 bp, Artificial Sequence
  Description of Artificial Sequence: Synthetic coding sequence
atgaaggccagccagtgctgctgctgcctgagccacctgctggcctctgtgctgctgctgctgctgctgcctgagctgagcggccccctggccgtgctgctgcaggccgctgaggccgcccctggcctgggccccccagacccccggcccaggaccctgccccccctgcccccaggccccaccccagcccagcagcccggccggggcctggccgaggccgccggcccccggggcagcgagggcggcaatggcagcaaccctgtggccggcctggagacagatgaccacggcggcaaggccggggagggctctgtgggcggcggcctggccgtgagccccaaccctggggacaagcccatgacccagagggccctgactgtgctgatggtggtgtctggagctgtgctggtgtactttgtggtgaggacagtgaggatgagaagaagaaacaggaagacccggcgctatggagtgctggacaccaacatcgagaacatggagctgacccccctggagcaggatgatgaagatgatgacaacaccctgtttgatgccaaccaccccaggaggtag

SEQ ID NO: 34165 - DNA, 480 bp, Artificial Sequence
  Description of Artificial Sequence: Synthetic coding sequence
atgagagctgtgcccctgcctgcccccctgctgcccctgctgctgctggccctgctggccgccccagctgcccgggccagcagagctgagagcgtgtctgccccctggccagagcctgagcgggagagcaggcctcctcctggccctggccctggcaacaccaccaggtttggaagtggagctgctgggggcagcggcagcagcagcagcaacagcagtggagatgccctggtgacccgcatcagcatcctgctgcgggacctgcccaccctgaaggccgccgtcatcgtggcctttgccttcaccaccctgctgattgcctgcctgctgctgcgggtcttccgcagcggcaagaggctgaagaagaccaggaaatatgacatcatcaccaccccagctgagcgggtggagatggcccccctgaatgaggaggatgatgaagatgaggacagcacagtgtttgacatcaagtacagatag

SEQ ID NO: 34166 - DNA, 1293 bp, Artificial Sequence
  Description of Artificial Sequence: Synthetic coding sequence
atggccgcccggctgctgcggggcagcctgcgggtgctgggcggccaccgggccccccggcagctgcctgctgcccgctgcagccacagcggcggggaggagcggctggagacccccagcgccaagaagctgacagacatcggcatccgccgcatcttcagccctgagcatgacatcttcaggaagtctgtgaggaagttcttccaggaggaggtgatcccccaccacagcgagtgggagaaggccggggaggtgtcccgggaggtgtgggagaaggccggcaagcagggcctgctgggcgtgaacattgctgagcacctgggcggcatcggcggggacctgtacagcgctgccatcgtgtgggaggagcaggcctacagcaactgcagcggccctggcttcagcatccacagcggcatcgtgatgagctacatcaccaaccacggcagcgaggagcagatcaagcacttcatcccccagatgacagctggaaaatgtattggagccatcgccatgacagagcctggagctggcagtgacctgcagggcatcaagaccaatgccaagaaggatggcagtgactggatcctgaatggcagcaaggtgttcatcagcaatggcagcctgagtgatgtggtgattgtggtggccgtgaccaaccacgaggcccccagccctgcccacggcatcagcctcttcctggtggagaatggcatgaagggcttcatcaagggcaggaagctgcacaagatgggcctgaaggcccaggacacagctgagctgttctttgaggacatccggctgcctgccagcgccctgctgggggaggagaacaagggcttctactacatcatgaaggagctgccccaggagcggctgctgattgctgatgtggccatcagcgccagcgagttcatgtttgaggagaccagaaattatgtgaagcagaggaaggccttcggcaagacagtggcccacctgcagacagtgcagcacaagctggccgagctgaagacccacatctgtgtgacccgggcctttgtggacaactgcctgcagctgcacgaggccaagaggctggacagcgccacagcctgcatggccaagtactgggccagcgagctgcagaacagcgtggcctatgactgtgtgcagctgcatggaggctggggctacatgtgggagtaccccatcgccaaggcctacgtggatgcccgggtgcagcccatctatggaggcaccaatgagatcatgaaggagctgattgcccgggagatcgtgtttgacaagtag

SEQ ID NO: 34167 - DNA, 459 bp, Artificial Sequence
  Description of Artificial Sequence: Synthetic coding sequence
atgaggctgcccctgagccacagccctgagcacgtggagatggccctgctgagcaacatcctggccgcctacagctttgtgtctgaaaatcctgagcgggccgccctgtactttgtgtctggagtgtgcatcggcctggtgctgaccctggccgccctggtgatccgcatcagctgccacacagactgcagaagaagacctgggaagaagttcctgcaggaccgggagagcagcagtgacagcagtgacagtgaagatggctctgaagatactgtgtctgacctgtctgtgcggcggcacagaagatttgagaggaccctgaacaagaatgtgttcaccagcgctgaggagctggagcgggcccagaggctggaggagcgggagcgcatcatccgggagatctggatgaatggccagcctgaggtgcccggcaccaggagcctgaaccgctactactag

SEQ ID NO: 34168 - DNA, 459 bp, Artificial Sequence; identical to SEQ ID NO: 34167
  Description of Artificial Sequence: Synthetic coding sequence

SEQ ID NO: 34169 - DNA, 459 bp, Artificial Sequence; identical to SEQ ID NO: 34167
  Description of Artificial Sequence: Synthetic coding sequence

SEQ ID NO: 34170 - DNA, 432 bp, Artificial Sequence
  Description of Artificial Sequence: Synthetic coding sequence
atgaggctgcccctgagccacagccctgagcacgtggagatggccctgctgagcaacatcctggccgcctacagctttgtgtctgaaaatcctgagcgggccgccctgtactttgtgtctggagtgtgcatcggcctggtgctgaccctggccgccctggtgatccgcatcagctgccacacagactgcagaagaagacctgggaagaagttcctgcaggaccgggagagcagcagtgacagcagtgacagtgaagatggctctgaagatactgtgtctgacctgtctgtgcggcggcacagaagatttgagaggaccctgaacaagaatgtgttcaccagcgctgaggagctggagcgggcccagaggctggaggagcgggagcgcatcatccgggagatctggatgaatggccagcctgaggtgccctag

SEQ ID NO: 34171 - DNA, 306 bp, Artificial Sequence
  Description of Artificial Sequence: Synthetic coding sequence
atgaggctgcccctgagccacagccctgagcacgtggagatggccctgctgagcaacatcctggccgcctacagctttgtgtctgaaaatcctgagcgggccgccctgtactttgtgtctggagtgtgcatcggcctggtgctgaccctggccgccctggtgatccgcatcagctgccacacagactgcagaagaagacctgggaagaagttcctgcaggaccgggagagcagcagtgacagcagtgacagtgaagatggctctgaagatactgtgtctgacctgtctgtgcggcggcacaggtag

SEQ ID NO: 34172 - DNA, 612 bp, Artificial Sequence
  Description of Artificial Sequence: Synthetic coding sequence
atgctgcagcaggacagcaatgatgacacagaagatgtgtccctgtttgatgctgaggaggagaccaccaaccggcccaggaaggccaagatccgccaccctgtggccagcttcttccacctgttcttccgggtgtctgccatcatcgtgtgcctgctgtgtgagctgctgagcagcagcttcatcacctgcatggtgaccatcatcctgctgctgagctgtgacttctgggccgtgaagaatgtgacaggccgcctgatggtgggcctgcgctggtggaaccacattgatgaagatggcaagagccactgggtgtttgagagcaggaaggagagcagccaggagaacaagacagtgtctgaggccgagagccgcatcttctggctgggcctcatcgcctgcagcgtgctgtgggtgatctttgccttcagcgccctcttctccttcaccgtgaagtggctggccgtggtgatcatgggcgtggtgctgcagggcgccaacctgtatggctacatccgctgcaaggtgcgcagcaggaagcacctgacctccatggccaccagctactttgggaagcagttcctgcggcaggtgtctgtgttctggatgtag

SEQ ID NO: 34173 - DNA, 642 bp, Artificial Sequence
  Description of Artificial Sequence: Synthetic coding sequence
atgaagcaggccctggtggatgacacagaagatgtgtccctggactttggaaatgaggaggagctggccttcaggaaggccaagatccgccaccccctggccaccttcttccacctgttcttccgggtgtctgccatcgtgacctacgtgtcctgtgactggttcagcaagagctttgtgggctgctttgtgatggtgctgctgctgctgagcctggacttctggagcgtgaagaatgtgacaggccgcctgctggtgggcctgcgctggtggaaccagattgatgaagatggcaagagccactggatctttgaggccaggaaggtgagccccaacagcattgctgccacagaagctgaggcccgcatcttctggctgggcctcatcatctgccccatgatctggatcgtgttcttcttcagcaccctcttcagcctgaagctgaagtggctggccctggtggtggccggcatcagcctgcaggccgccaacctgtatggctacatcctgtgcaagatgggcggcaacagcgacatcggcaaggtgacagccagcttcctgagccagaccgtcttccagacagcctgccctggggacttccagaagccaggcctggagggcctggagatccaccagcactag

SEQ ID NO: 34174 - DNA, 567 bp, Artificial Sequence
  Description of Artificial Sequence: Synthetic coding sequence
atgaagcaggccctggtggatgacacagaagatgtgtccctggactttggaaatgaggaggagctggccttcaggaaggccaagatccgggacagagtgtccaagctgctggccagcgtcatcctgctgccctggccacccaaggtgctgggcctgaagaatgtgacaggccgcctgctggtgggcctgcgctggtggaaccagattgatgaagatggcaagagccactggatctttgaggccaggaaggtgagccccaacagcattgctgccacagaggccgaggcccgcatcttctggctgggcctcatcatctgccccatgatctggatcgtgttcttcttcagcaccctcttcagcctgaagctgaagtggctggccctggtggtggccggcatcagcctgcaggccgccaacctgtatggctacatcctgtgcaagatgggcggcaacagcgacatcggcaaggtgacagccagcttcctgagccagacagtgttccagacagcctgccctggggacttccagaagccaggcctggagggcctggagatccaccagcactag

SEQ ID NO: 34175 - DNA, 618 bp, Artificial Sequence
  Description of Artificial Sequence: Synthetic coding sequence
atgctgcagcaggacagcaatgatgacacagaagatgtgtccctgtttgatgctgaggaggagaccaccaaccggcccaggaaggccaagatccgccaccctgtggccagcttcttccacctgttcttccgggtgtctgccatcatcgtgtacctgctgtgtggcctgctgagcagcagcttcatcacctgcatggtgaccatcatcctgctgctgagctgtgacttctgggccgtgaagaatgtgacaggccgcctgatggtgggcctgcgctggtggaaccacattgatgaagatggcaagagccactgggtgtttgagagcaggaaggagagcagccaggagaacaagacagtgtctgaggccgagagccgcatcttctggctgggcctcatcgcctgccctgtgctgtgggtgatctttgccttcagcgccctcttctccttccgggtgaagtggctggccgtggtgatcatgggcgtggtgctgcagggcgccaacctgtatggctacatccgctgcaaggtgcgcagcaggaagcacctgacctccatggccaccagctactttgggaagcagttcctgcggcagaacacaggagatgaccagaccagctag

SEQ ID NO: 34176 - DNA, 786 bp, Artificial Sequence
  Description of Artificial Sequence: Synthetic coding sequence
atgacctgctggctgcggggcgtgacagccaccttcggccggcctgctgagtggccaggctacctgagccacctgtgtggccgctctgctgccatggacctgggccccatgaggaagagctacagaggagaccgggaggcctttgaggagacccacctgaccagcctggaccctgtgaagcagtttgctgcctggtttgaggaggccgtgcagtgcccagacattggagaggccaatgccatgtgcctggccacctgcaccagagatggcaagcccagcgccaggatgctgctgctgaagggctttgggaaggatggcttccgcttcttcaccaactttgagagcaggaagggcaaggagctggacagcaacccctttgccagcctggtgttctactgggagcccctgaaccggcaggtgcgggtggagggccctgtgaagaagctgcctgaggaggaggccgagtgctacttccacagccggcccaagagcagccagattggagctgtggtgagccaccagagcagcgtcatcccagaccgggagtacctgaggaagaagaatgaggagctggagcagctgtaccaggaccaggaggtgcccaagcccaagtcctggggcggctacgtgctgtacccccaggtgatggagttctggcagggccagaccaaccggctgcatgaccgcatcgtgttcagaagaggcctgcccaccggggacagccccctgggccccatgacccacagaggagaggaggactggctgtatgaaaggctggccccctag

SEQ ID NO: 34177 - DNA, 612 bp, Artificial Sequence; identical to SEQ ID NO: 34172
  Description of Artificial Sequence: Synthetic coding sequence

SEQ ID NO: 34178 - DNA, 558 bp, Artificial Sequence; identical to SEQ ID NO: 34090
  Description of Artificial Sequence: Synthetic coding sequence

SEQ ID NO: 34179 - DNA, 1110 bp, Artificial Sequence
  Description of Artificial Sequence: Synthetic coding sequence
atgccacccatgctgtggctgctgctgcactttgctgccccagccctgggcttctacttcagcatcagctgccccagcggcaagcagtgccagcaggccctgctgtctggaaatgacatcctgctgtactgcaacagcagcggggcccactggtactacctgttcacccagggcaagaagggccgcctgaccagcctgaccaacatcagcaacatggagatcatgcctgagggcagcctgctgatcaaggaccccctgcccagccagacaggcctgtaccactgctggaacaagaatggccggcaggtggtgcagtatgaaattgacttccaggatgtgaccaccctgcacatcacccacaaggacctgggccagaggcccctgcagaatgagaccctgcacctgggcagcaagcagctgatcttcacctggtgggagccctggcaggactgcaacagatgtgaggagcctggagagtgcaagaggctgggctaccgctacatcgaggagcccctggaggaggccatgccctgctggctgtacctgggggaggtgctggtgtggagcagccggctgcggcctgagctgcaggtggaggcctgccacgtgcagtgcaccaacaacacccagctgcgggtggactatgtgatctttgacaacttccggctggatgagaagacagaatttgtgtggctggactgccccctgggctccatgtacagacctgtgaactggagggccaatgacacccccctgacctgggagagccagctgagcggccaggacttcaccaccttcctggaccccagcactggaggccggcagctgcaggtgttccagcctgctgtgtacaagtgctttgtgcagcaggagctggtggcccagttcaagccagctgccagcctggagaccctggaggcccagtggagagaaaatgatgcccagtggagggaggccaggaaggccctgcggggccgggctgacagcgtgctgaagggcctgaagctggtgctgctggtggtgacagtgctggccctgctgggcgccctgctgaagtgcatccaccccagccctggccgccgcagcacccaggtgctggtggtgaagtag

SEQ ID NO: 34180 - DNA, 1620 bp, Artificial Sequence
  Description of Artificial Sequence: Synthetic coding sequence
atgcccccagctgggggcccccgggcccccaggcctgctgccctgcccaggagcctgagccggctgcgggagtgccccggccgcagcagaattgtgctggccctgggcgccacccagatggccctgggctgcctgattgtggccgtgtcctttgctgccctggccctgaccaccagcgcccgggtgcgccacagctgccccttctgggccggcttctctgtgctgctgagcggcctcatcggcgtggtgtcctggaagaggcccctgagcctggtgatcaccttcttcatgctgctgtctgctgtgtgtgtgatgctgaacctggccggcagcatcctgagctgccagaatgcccagctggtgaacagcctggagggctgccagctgatcaagtttgacagcgtggaggtgtgtgtgtgctgtgagctgcagcaccagagcagcggctgcagcaacctgggggagaccctgaagctgaaccccctgcaggagaactgcaatgctgtgcggctgaccctgaaggacctgctcttctctgtgtgtgccctgaatgtgctgagcaccatcgtgtgtgccctggccacagccatgtgctgcatgcagatggtgtccagtgatgtgctgcagatgttcctgccccagaggagccacccagccaaccccacctgtgtgacccctcatggaacagtgctgcaccagaccctggactttgatgagttcatcccccccctgcccccaccaccctactacccacctgagtacacctgcacccccagcacagaggcccagaggggcctgcacctggactttgcccccagccccttcggcaccctgtatgatgtggccatcaacagccctggcctgctgtacccagctgagctgcccccaccctatgaggccgtggtgggccagcccccagccagccaggtgaccagcatcggccagcaggtggccgagagcagcagcggggaccccaacaccagcgctggcttcagcacccctgtgcctgctgacagcaccagcctgctggtgtctgagggcacagccaccccaggcagcagccccagcccagatggccctgtgggcgccccagcccccagcgagcccgccctgcccccaggccacgtgtccccagaagatcctggcatgggcagccaggtgcagcccggccctggccgggtgagccgcagcaccagtgaccccaccctgtgcaccagctccatggctggagatgccagcagccaccggcccagctgcagccaggacctggaggccggcctgtctgaggccgtgcccggcagcgcctccatgagccgcagcgccacagctgcctgccgggcccagctgagccctgctggggaccctgacacctggaagacagaccagaggcccaccccagagcccttccctgccaccagcaaggagcggcccaggagcctggtggacagcaaggcctatgcagatgcccgggtgctggtggccaagttcctggagcacagccactgtgccctgcccacagaggcccagcacatggtgggcgccatgaggctggccgtgaccaatgaggagcggctggaggaggaggccgtgtttggagcagatgtgctggaccaggtgtag

SEQ ID NO: 34181 - DNA, 1353 bp, Artificial Sequence
  Description of Artificial Sequence: Synthetic coding sequence
atgatcctgctggtgaacctgtttgtgctgctgtctgtggtgtgtgtgctgctgaacctggccggcttcatcctgggctgccagggcgcccagtttgtgtcctctgtgccccgctgtgacctggtggacctgggggagggcaagatctgcttctgctgtgaggagttccagcctgccaagtgcacagacaaggaaaatgccctgaagctgtttcctgtgcagccctgcagcgctgtgcacctgctgctgaagaaggtgctgtttgccctgtgtgccctgaatgccctgaccaccaccgtgtgcctggtggccgccgccctgcgctacctgcagatctttgccacccggcgcagctgcattgatgagagccagatctctgctgaggaggctgaagatcatggccgcatcccagaccctgatgactttgtgccccctgtgcccccacccagctactttgccaccttctacagctgcacccccaggatgaacagaaggatggtgggcccagatgtgatccccctgccccacatctacggggcccgcatcaagggcgtggaggtgttctgccccctggaccccccaccaccctatgaagctgtggtgtcccagatggaccaggagcagggcagcagcttccagatgtctgagggcagcgaggccgctgtgatccccctggacctgggctgcacccaggtgacccaggatggagacatccccaacatcccagcagaagaaaatgccagcaccagcacccccagcagcaccctggtgcggcccatccgcagcagaagagccctgccccccctgcggaccaggagcaagagtgaccctgtgctgcaccccagcgaggagcgggccgcccctgtgctgagctgtgaggccgccacccagacagagcggcggctggacctggccgctgtgaccctgcggcggggcctgcggagccgggccagccgctgccggcccaggagcctgattgactacaagagctacatggacaccaagctgctggtggcccgcttcctggagcagagcagctgcaccatgaccccagacatccacgagctggtggagaacatcaagtctgtgctgaagagtgatgaggagcacatggaggaggccatcaccagcgccagcttcctggagcagatcatggcccccctgcagcccagcaccagccgggcccacaagctgcccagccggcggcagcccggcctgctgcacctgcagagctgtggggacctgcacaccttcaccccagctggccggcccagggctgagcggcggcccaggagagtggaggccgagcggccccacagcctcatcggggtcatccgggagaccgtgctgtag

SEQ ID NO: 34182 - DNA, 858 bp, Artificial Sequence
  Description of Artificial Sequence: Synthetic coding sequence
atggtgggcccagatgtgatccccctgccccacatctatggagcccgcatcaagggcgtggaggtgttctgccccctggaccccccaccaccctatgaggccgtggtgtcccagatggaccaggagcagggcagcagcttccagatgtctgagggcagcgaggccgccgtcatccccctggacctgggctgcacccaggtgacccaggatggagacatccccaacatcccagctgaggagaatgccagcaccagcacccccagcagcaccctggtgcggcccatccgcagccggcgggccctgccccccctgcggaccaggagcaagagtgaccctgtgctgcaccccagcgaggagagagctgcccctgtgctgagctgtgaggccgccacccagacagaaagaaggctggacctggccgctgtgaccctgcggcggggcctgcggagccgggccagccgctgccggcccaggagcctgattgactacaagagctacatggacaccaagctgctggtggcccgcttcctggagcagagcagctgcaccatgaccccagacatccacgagctggtggagaacatcaagtctgtgctgaagagtgatgaggagcacatggaggaggccatcaccagcgccagcttcctggagcagatcatggcccccctgcagcccagcaccagccgggcccacaagctgcccagccggcggcagcccggcctgctgcacctgcagagctgtggggacctgcacaccttcaccccagctggccggcccagggctgagcggcggccccggcgggtggaggccgagcggccccacagcctgattggagtcatccgggagaccgtgctgtag

SEQ ID NO: 34183 - DNA, 714 bp, Artificial Sequence
  Description of Artificial Sequence: Synthetic coding sequence
atgacctgcttcggcccctaccccatcggcaccggcctgcagggcatcaccctgtgctgcttccccagcttctgcaagatgaagagcaggatgtgcatggccatcagcatctgccagatgctgtccatgctgagctttgtggtgtgtgccttccgctaccgccacatgttcaagaggggctggcccatgggcacctgctgcctcttcctgcccacagctgcccctgtgctgagctgtgaggccgccacccagacagaaagaaggctggacctggccgctgtgaccctgcggcggggcctgcggagccgggccagccgctgccggcccaggagcctgattgactacaagagctacatggacaccaagctgctggtggcccgcttcctggagcagagcagctgcaccatgaccccagacatccacgagctggtggagaacatcaagtctgtgctgaagagtgatgaggagcacatggaggaggccatcaccagcgccagcttcctggagcagatcatggcccccctgcagcccagcaccagccgggcccacaagctgcccagccggcggcagcccggcctgctgcacctgcagagctgtggggacctgcacaccttcaccccagctggccggcccagggctgagcggcggccccggcgggtggaggccgagcggccccacagcctgattggagtcatccgggagaccgtgctgtag

SEQ ID NO: 34184 - DNA, 1350 bp, Artificial Sequence
  Description of Artificial Sequence: Synthetic coding sequence
gtgctgctggtgaacctgtttgtgctgctgtctgtggtgtgtgtgctgctgaacctggccggcttcatcctgggctgccagggcgcccagtttgtgtcctctgtgccccgctgtgacctggtggacctgggggagggcaagatctgcttctgctgtgaggagttccagcctgccaagtgcacagacaaggaaaatgccctgaagctgtttcctgtgcagccctgcagcgctgtgcacctgctgctgaagaaggtgctgtttgccctgtgtgccctgaatgccctgaccaccaccgtgtgcctggtggccgccgccctgcgctacctgcagatctttgccaccaggaggagctgcattgatgagagccagatctctgctgaggaggccgaggaccacggccgcatcccagaccctgatgactttgtgccccctgtgcccccacccagctactttgccaccttctacagctgcacccccaggatgaacagaaggatggtgggcccagatgtgatccccctgccccacatctatggagcccgcatcaagggcgtggaggtgttctgccccctggaccccccaccaccctatgaggccgtggtgtcccagatggaccaggagcagggcagcagcttccagatgtctgagggcagcgaggccgccgtcatccccctggacctgggctgcacccaggtgacccaggatggagacatccccaacatcccagctgaggagaatgccagcaccagcacccccagcagcaccctggtgcggcccatccgcagccggcgggccctgccccccctgcggaccaggagcaagagtgaccctgtgctgcaccccagcgaggagagagctgcccctgtgctgagctgtgaggccgccacccagacagaaagaaggctggacctggccgctgtgaccctgcggcggggcctgcggagccgggccagccgctgccggcccaggagcctgattgactacaagagctacatggacaccaagctgctggtggcccgcttcctggagcagagcagctgcaccatgaccccagacatccacgagctggtggagaacatcaagtctgtgctgaagagtgatgaggagcacatggaggaggccatcaccagcgccagcttcctggagcagatcatggcccccctgcagcccagcaccagccgggcccacaagctgcccagccggcggcagcccggcctgctgcacctgcagagctgtggggacctgcacaccttcaccccagctggccggcccagggctgagcggcggccccggcgggtggaggccgagcggccccacagcctgattggagtcatccgggagaccgtgctgtag

SEQ ID NO: 34185 - DNA, 1353 bp, Artificial Sequence; identical to SEQ ID NO: 34181
  Description of Artificial Sequence: Synthetic coding sequence

SEQ ID NO: 34186 - DNA, 1074 bp, Artificial Sequence
  Description of Artificial Sequence: Synthetic coding sequence
atgggcctgcggggggacagccaggccaccctgtttgacccccagctgcatgatggcagctgcatctgtgagcgggtggccagcatcgtggatgtgtccatggacagcggcagcctggtgctgagcgccatcggggacctgcccggcggcagcagccccagcgaggacagctgcctgctggagctgcagggctctgtgcgctctgtggactatgtgctcttccgcagcatccagaggagccgggccggctactgcctgagcctggactgtggcctgcggggcccctttgaggagagccccctgcccaggaggcctccccgggccgcccggagctacagctgcagcgcccctgaggcccccccacccctgggcgcccccacagctgcccggagctgccaccggctggagggctggccaccctgggtgggcccctgcttcccagacagcagcggcagcctgaccccacctggccaccggcccccccacccagccagccccccacccctgctgctgcccaggagccacagcgaccccggcatcaccaccagcagtgacacagctgacttccgggacctgtacaccaaggtgctggaggaggaggccgcctctgtgagcagcgctgacaccggcctgtgcagcgaggcctgcctcttccggctggcccgctgccccagccccaagctgctgcgggcccggtctgctgagaagagaagacctgtgcccaccttccagaaggtgcccctgcccagcggccctgccccagcccacagcctgggggacctgaagggctcctggccaggccggggcctggtgacccgcttcctgcagatcagcaggaaggccccagaccccagcggcactggagcccacggccacaagcaggtgcccaggagcctgtggggccggcccggccgggagagcctgcacctgcggagctgtggggacctgagcagcagcagctgtggggtgtcctgcctggccgccggctggagcgtggtgcctgcccccacagccagcgccagcactggagctgctggccgcctgggcagtgacctgggcttcctgagccactag

SEQ ID NO: 34187 - DNA, 729 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcaacctgctcttctctgtgtgtggcctgaccatctgtgccgccatcatctgcaccctgagcgccatcgtgtgctgcatccagatcttcagcctggacctggtgcacaccctggcccctgagaggtctgtgtctggccccctgggccccctgggctgcaccagccccccaccagcccccctgctgcacaccatgctggacctggaggagtttgtgccccctgtgcccccaccaccctactacccacctgagtacacctgcagcagcgagacagatgcccagagcatcacctacaacggctccatggacagccctgtgcccctgtaccccacagactgcccccccagctatgaagctgtgatgggcctgcggggcggcaagcagatcctggtgcccctgaggatgagggtggccctgagtgacctgcagggccactacggccagggcaagggcatggcccaggtgttcaagtacagagtgacctgtgcctatgccatgggctggtag

SEQ ID NO: 34188 - DNA, 1719 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcaacctgctcttctctgtgtgtggcctgaccatctgtgccgccatcatctgcaccctgagcgccatcgtgtgctgcatccagatcttcagcctggacctggtgcacaccctggcccctgagaggtctgtgtctggccccctgggccccctgggctgcaccagccccccaccagcccccctgctgcacaccatgctggacctggaggagtttgtgccccctgtgcccccaccaccctactacccacctgagtacacctgcagcagcgagacagatgcccagagcatcacctacaacggctccatggacagccctgtgcccctgtaccccacagactgcccccccagctatgaagctgtgatgggcctgcggggggacagccaggccaccctgtttgacccccagctgcatgatggcagctgcatctgtgagcgggtggccagcatcgtggatgtgtccatggacagcggcagcctggtgctgagcgccatcggggacctgcccggcggcagcagccccagcgaggacagctgcctgctggagctgcagggctctgtgcgctctgtggactatgtgctcttccgcagcatccagaggagccgggccggctactgcctgagcctggactgtggcctgcggggcccctttgaggagagccccctgcccaggaggcctccccgggccgcccggagctacagctgcagcgcccctgaggcccccccacccctgggcgcccccacagctgcccggagctgccaccggctggagggctggccaccctgggtgggcccctgcttccctgagctgcggaggagagtgccccggggcggcggccggcctgctgctgccccacccacccgggcccccacccggcgcttcagtgacagcagcggcagcctgaccccacctggccacaggcctccccacccagccagccccccacccctgctgctgcccaggagccacagcgaccccggcatcaccaccagcagtgacacagctgacttccgggacctgtacaccaaggtgctggaggaggaggccgcctctgtgtcctctgctgacaccggcctgtgcagcgaggcctgcctcttccggctggcccgctgccccagccccaagctgctgcgggcccggtctgctgagaagaggaggcctgtgcccaccttccagaaggtgcccctgcccagcggccctgccccagcccacagcctgggggacctgaagggctcctggccaggccggggcctggtgacccgcttcctgcagatcagcaggaaggccccagaccccagcggcaccggggcccacggccacaagcaggtgcccaggagcctgtggggccggcccggccgggagagcctgcacctgcggagctgtggggacctgagcagcagcagcagcctgcggcggctgctgagcggccggcggctggagcggggcacccggccccacagcctgagcctgaatggaggcagccgggagaccggcctgtag

SEQ ID NO: 34189 - DNA, 2007 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcctggccttctctggagtggtgggcatcgtgtcctggaagaggcccttcaccctggtgatctccttcttcagcctgctgtctgtgctgtgtgtgatgctgtccatggccggctctgtgctgagctgcaagaatgcccagctggcccgggacttccagcagtgcagcctggagggcaaggtgtgtgtgtgctgccccagcgtgcccctgctgcggccctgcccagagagcggccaggagctgaaggtggcccccaacagcacctgtgatgaggcccggggggccctgaagaacctgctcttctctgtgtgtggcctgaccatctgtgccgccatcatctgcaccctgagcgccatcgtgtgctgcatccagatcttcagcctggacctggtgcacaccctggcccctgagaggtctgtgtctggccccctgggccccctgggctgcaccagccccccaccagcccccctgctgcacaccatgctggacctggaggagtttgtgccccctgtgcccccaccaccctactacccacctgagtacacctgcagcagcgagacagatgcccagagcatcacctacaacggctccatggacagccctgtgcccctgtaccccacagactgcccccccagctatgaagctgtgatgggcctgcggggggacagccaggccaccctgtttgacccccagctgcatgatggcagctgcatctgtgagcgggtggccagcatcgtggatgtgtccatggacagcggcagcctggtgctgagcgccatcggggacctgcccggcggcagcagccccagcgaggacagctgcctgctggagctgcagggctctgtgcgctctgtggactatgtgctcttccgcagcatccagaggagccgggccggctactgcctgagcctggactgtggcctgcggggcccctttgaggagagccccctgcccaggaggcctccccgggccgcccggagctacagctgcagcgcccctgaggcccccccacccctgggcgcccccacagctgcccggagctgccaccggctggagggctggccaccctgggtgggcccctgcttccctgagctgcggaggagagtgccccggggcggcggccggcctgctgctgccccacccacccgggcccccacccggcgcttcagtgacagcagcggcagcctgaccccacctggccacaggcctccccacccagccagccccccacccctgctgctgcccaggagccacagcgaccccggcatcaccaccagcagtgacacagctgacttccgggacctgtacaccaaggtgctggaggaggaggccgcctctgtgtcctctgctgacaccggcctgtgcagcgaggcctgcctcttccggctggcccgctgccccagccccaagctgctgcgggcccggtctgctgagaagaggaggcctgtgcccaccttccagaaggtgcccctgcccagcggccctgccccagcccacagcctgggggacctgaagggctcctggccaggccggggcctggtgacccgcttcctgcagatcagcaggaaggccccagaccccagcggcaccggggcccacggccacaagcaggtgcccaggagcctgtggggccggcccggccgggagagcctgcacctgcggagctgtggggacctgagcagcagcagcagcctgcggcggctgctgagcggccggcggctggagcggggcacccggccccacagcctgagcctgaatggaggcagccgggagaccggcctgtag

SEQ ID NO: 34190 - DNA, 1953 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcatctccttcttcagcctgctgtctgtgctgtgtgtgatgctgtccatggccggctctgtgctgagctgcaagaatgcccagctggcccgggacttccagcagtgcagcctggagggcaaggtgtgtgtgtgctgccccagcgtgcccctgctgcggccctgcccagagagcggccaggagctgaaggtggcccccaacagcacctgtgatgaggcccggggggccctgaagaacctgctcttctctgtgtgtggcctgaccatctgtgccgccatcatctgcaccctgagcgccatcgtgtgctgcatccagatcttcagcctggacctggtgcacacccagctggcccctgagaggtctgtgtctggccccctgggccccctgggctgcaccagccccccaccagcccccctgctgcacaccatgctggacctggaggagtttgtgccccctgtgcccccaccaccctactacccacctgagtacacctgcagcagcgagacagatgcccagagcatcacctacaacggctccatggacagccctgtgcccctgtaccccacagactgcccccccagctatgaagctgtgatgggcctgcggggggacagccaggccaccctgtttgacccccagctgcatgatggcagctgcatctgtgagcgggtggccagcatcgtggatgtgtccatggacagcggcagcctggtgctgagcgccatcggggacctgcccggcggcagcagccccagcgaggacagctgcctgctggagctgcagggctctgtgcgctctgtggactatgtgctcttccgcagcatccagaggagccgggccggctactgcctgagcctggactgtggcctgcggggcccctttgaggagagccccctgcccaggaggcctccccgggccgcccggagctacagctgcagcgcccctgaggcccccccacccctgggcgcccccacagctgcccggagctgccaccggctggagggctggccaccctgggtgggcccctgcttccctgagctgcggaggagagtgccccggggcggcggccggcctgctgctgccccacccacccgggcccccacccggcgcttcagtgacagcagcggcagcctgaccccacctggccacaggcctccccacccagccagccccccacccctgctgctgcccaggagccacagcgaccccggcatcaccaccagcagtgacacagctgacttccgggacctgtacaccaaggtgctggaggaggaggccgcctctgtgtcctctgctgacaccggcctgtgcagcgaggcctgcctcttccggctggcccgctgccccagccccaagctgctgcgggcccggtctgctgagaagaggaggcctgtgcccaccttccagaaggtgcccctgcccagcggccctgccccagcccacagcctgggggacctgaagggctcctggccaggccggggcctggtgacccgcttcctgcagatcagcaggaaggccccagaccccagcggcaccggggcccacggccacaagcaggtgcccaggagcctgtggggccggcccggccgggagagcctgcacctgcggagctgtggggacctgagcagcagcagcagcctgcggcggctgctgagcggccggcggctggagcggggcacccggccccacagcctgagcctgaatggaggcagccgggagaccggcctgtag

SEQ ID NO: 34191 - DNA, 435 bp, Artificial Sequence
  Description of Artificial Sequence: Synthetic coding sequence
atgatgcccagccccagcgacagcagccgcagcctgaccagccggcccagcacccggggcctgacccacctgcggctgcaccggccctggctgcaggccctgctgaccctgggcctggtgcaggtgctgctgggcatcctggtggtgaccttctccatggtggccagctctgtgaccaccacagagagcatcaagaggagctgccccagctgggccggcttcagcaacctgctcttctctgtgtgtggcctgaccatctgtgccgccatcatctgcaccctgagcgccatcgtgtgctgcatccagatcttcagcctggacctggtgcacaccctgaccagcggcaccttcatccccaagtgcctgaggaagaagctgctgctcttccccctgcagatccagggcagcgccctgaagccagccagcagcgcctag

SEQ ID NO: 34192 - DNA, 1560 bp, Artificial Sequence
  Description of Artificial Sequence: Synthetic coding sequence
atgacctgcccagacaagccaggccagctgatcaactggttcatctgcagcctgtgtgtgccccgggtgaggaagctgtggagcagccggcggcccaggaccaggaggaacctgctgctgggcacagcctgtgccatctacctgggcttcctggtgtcccaggtgggccgggccagcctgcagcacggccaggccgctgagaagggcccccacaggagccgggacacagctgagcccagcttccctgagatccccctggatggcaccctggcccctcctgagagccagggcaatggcagcaccctgcagcccaacgtggtgtacatcaccctgcggagcaagaggagcaagccagccaacatccggggcaccgtgaagcccaagaggaggaagaagcatgctgtggccagcgctgcccctggccaggaggccctggtgggccccagcctgcagccccaggaggccgcccgggaggctgatgctgtggcccctggctacgcccagggcgccaacctggtgaagattggagagcggccctggaggctggtgcggggccctggggtgcgggccggcggccctgacttcctgcagcccagcagccgggagagcaacatccgcatctacagcgagagcgcccccagctggctgagcaaggatgacatccggaggatgaggctgctggccgacagcgctgtggccggcctgcggcctgtgagcagccgcagcggggcccggctgctggtgctggagggcggggcccctggagctgtgctgcgctgtggccccagcccctgtggcctgctgaagcagcccctggacatgtctgaggtgtttgccttccacctggaccgcatcctgggcctgaacagaaccctgcccagcgtgtccaggaaggccgagttcatccaggacggccggccctgccccatcatcctgtgggatgccagcctgagcagcgccagcaatgacacccacagctctgtgaagctgacctggggcacctaccagcagctgctgaagcagaagtgctggcagaatggccgggtgcccaagccagagagcggctgcacagagatccaccaccacgagtggagcaagatggccctgtttgacttcctgctgcagatctacaaccggctggacaccaactgctgcggcttccggcccaggaaggaggatgcctgtgtgcagaatggcctgcggcccaagtgtgatgaccagggcagcgctgccctggcccacatcatccagaggaagcatgaccccaggcacctggtgttcatcgacaacaagggcttctttgacagaagtgaggacaacctgaacttcaagctgctggagggcatcaaggagttccctgccagcgctgtgtctgtgctgaagagccagcacctgcggcagaagctgctgcagagcctcttcctggacaaggtgtactgggagagccagggcggccggcagggcatcgagaagctgattgatgtgattgagcaccgggccaagatcctgatcacctacatcaatgcccacggcgtgaaggtgctgcccatgaatgaatag

SEQ ID NO: 34193 - DNA, 1560 bp, Artificial Sequence; identical to SEQ ID NO: 34192
  Description of Artificial Sequence: Synthetic coding sequence

SEQ ID NO: 34194 - DNA, 1560 bp, Artificial Sequence; identical to SEQ ID NO: 34192
  Description of Artificial Sequence: Synthetic coding sequence

SEQ ID NO: 34195 - DNA, 1584 bp, Artificial Sequence
  Description of Artificial Sequence: Synthetic coding sequence
atgacctgcccagacaagccaggccagctgatcaactggttcatctgcagcctgtgtgtgccccgggtgaggaagctgtggagcagccggcggcccaggaccaggaggaacctgctgctgggcacagcctgtgccatctacctgggcttcctggtgtcccaggtgggccgggccagcctgcagcacggccaggccgctgagaagggcccccacaggagccgggacacagctgagcccagcttccctgagatccccctggatggcaccctggcccctcctgagagccagggcaatggcagcaccctgcagcccaacgtggtgtacatcaccctgcggagcaagaggagcaagccagccaacatccggggcaccgtgaagcccaagaggaggaagaagcatgctgtggccagcgctgcccctggccaggaggccctggtgggccccagcctgcagccccaggaggccgcccgggaggctgatgctgtggcccctggctacgcccagggcgccaacctggtgaagattggagagcggccctggaggctggtgcggggccctggggtgcgggccggcggccctgacttcctgcagcccagcagccgggagagcaacatccgcatctacagcgagagcgcccccagctggctgagcaaggatgacatccggaggatgaggctgctggccgacagcgctgtggccggcctgcggcctgtgagcagccgcagcggggcccggctgctggtgctggagggcggggcccctggagctgtgctgcgctgtggccccagcccctgtggcctgctgaagcagcccctggacatgtctgaggtgtttgccttccacctggaccgcatcctgggcctgaacagaaccctgcccagcgtgtccaggaaggccgagttcatccaggccgctgctgctgcctgcctgtccatgaggctggccttcttcatcttccctgcctgggaggacatgagggtgcctgggaagtgctgcattggacatgcccggctgacctggggcacctaccagcagctgctgaagcagaagtgctggcagaatggccgggtgcccaagccagagagcggctgcacagagatccaccaccacgagtggagcaagatggccctgtttgacttcctgctgcagatctacaaccggctggacaccaactgctgcggcttccggcccaggaaggaggatgcctgtgtgcagaatggcctgcggcccaagtgtgatgaccagggcagcgctgccctggcccacatcatccagaggaagcatgaccccaggcacctggtgttcatcgacaacaagggcttctttgacagaagtgaggacaacctgaacttcaagctgctggagggcatcaaggagttccctgccagcgctgtgtctgtgctgaagagccagcacctgcggcagaagctgctgcagagcctcttcctggacaaggtgtactgggagagccagggcggccggcagggcatcgagaagctgattgatgtgattgagcaccgggccaagatcctgatcacctacatcaatgcccacggcgtgaaggtgctgcccatgaatgaatag

SEQ ID NO: 34196 - DNA, 996 bp, Artificial Sequence
  Description of Artificial Sequence: Synthetic coding sequence
atgacctgcccagacaagccaggccagctgatcaactggttcatctgcagcctgtgtgtgccccgggtgaggaagctgtggagcagccggcggcccaggaccaggaggaacctgctgctgggcacagcctgtgccatctacctgggcttcctggtgtcccaggtgggccgggccagcctgcagcacggccaggccgctgagaagggcccccacaggagccgggacacagctgagcccagcttccctgagatccccctggatggcaccctggcccctcctgagagccagggcaatggcagcaccctgcagcccaacgtggtgtacatcaccctgcggagcaagaggagcaagccagccaacatccggggcaccgtgaagcccaagaggaggaagaagcatgctgtggccagcgctgcccctggccaggaggccctggtgggccccagcctgcagccccaggaggccgcccgggaggctgatgctgtggcccctggctacgcccagggcgccaacctggtgaagattggagagcggccctggaggctggtgcggggccctggggtgcgggccggcggccctgacttcctgcagcccagcagccgggagagcaacatccgcatctacagcgagagcgcccccagctggctgagcaaggatgacatccggaggatgaggctgctggccgacagcgctgtggccggcctgcggcctgtgagcagccgcagcggggcccggctgctggtgctggagggcggggcccctggagctgtgctgcgctgtggccccagcccctgtggcctgctgaagcagcccctggacatgtctgaggtgtttgccttccacctggaccgcatcctgggcctgaacagaaccctgcccagcgtgtccaggaaggccgagttcatccagggcaaccgcttcacctgcttcgtcatctgcagctgctggggcttctggttcatcttcttcttccccagcctgtccttcagcaagtag

SEQ ID NO: 34197 - DNA, 1608 bp, Artificial Sequence
  Description of Artificial Sequence: Synthetic coding sequence
atgaccccagagagccgggacaccacagacctgagccctgggggcacccaggagatggagggcatcgtcatcgtgaaggtggaggaggaggatgaggaggaccacttccagaaggagaggaacaaggtggagagcagcccccaggtgctgagccgcagcaccaccatgaatgaaagagccctgctgagcagctacctggtggcctacagagtggccaaggagaagatggcccacacagctgctgagaagatcatcctgcctgcctgcatggacatggtgaggaccatctttgatgacaagtctgctgacaagctgcggaccatccccctgagtgacaacaccatcagccgccgcatctgcaccatcgccaagcacctggaggccatgctgatcacccggctgcagagcggcatcgactttgccatccagctggatgagagcacagacatcgccagctgccccaccctgctggtgtatgtgcgctacgtgtggcaggatgactttgtggaggacctgctgtgctgcctgaacctgaacagccacatcaccggcctggacctcttcacagagctggagaactgcctgctgggccagtacaagctgaactggaagcactgcaagggcatcagcagtgatggaacagccaacatgaccgggaagcacagccggctgacagagaagctgctggaggccacccacaacaatgctgtgtggaaccactgcttcatccaccgggaggccctggtgtccaaggagatcagccccagcctgatggatgtgctgaagaatgctgtgaagacagtgaacttcatcaagggcagcagcctgaacagccggctgctggagatcttctgcagcgagattggagtgaaccacacccacctgctcttccacacagaggtgcgctggctgagccagggcaaggtgctgagccgggtgtatgagctgagaaatgagatctacatcttcctggtggagaagcagagccacctggccaacatctttgaagatgacatctgggtgaccaagctggcctacctgagtgacatcttcggcatcctgaatgagctgagcctgaagatgcagggcaagaacaatgacatcttccagtacctggagcacatcctgggcttccagaagaccctgctgctgtggcaggcccggctgaagagcaaccggcccagctactacatgttccccaccctgctgcagcacatcgaggagaacatcatcaatgaagactgcctgaaggagatcaagctggagatcctgctgcacctgaccagcctgagccagaccttcaactactacttccctgaggagaagtttgagagcctgaaggagaacatctggatgaaggacccctttgccttccagaaccctgagagcatcatcgagctgaacctggagcctgaggaggagaatgagctgctgcagctgagcagcagcttcaccctgaagaactactacaagatcctgagcctgagcgccttctggatcaagatcaaggatgacttccccctgctgagcaggaagagcatcctgctgctgctgcccttcaccaccacctacctgtgtgagctgggcttcagcatcctgaccaggtag

SEQ ID NO: 34198 - DNA, 1722 bp, Artificial Sequence
  Description of Artificial Sequence: Synthetic coding sequence
atgaccccagagagccgggacaccacagacctgagccctgggggcacccaggagatggagggcatcgtcatcgtgaaggtggaggaggaggatgaggaggaccacttccagaaggagaggaacaaggtggagagcagcccccaggtgctgagccgcagcaccaccatgaatgaaagagccctgctgagcagctacctggtggcctacagagtggccaaggagaagatggcccacacagctgctgagaagatcatcctgcctgcctgcatggacatggtgaggaccatctttgatgacaagtctgctgacaagctgcggaccatccccctgagtgacaacaccatcagccgccgcatctgcaccatcgccaagcacctggaggccatgctgatcacccggctgcagagcggcatcgactttgccatccagctggatgagagcacagacatcgccagctgccccaccctgctggtgtatgtgcgctacgtgtggcaggatgactttgtggaggacctgctgtgctgcctgaacctgaacagccacatcaccggcctggacctcttcacagagctggagaactgcctgctgggccagtacaagctgaactggaagcactgcaagggcatcagcagtgatggaacagccaacatgaccgggaagcacagccggctgacagagaagctgctggaggccacccacaacaatgctgtgtggaaccactgcttcatccaccgggaggccctggtgtccaaggagatcagccccagcctgatggatgtgctgaagaatgctgtgaagacagtgaacttcatcaagggcagcagcctgaacagccggctgctggagatcttctgcagcgagattggagtgaaccacacccacctgctcttccacacagaggtgcgctggctgagccagggcaaggtgctgagccgggtgtatgagctgagaaatgagatctacatcttcctggtggagaagcagagccacctggccaacatctttgaagatgacatctgggtgaccaagctggcctacctgagtgacatcttcggcatcctgaatgagctgagcctgaagatgcagggcaagaacaatgacatcttccagtacctggagcacatcctgggcttccagaagaccctgctgctgtggcaggcccggctgaagagcaaccggcccagctactacatgttccccaccctgctgcagcacatcgaggagaacatcatcaatgaagactgcctgaaggagatcaagctggagatcctgctgcacctgaccagcctgagccagaccttcaactactacttccctgaggagaagtttgagagcctgaaggagaacatctggatgaaggacccctttgccttccagaaccctgagagcatcatcgagctgaacctggagcctgaggaggagaatgagctgctgcagctgagcagcagcttcaccctgaagaactactacaagatcctgagcctgagcgccttctggatcaagatcaaggatgacttccccctgctgagcaggaagagcatcctgctgctgctgcccttcaccaccacctacctgtgtgagctgggcttcagcatcctgacccggctgaagaccaagaagaggaaccggctgaacagcgccccagacatgagggtggccctgagcagctgtgtgcctgactggaaggagctgatgaaccggcaggcccaccccagccactag

SEQ ID NO: 34199 - DNA, 4008 bp, Artificial Sequence
  Description of Artificial Sequence: Synthetic coding sequence
atgctgagccccacctttgtgctgtgggaggtgggctaccccctgtacatctacggcagcatcttcatcgtgattgtcatcatctggcaggtgaagaggagccaccacgagctgagcagcgagcccaagaggagctgctgccgctgccaccagaaggtgcggcagagggccagagatgctgccagcacagcccggcggcgcagccgggaggaggccgagaagccccagaagctgctgagcatcatcaagagccagggctggctgcccctggagaggtctgtgcggcgcatcctgtgtgccgacccctgctgccagatctgcaacagcgtggccctggagatccagcagctgctggtgggggagaacaaccagatcagcctgaccctgagcggccccctgcagggcagcagctgcctggagatgctgagcaccagctccatgagcctggaccagagcctggagttccacagctggcacacccgggagctgagcctgagctctgtgacccccaccctgagccagctgacagaccagaagagcctgacccagagcgctgcccagagcacctatgcagatggcatccaggactactgggccgaccacctgcagctgggccaggagttccaggtgcctgatgtgctgcggggccccaacaccatcgccagcagcagaattgagaagccccgggcccccctgaaccaggaggagatgacccagagcaaccccagcctggtgcagggcaaccagggccagcaccacctgaacagccaggtgtccctgctgagcctgaaccctgagaccctgaacaggatgcaccccatggccctgcacatggtgctgcctgcccacctgcccttcctgagccctgaggtgctgcggctgctggaggtgcacgtgaagaagtggatgcacttccagcgctggggcctgccccggcgggtggaggagagcctgcggcagctgatgcccaacccccccctgtactaccagcctggaaatgaccagcctgtgtccttcaacctgaagaacaccccccaggtgtccctgcacagatttgagaccatcagcctgcagacctggtgcagctgtgtggccggccagcccatccagaccttctgggtgtctgagtggagcaccatgaaccctgagcagaggcaccactgccagcagacccccaaccccatggccctggccctgcccagccctgccctgaaggccctgagcggcccccacccccagagcggcggccaggacaatgattctggcagtgacctgcagcagaagtacagccagctgttctgtggcctgcccagcctgcacagcgagagcctggtggccaccttcatgggcagccagggcctgcccaagattgaaaatgtgcccaagccacccctgaaggaccccttcctgttcaatgagctgtccttcccccagctgctgcccaagaccagcccccagagcgccccacccagcagccccctgagccccaactggatgagccccagcgaccaccagagggcccagatcaacgtgcccttcctgaccctggccgagtatgaggccctggagtggcacctgctgcagaggcagctgcagctgcagtggggctggccagctgccctgcagaggagccagcacacccagtgcctgatgcagcacgagccctgtgggaaggcccagagccctgagaccaccacagccagccagacaggcaagagcatctctgtgctgacccgggagctgctcttcttccctgagcacgccaggaagctgctggagttccacatccagaagcagctgatccgccaccgctggggcctgccccagaagatccagcagagcatccagctgctgctgaccagcacagaccagcagacagtgagcagcagcagcacagccctggccaacgtgtccatcccccagcctgtggccctggaggccaacggggcctgtgatgtgctgagccccatcgccgcccctgtgtccatcccccggccccacctgctgacccaggtgaaggccatcctgcagagccacatcgacagcaaatgtggccagatccaccagggcaagatcccagcctgtgtgcaccgctcctgggactgccgcatctctggagtgctggccgtggcccccttcccctgcatccctgagagccagttcctggagctgcagacagccagtgaccctgacctgcaccacaaggtgatgccctggatgcccacagccctggaccagcagcagcaggccctgcccggcaccgtgacagagcaccccaagctgctgcgggtgctgtctgtggaggccatcgagaagctggagaccaccctgcggcacaagcacctggccttcctgagcggcctgcctgccctgtactacgtggccctgccccgggccctggccccagctgtgaccagccagagcgtcatcacagagatggagcccagccctgtggagatcccagctgagcccctcatccagatggtgtcctttgaggagcagtgcatcagcctgggcccctgcccccagggcaacaatgaaagctgcacagatgtggccaaggagttccagcctgctgtgcctgtgaagggcaccatggagaccctgcccctggagagccagacccaccccaccagcccccacagcctgcagacccacatcctgaccaagctgaacttccacctgaggaagaaggtgctggagatccagtggggcatccccatccgggccaggaagagccgggagcagacagtggccgcccctgagaacatcagcacccagaagagcctggagagcctgaaccaccagggcgagaccctgctgcaggagctgcccatccccccagacaccctgcctgcccccaaccctgagggcgtgcacctgaaggagcagctggccaatgacctgaaggctgtgcagcagaaccagaagcagagcaacagcaaggctgtgccccagggcagcgcccacagcgtgtccaagatcagccagcccagcggggacatgacagaggcccacatgccctgtgtgcaggtggaggccaacgtgaacaagcccagcctggaggagccctgtggccctgagccccagagccccagcaagagcaaggaccctgcccacgtgcccatgctggccggcaacagagaagatcctgaggagaccaaggccgcccgggaccaccgggagggagatgctggcttcggccgcagcagcacccgggaggagcggcggcctgctgaggaccagaggcctgctggcatgctgcccaacaagaccccccggggctcctggcgctggagccgctccttccacctggccgacccctgccagcacagcccccagcaccacccccagctgaagctgccccagctgcccccccgggtgcctggagagaaggagagcgagaaggacctgcaggacagccagaccaagctgaccgtcatcctggagcccgccaccatcccagaaaatgcccagacagtgctgccccaggccagccagggccagcccttcctgagccagcccacccaggccaagcccctgcagggccagaccctgcagggccaggtgctgcacggcctggtgatgcctgtgcacgcccagaagaagcccagcctgacagagagcagcttcaggaacaagatcaagtgcttcctgcagcacatcaaccccaagaccaagggcaaaggacatgaggacagcatgttttctgctgctgccaaggtggccaagaccaggaaagaaaatgtggccaagagcctggccccagccaagagccctgtgggccgcagcaagacagagaagcccaccggctgcagcaaggcccagagcaggcctgcccagaagctggtgggccctgccttcctggatggcccccagagcctggatgacaagctgcggctgcacagccggcagcccggcagcgccagcgccctgggctaccccaggcactgccccaggcactgcccccgggaggcctgtgccaacaagccaggccaccccacctag

SEQ ID NO: 34200 - DNA, 516 bp, Artificial Sequence
  Description of Artificial Sequence: Synthetic coding sequence
atgtggaccctgaagagcagcctggtgctgctgctgtgcctgacctgcagctatgccttcatgttcagcagcctgcggcagaagaccagcgagccccagggcaaggtgcagtacggggagcacttccgcatccggcagaacctgcctgagcacacccagggctggctgggcagcaagtggctgtggctgctgtttgtggtggtgcccttcgtcatcctgcagtgccagagggacagcgagaagaacaaggagcagagccccccaggcctgcggggcggccagctgcacagccccctgaagaagaagagaaatgccagccccaacaaggactgtgccttcaacaccctgatggagctggaggtggagctgatgaagtttgtgtccaaggtgaggaacctgaagagggccatggccactggaagtggcagcaacctgcggctgaggaagtctgagatgcctgctgacccctaccacgtgaccatctgtgagatctggggcgaggagagcagcagctag

SEQ ID NO: 34201 - DNA, 516 bp, Artificial Sequence
  Description of Artificial Sequence: Synthetic coding sequence
atgtggaccctgaagagcagcctggtgctgctgctgtgcctgacctgcagctatgccttcatgttcagcagcctgcggcagaagaccagcgagccccagggcaaggtgccctgtggggagcacttccgcatccggcagaacctgcctgagcacacccagggctggctgggcagcaagtggctgtggctgctgtttgctgtggtgcccttcgtcatcctgcagtgccagagggacagcgagaagaacaaggagcagagccccccaggcctgcggggcttccccttccgcacccccctgaagaagaaccagaatgccagcctgtacaaggactgtgtgttcaacaccctgaatgagctggaggtggagctgctgaagtttgtgtctgaggtgcagaacctgaagggggccatggccactggaagtggcagcaacctgaagctgcggcgctctgagatgcctgctgacccctaccacgtgaccatctgcaagatctggggcgaggagagcagcagctag

SEQ ID NO: 34202 - DNA, 4026 bp, Artificial Sequence
  Description of Artificial Sequence: Synthetic coding sequence
atgatgaacagaaccaccccagaccaggagctggccccagccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccaccctggtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcaacagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 34203 - DNA, 3840 bp, Artificial Sequence
  Description of Artificial Sequence: Synthetic coding sequence
atgatgaacagaaccaccccagaccaggagctggccccagccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccaccctggtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcaacagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 34204 - DNA, 3963 bp, Artificial Sequence
  Description of Artificial Sequence: Synthetic coding sequence
atgatgaacagaaccaccccagaccaggagctggccccagccagcgagcctgtgtgggagcggccctggagcgtggaggagatcagaagaagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcatcgagaacagagtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccaccctggtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcaacagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 34205 - DNA, 3762 bp, Artificial Sequence
  Description of Artificial Sequence: Synthetic coding sequence
atgccccggctgagcggcaagtctgtgcgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccaccctggtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaaccccttccccctgctggaggatgaagatgacctcttcacagaccagaaggtgaagaagaatgagaccaagagcaacagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 34206 - DNA, 3204 bp, Artificial Sequence
  Description of Artificial Sequence: Synthetic coding sequence
atgaacagaaccaccccagaccaggagctggccccagccagcgagcctgtgtgggagcggccctggagcgtggaggagatccgccgcagcagccagagctggagcctggccgcagatgctggcctgctgcagttcctgcaggagttcagccagcagaccatcagcaggacccatgagatcaagaagcaggtggatggcctcatccgggagaccaaggccacagactgccgcctgcacaacgtgttcaatgacttcctgatgctgagcaacacccagttcattgaaaatagagtgtatgatgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctgtttgccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccaccctggtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagcggcggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagtttgggaagctgtggccaccccactgccacatcctgctgatcaagttctactggaacacctag

SEQ ID NO: 34207 - DNA, 471 bp, Artificial Sequence
  Description of Artificial Sequence: Synthetic coding sequence
agcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggtgaggaaccccctgtag

SEQ ID NO: 34208 - DNA, 3672 bp, Artificial Sequence
  Description of Artificial Sequence: Synthetic coding sequence
cgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagtgaagaagatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaagattttgcccaccacagcgacaatgagcagaacagacacaccacccagatgtctgatgaggaggaggatgatgatggctgtgacctgtttgctgacagcgagaaggaggaggaggacatcgaggacatcgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctcttcaccccacccaagctgacagatgaggacttcagcccctttggaagtggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaagaagattctgaggacctcttcagcagccagagcgccagcaagctgaagggggccagcctgctgcccgggaagctgcccacctctgtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaaaggagagccccgggacagcggcaccctgcagagccaggaggccaaggctgtgaagaagaccagcctgtttgaggaggatgaagaagatgacctgtttgccatcgccaaggacagccagaagaagacccagagggtgtccctgctgtttgaagatgatgtggacagccggggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggccgcacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaacaccttccccctgctggaggatgaagatgacctcttcacagaccagaaggtgaagaagaatgagaccaagagcaacagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 34209 - DNA, 3762 bp, Artificial Sequence
  Description of Artificial Sequence: Synthetic coding sequence
atgccccggctgagcggcaagtctgtgcgggtgtatgatgaggaggtggaggagcctgtgctgaaggccgaggccgagaagacagagcaggagaagacccgggagcagaaggaggtggacctgatccccaaggtgcaggaggccgtgaactacggcctgcaggtgctggacagcgcctttgagcagctggacatcaaggccggcaacagcgacagcgaggaggatgatgccaacggccgggtggagctgatcctggagcccaaggacctgtacatcgaccggcccctgccctacctgattggcagcaagctgttcatggagcaggaggatgtgggcctgggggagctgagcagcgaggagggctctgtgggcagtgaccggggcagcatcgtggacacagaggaggagaaggaggaggaggagagtgatgaggactttgcccaccacagcgacaatgagcagaacagacacaccacccagatgtctgatgaggaggaggatgatgatggctgtgacctgtttgctgacagcgagaaggaggaggaggacattgaagatattgaggagaacacccggcccaagaggagccggcccaccagctttgctgatgagctggccgcccgcatcaagggagatgctgtgggccgggtggatgaggagcccaccaccctgcccagcggggaggccaagcccaggaagaccctgaaggagaagaaggagaggaggacccccagtgatgatgaggaggacaacctcttcaccccacccaagctgacagatgaggacttcagccccttcggcagcggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaggaggacagtgaagatctcttcagcagccagagcgccagcaagctgaagggggccagcctgctgcccgggaagctgcccacctctgtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaagggggagccccgggacagcggcaccctgcagagccaggaggccaaggctgtgaagaagaccagcctgtttgaagaagatgaggaggatgacctgtttgccatcgccaaggacagccagaagaagacccagagggtgtccctgctgtttgaagatgatgtggacagccggggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggaagaacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcacccgcatcggcaagatccaggccaacctggccatcaacccagctgccctgctgcccacagctgccagccagatcagcgaggtgaagcctgtgctgcctgagctggccttccccagcagcgagcaccggcgcagccacggcctggagagcgtgcctgtgctgcccggcagcggggaggccggcgtgtcctttgacctgcctgcccaggccgacaccctgcacagcgccaacaagagccgggtgaagatgaggggcaagaggcggccccagacccgggccgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgacagcggggacatcttcagcacaggcaccggcagccagagcgtggagaggaccaagcccaaggccaagattgctgagaacccagccaacccccctgtgggcggcaaggccaagagccccatgtttcctgccctgggggaggccagcagtgatgatgacctcttccagagcgccaagcccaagccagccaagaagaccaacaccttccccctgctggaggatgaagatgacctcttcacagaccagaaggtgaagaagaatgagaccaagagcaacagccagcaggacgtcatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgccttcggcggccagtag

SEQ ID NO: 34210 - DNA, 828 bp, Artificial Sequence
  Description of Artificial Sequence: Synthetic coding sequence
gagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcaccagaattggcaagatccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgattctggggacatcttcagcactggaacaggcagccagagcgtggagtag

SEQ ID NO: 34211 - DNA, 2769 bp, Artificial Sequence
  Description of Artificial Sequence: Synthetic coding sequence
atgaggaagaggatgatgatggctgtgaccttcagcctgaccctgcggcggcggaggaagatcctgcggaccctgaagaagatcctggacctgaaggaggccgacctgcaccggctgcagatgtcctggctgcctgccagccggggcatgccctgggtggagtggaccaggagccggcagccctacccccaggagaagcagaacctgggccgccacagcaagagaagaaggaagggggagctgctgcagaccatgaagaggatcacctacagccacccccccctgacagatgaggacttcagcccctttggaagtggcggcggcctcttcagcggcggcaagggcctgtttgatgatgaagatgaggagagtgacctcttcacagaggccccccaggaccggcaggccggggcctctgtgaaggaggagagcagcagcagcaagccaggcaagaagatcccagctggagctgtgtctgtgttcctgggggacacagatgtgtttggagctgcctctgtgcccagcatgaaggagccccagaagccagagcagcccacccccaggaagagcccctacggccccccacccaccggcctgtttgatgatgatgatggagatgatgatgatgacttcttcagcgccccccacagcaagcccagcaagacaggcaaggtgcagagcacagctgacatctttggagatgaggagggggacctcttcaaggagaaggctgtggccagccctgaggccaccgtgtcccagacagatgagaacaaggcccgggcagagaagaaggtgaccctgagcagcagcaagaacctgaagcccagcagcgagaccaagacccagaagggcctcttcagtgatgaagaagattctgaggacctcttcagcagccagagcgccagcaagctgaagggggccagcctgctgcccgggaagctgcccacctctgtgtccctgtttgatgatgaagatgaggaggacaacctgtttggaggaacagctgccaagaagcagaccctgtgcctgcaggcccagcgggaggagaaggccaaggccagcgagctgagcaagaagaaggccagcgccctgctcttcagcagtgatgaggaggaccagtggaacatcccagccagccagacccacctggccagtgacagccgcagcaaaggagagccccgggacagcggcaccctgcagagccaggaggccaaggctgtgaagaagaccagcctgtttgaggaggatgaagaagatgacctgtttgccatcgccaaggacagccagaagaagacccagagggtgtccctgctgtttgaagatgatgtggacagccggggcagcctgtttggcagcccccccacctctgtgcccccagccaccaagaagaaggagaccgtgtctgaggccccacccctgctcttcagtgatgaggaggagaaggaggcccagctgggcgtgaagtctgtggacaagaaggtggagagcgccaaggagagcctgaagtttggccgcacagatgtggccgagagcgagaaggagggcctgctgaccaggtctgcccaggagaccgtgaagcacagcgacctcttcagcagcagcagcccctgggacaagggcaccaagcccaggaccaagacagtgctgagcctgtttgatgaggaggaggacaagatggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggacagcagcggcctggcccccttcaagaccaaggagcccagcaccagaattggcaagatccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgattctggggacatcttcagcactggaacaggcagccagagcgtggagaggaccaagcccaaggccaagtttgggaagctgtggccaccccactgccacatcctgctgatcaagttctactggaacacctag

SEQ ID NO: 34212 - DNA, 1533 bp, Artificial Sequence
  Description of Artificial Sequence: Synthetic coding sequence
atggaggaccagaacatcatccaggccccccagaaggaggtgggcaagggccgggaccctgatgcccaccccaagagcactggagtcttccaggatgaggagctgctcttcagccacaagctgcagaaggacaatgaccctgatgtggacctgtttgctggcaccaagaagaccaagctgctggagcccagcgtgggcagcctgtttggagatgatgaagatgatgacctcttcagcagcgccaagagccagcccctggtgcaggagaagaagagggtggtgaagaaggaccacagcgtggacagcttcaagaaccagaagcaccctgagagcatccagggcagcaaggagaagggcatctggaagccagagaccccccaggccaacctggccatcaacccagctgccctgctgcccacagctgccagccagatcagcgaggtgaagcctgtgctgcctgagctggccttccccagcagcgagcacagaagaagccacggcctggagagcgtgcctgtgctgcccggcagcggggaggccggcgtgtcctttgacctgcctgcccaggccgacaccctgcacagcgccaacaagagccgggtgaagatgaggggcaagagaagaccccagaccagggctgcccggcggctggccgcccaggagagcagcgagacagaggacatgtctgtgccccggggccccatcgcccagtgggcagatggagccatcagccccaacggccaccggccccagctgcgggccgccagcggggaggacagcacagaggaggccctggccgctgctgctgccccctgggagggcggccctgtgcctggggtggacaggagcccctttgccaagagcctgggccacagcagaggagaggccgacctgtttgattctggggacatcttcagcactggaacaggcagccagagcgtggagaggaccaagcccaaggccaagattgctgaaaatcctgccaacccccctgtgggcggcaaggccaagagccccatgtttcctgccctgggggaggccagcagtgatgatgacctcttccagagcgccaagcccaagccagccaagaagaccaacaccttccccctgctggaggatgaagatgacctcttcacagaccagaaggtgaagaagaatgagaccaagagcaacagccagcaggatgtgatcctgaccacccaggacatctttgaagatgacatctttgccacagaggccatcaagcccagccagaagacccgggagaaggagaagaccctggagagcaacctgtttgatgacaacatcgacatctttgctgacctgactgtgaagcccaaggagaagagcaagaagaaggtggaggccaagagcatctttgatgatgacatggatgacatcttcagcagcggcatccaggccaagaccaccaagcccaagagccgcagcgcccaggccgcccctgagcccaggtttgagcacaaggtgagcaacatctttgatgaccccctgaatgcctttggaggccagtag

SEQ ID NO: 34213 - DNA, 819 bp, Artificial Sequence
  Description of Artificial Sequence: Synthetic coding sequence
atgcagtggaatgtgcccaggacagtgtcccggctggcccggaggacctgcctggagccccacaatgccggcctgtttggccactgccagaatgtgaagggccccctgctgctgtacaatgctgagagcaaggtggtgctggtgcagggcccccagaagcagtggctgcacctgtctgctgcccagtgtgtggccaaggagcggcggcccctggatgcccaccccccccagcccggggtgctgcggcacaagcagggcaagcagcacgtgtccttcagaagagtcttcagcagcagcgccacagcccagggcaccccagagaagaaggaggagccagaccccctgcaggacaagagcatcagcctgtaccagcgcttcaagaagaccttccggcagtatggcaaggtgctgatccctgtgcacctgatcaccagcggcgtgtggtttggcaccttctactatgctgccctgaagggcgtgaatgtggtgcccttcctggagctgattggcctgcctgacagcgtggtgtccatcctgaagaacagccagagcggaaatgccctgacagcctatgccctcttcaagatcgccaccccagcccgctacacagtgaccctgggcggcacctctgtgacagtgaagtacctgcggagccacggctacatgagcaccccacctcctgtgaaggagtacctgcaggacaggatggaggagaccaaggagctgatcacagagaagatggaggagaccaaggaccggctgacagagaagctgcaggagaccaaggagaaggtgtccttcaagaagaaggtggagtag

SEQ ID NO: 34214 - DNA, 819 bp, Artificial Sequence; identical to SEQ ID NO: 34213
  Description of Artificial Sequence: Synthetic coding sequence

SEQ ID NO: 34215 - DNA, 579 bp, Artificial Sequence
  Description of Artificial Sequence: Synthetic coding sequence
atggccggcctgctggccctgctgggccctgctggccgggtgggcgcccgggtgcggccccgggccacctggctgctgggcgccacagccccctgtgcccccccacccctggccctggccctgctgcccccccggctggatgcccggctgctgaggacagcccggggggactgccggggccaccaggaccccagccaggccaccggcaccaccggcagctctgtgtcctgcacagaggagaagaagcagagcaagagccagcagctgaagaagatcttccaggagtatggcaccgtgggcgtgtccctgcacatcggcatcagcctcatcagcctgggcatcttctacatggtggtgtcctctggagtggacatgcctgccatcctgctgaagctgggcttcaaggagagcctggtgcagagcaagatggctgctggcaccagcacctttgtggtggcctatgccatccacaagctgtttgcccctgtgcgcatcagcatcaccctggtgtctgtgcccctgattgtgcgctacttcaggaaggtgggcttcttcaagcccccagctgccaagccctag

SEQ ID NO: 34216 - DNA, 945 bp, Artificial Sequence
  Description of Artificial Sequence: Synthetic coding sequence
atgtgccccaccctgaacaacatcgtgagcagcctgcagagaaatggcatcttcatcaacagcctgattgctgccctgaccatcggcggccagcagctgttcagcagcagcaccttcagctgcccctgccaggtgggcaagaacttctactacggcagcgccttcctggtgatcccagccctgatcctgctggtggccggctttgccctgcggagccagatgtggaccatcaccggggagtactgctgcagctgtgccccaccctaccgccgcatcagccccctggagtgcaagctggcctgcctgcgcttcttcagcatcaccggccgggctgtgattgcccccctgacctggctggccgtgaccctgctgaccggcacctactatgaatgtgccgccagcgagtttgcctctgtggaccactaccccatgtttgacaacgtgtctgccagcaagcgggaggagatcctggccggcttcccctgctgccgcagcgcccccagtgatgtgatcctggtgagagatgaaattgccctgctgcaccgctaccagagccagatgctgggctggatcctgatcaccctggccaccatcgccgccctggtgtcctgctgcgtggccaagtgctgcagccccctgaccagcctgcagcactgctactggaccagccacctgcagaatgaaagagagctgtttgagcaggccgctgagcagcacagccggctgctgatgatgcaccgcatcaagaagctgtttggcttcatccctggctctgaagatgtgaagcacatccgcatccccagctgccaggactggaaggacatctctgtgcccaccctgctgtgcatgggagatgacctgcagggccactacagcttcctgggcaacagagtggatgaggacaatgaggaggacaggagccggggcatcgagctgaagccctag

SEQ ID NO: 34217 - DNA, 387 bp, Artificial Sequence
  Description of Artificial Sequence: Synthetic coding sequence
atgctgggctggatcctgatcaccctggccaccatcgccgccctggtgtcctgctgcgtggccaagtgctgcagccccctgaccagcctgcagcactgctactggaccagccacctgcagaatgaaagagagctgtttgagcaggccgctgagcagcacagccggctgctgatgatgcaccgcatcaagaagctgtttggcttcatccctggctctgaagatgtgaagcacatccgcatccccagctgccaggactggaaggacatctctgtgcccaccctgctgtgcatgggagatgacctgcagggccactacagcttcctgggcaacagagtggatgaggacaatgaggaggacaggagccggggcatcgagctgaagccctag

SEQ ID NO: 34218 - DNA, 516 bp, Artificial Sequence
  Description of Artificial Sequence: Synthetic coding sequence
atgtttgacaacgtgtctgccagcaagcgggaggagatcctggccggcttcccctgctgccgcagcgcccccagtgatgtgatcctggtgagagatgagatcgccctgctgcaccgctaccagagccagatgctgggctggatcctgatcaccctggccaccatcgccgccctggtgtcctgctgcgtggccaagtgctgcagccccctgaccagcctgcagcactgctactggaccagccacctgcagaatgaaagagagctgtttgagcaggccgctgagcagcacagccggctgctgatgatgcaccgcatcaagaagctgtttggcttcatccctggctctgaagatgtgaagcacatccgcatccccagctgccaggactggaaggacatctctgtgcccaccctgctgtgcatgggagatgacctgcagggccactacagcttcctgggcaacagagtggatgaagataatgaagaagatagaagccggggcatcgagctgaagccctag

SEQ ID NO: 34219 - DNA, 513 bp, Artificial Sequence
  Description of Artificial Sequence: Synthetic coding sequence
atggcccccaggtctgccaaggagaccttccgcatcaaccccaacgtggccgccaacctgagcgcccccagtgatgtgatcctggtgagagatgaaattgccctgctgcaccgctaccagagccagatgctgggctggatcctgatcaccctggccaccatcgccgccctggtgtcctgctgcgtggccaagtgctgcagccccctgaccagcctgcagcactgctactggaccagccacctgcagaatgaaagagagctgtttgagcaggccgctgagcagcacagccggctgctgatgatgcaccgcatcaagaagctgtttggcttcatccctggctctgaagatgtgaagcacatccgcatccccagctgccaggactggaaggacatctctgtgcccaccctgctgtgcatgggagatgacctgcagggccactacagcttcctgggcaacagagtggatgaggacaatgaggaggacaggagccggggcatcgagctgaagccctag

SEQ ID NO: 34220 - DNA, 372 bp, Artificial Sequence
  Description of Artificial Sequence: Synthetic coding sequence
atgctgggctggatcctgatcaccctggccaccatcgccgccctggtgtcctgctgcgtggccaagtgctgcagccccctgaccagcctgcagcactgctactggaccagccacctgcagaatgaaagagagctgtttgagcaggccgctgagcagcacagccggctgctgatgatgcaccgcatcaagaagctgtttggcttcatccctggctctgaagatgtgaagcacatccgcatccccagctgccaggactggaaggacatctctgtgcccaccctgctgtgcatgggagatgacctgcagggccactacagcttcctgggcaacagagtggatgaggacaatgaggaggacaggagccggggctag

SEQ ID NO: 34221 - DNA, 930 bp, Artificial Sequence
  Description of Artificial Sequence: Synthetic coding sequence
atggatgccttccagggcatcctgaagttcttcctgaaccagaagacagtcatcggctacagcttcatggccctgctgactgtgggcagcgagcggctcttctctgtggtggccttcaagtgcccctgcagcacagagaacatgacctacggcctggtgttcctgtttgccccagcctgggtgctgctgatcctgggcttcttcctgaacaacagatcctggaggctcttcaccggctgctgcgtgaaccccaggaagatcttcccccggggccacagctgccgcttcttctacgtgctgggccagatcaccctgagcagcctggtggcccctgtgatgtggctgtctgtggccctgctgaatggcaccttctatgaatgtgccatgagcggcaccaggagcagcggcctgctggagctgatctgcaagggcaagcccaaggagtgctgggaggagctgcacaaggtgtcctgtgggaagacctccatgctgcccaccgtgaatgaggagctgaagctgagcctgcaggcccagagccagatcctgggctggtgcctgatctgcagcgccagcttcttcagcctgctgaccacctgctacgcccgctgccgcagcaaggtgtcctacctgcagctgtccttctggaagacctacgcccagaaggagaaggagcagctggagaacaccttcctggactatgccaacaagctgtctgagaggaacctgaagtgcttctttgagaacaagaggccagaccccttccccatgcccacctttgctgcctgggaggccgccagcgagctgcacagcttccaccagagccagcagcactacagcaccctgcaccgggtggtggacaatggcctgcagctgagcccagaagatgatgagaccaccatggtgctggtgggcacagcccacaacatgtag

SEQ ID NO: 34222 - DNA, 948 bp, Artificial Sequence
  Description of Artificial Sequence: Synthetic coding sequence
atggagaagttccgggctgtgctggacctgcacgtgaagcaccacagcgccctgggctacggcctggtgaccctgctgacagctggaggagagcgcatcttctctgctgtggccttccagtgcccctgcagcgctgcctggaacctgccctacggcctggtgttcctgctggtgcctgccctggccctcttcctgctgggctacgtgctgagcgcccggacctggaggctgctgaccggctgctgcagcagcgcccgggccagctgtggcagcgccctgcggggcagcctggtgtgcacccagatctctgctgctgctgccctggcccccctgacctgggtggccgtggccctgctgggcggggccttctatgaatgtgccgccactggatctgctgcctttgcccagaggctgtgcctgggcaggaacagaagctgtgccgctgagctgcccctggtgccctgcaaccaggccaaggccagtgatgtgcaggacctgctgaaggacctgaaggcccagagccaggtgctgggctggatcctgattgctgtggtgatcatcatcctgctgatcttcacctctgtgacccgctgcctgagccctgtgtccttcctgcagctgaagttctggaagatctacctggagcaggagcagcagatcctgaagagcaaggccacagagcacgccacagagctggccaaggagaacatcaagtgcttctttgagggcagccaccccaaggagtacaacacccccagcatgaaggagtggcagcagatcagcagcctgtacaccttcaaccccaagggccagtactacagcatgctgcacaagtatgtgaacaggaaggagaagacccacagcatccgcagcacagaaggagacaccgtcatccctgtgctgggctttgtggacagcagcggcatcaacagcaccccagagctgtag

SEQ ID NO: 34223 - DNA, 204 bp, Artificial Sequence
  Description of Artificial Sequence: Synthetic coding sequence
atgaggaagccccaggccggcaccggggaggccgcccgggaccccagcctgcggcctgccaggacagtgctggtgggggaccaggatgagtacacagctgctgagaacaagagcccccggggcaccctgtgccccaccggggagcagaggatccacgccagagaagatgcctgcatcttcagccgcctcttcagcgagaagtag

SEQ ID NO: 34224 - DNA, 393 bp, Artificial Sequence
  Description of Artificial Sequence: Synthetic coding sequence
atggccgcccctcctgagcctggagagcctgaggagaggaaggccagctgcaccagcctgcacctgagctactggaagagcctgaagctgctgggcttcctggatgtggagaacaccccctgtgcccggcacagcatcctgtatggcagcctgggctctgtggtggccggcttcggccacttcctgttcaccagccgcatccgccgcagctgtgatgtgggcgtgggcggcttcatcctggtgaccctgggctgctggttccactgccgctacaactatgccaagcagaggatccaggagcgcatcgcccgggaggagatcaagaagaagatcctgtatgagggcacccacctggaccctgagaggaagcacaacggcagcagcagcaactag

SEQ ID NO: 34225 - DNA, 357 bp, Artificial Sequence
  Description of Artificial Sequence: Synthetic coding sequence
atggccgcccctcctgagcctggagagcctgaggagaggaagagcctgaagctgctgggcttcctggatgtggagaacaccccctgtgcccggcacagcatcctgtatggcagcctgggctctgtggtggccggcttcggccacttcctgttcaccagccgcatccgccgcagctgtgatgtgggcgtgggcggcttcatcctggtgaccctgggctgctggttccactgccgctacaactatgccaagcagaggatccaggagcgcatcgcccgggaggagatcaagaagaagatcctgtatgagggcacccacctggaccctgagaggaagcacaacggcagcagcagcaactag

SEQ ID NO: 34226 - DNA, 1680 bp, Artificial Sequence
  Description of Artificial Sequence: Synthetic coding sequence
atggtggagaagatcctgatccaccgcatcctgaccctcttccccaatgccatcgccaggaagctgctgctgatgctgaccttcatcctgatcttctggatcatctacctggccagcaaggaccacaccaagttctccttcaacctggagaaccacatcatcctgaaccagggcaacatcttcaagaagtacagccacagcgagacccccctgtgcccagctgtgagccccaaggagacagagctgcgcatcaaggacatcatggagaagctggaccagcagatccccccccggcccttcacccacgtgaacaccaccaccagcgccacccacagcacagccaccatcctgaacccccaggacacctactgccgcggggaccagctggacatcctgctggaggtgcgggaccacctgggccacaggaagcagtatggaggagacttcctgcgggccaggatgtacagcacagccctgatggccggggccagcggcaaggtgacagacttcaacaacggcacctacctggtgtccttcaccctcttctgggagggccaggtgtccctgagcctgctgctgatccaccccagcgagggcgtgtctgccctgtggagggccaggaaccagggctgtgaccgcatcatcttcaccggcctgtttgccaacagaagcagcaatgtgttcacagaatgtggcctgaccctgaacaccaatgctgagctgtgccagtacatggatgaccgggaccaggaggccttctactgtgtgcggccccagcacatgccctgtgaggccctgacccacatgaccaccaggaccaggaacatctcctacctgagcaaggaggagtggaggctcttccacaggagcaacatcggcgtggagatgatgaagaacttcacccccattgaagtcatcccctgcaacaagtctgagaacatcaagaagaactgccagatcggcatgaagacccccttccccagcggctacaccctgaagaagatgtggatcacagccttctgcaagcagatcaagttcaatgagaccaagaacatcaatgactgcctggagaggaagctgatctacctgatgggagacagcaccctgcaccagtggatctactacctgcagaaggctgtgaagaccctgaagtactttgaccaccacggggccggcatcttcaagacccacgtgctgctggatgtggagcggcacatcctgatccagtggaagaagcacggccacccctttgtgaccaagaagctgttctctgtgaaggatgagaactacatcccccgggagattgaccaggtggccggggacaagaacacagccatcgtcatcaccctgggccagcacttccggcccttccccatcaacatcttcatccggcgggccatcaacatccagaaggccatcgagcggctcttcctgcggagccctgagaccaaggtgatcctgaagacagagaacacccgggagattgagcagaatgctgagatgttcagtgacttccacggctacatccagaacctgatcatccgggacatctttgtggacctgaatgtgggcatcattgatgcctgggacatgaccatcgcctactgcaccaacaatgcccaccccccagactatgtgatccagaaccagatcggcatgttcctgaactacatctgctag

SEQ ID NO: 34227 - DNA, 1098 bp, Artificial Sequence
  Description of Artificial Sequence: Synthetic coding sequence
atggtggagaagatcctgatccaccgcatcctgaccctcttccccaatgccatcgccaggaagctgctgctgatgctgaccttcatcctgatcttctggatcatctacctggccagcaaggaccacaccaagttctccttcaacctggagaaccacatcatcctgaaccagggcaacatcttcaagaagtacagccacagcgagacccccctgtgcccagctgtgagccccaaggagacagagctgcgcatcaaggacatcatggagaagctggaccagcagatccccccccggcccttcacccacgtgaacaccaccaccagcgccacccacagcacagccaccatcctgaacccccaggacacctactgccgcggggaccagctggacatcctgctggaggtgcgggaccacctgggccacaggaagcagtatggaggagacttcctgcgggccaggatgtacagcacagccctgatggccggggccagcggcaaggtgacagacttcaacaacggcacctacctggtgtccttcaccctcttctgggagggccaggtgtccctgagcctgctgctgatccaccccagcgagggcgtgtctgccctgtggagggccaggaaccagggctgtgaccgcatcatcttcaccggcctgtttgccaacagaagcagcaatgtgttcacagaatgtggcctgaccctgaacaccaatgctgagctgtgccagtacatggatgaccgggaccaggaggccttctactgtgtgcggccccagcacatgccctgtgaggccctgacccacatgaccaccaggaccaggaacatctcctacctgagcaaggaggagtggaggctcttccacaggagcaacatcggcgtggagatgatgaagaacttcacccccattgaagtcatcccctgcccagccctcttctacttcatcttccgggacagcctgaccctgagcccccggctggagtgcagcggcatgatcagcgcccactgcaacctgtgcctgcccggcagcagtgacagcccagattctgccagccacgtggccggcatcacctctgtgcagaggcacacctggctgtag

SEQ ID NO: 34228 - DNA, 726 bp, Artificial Sequence
  Description of Artificial Sequence: Synthetic coding sequence
tgacagacagcccgctgccacagcggcctggtgtcctctgtgcaggccatcatggccagcacagctggctacatcgtgtccaccagctgcaagcacatcattgatgaccagcactggctgagcagcgcctacacccagtttgctgtgccctacttcatctatgacatctatgccatgttcctgtgccactggcacaagcaccaggtgaagggccacggcggagatgatggagctgcccgggcccctggcagcacctgggccatcgcccggggctacctgcacaaggagttcctgatggtgctgcaccacgccgccatggtgctggtgtgcttccccctgtctgtggtgtggaggcagggcaaaggagacttcttcctgggctgcatgctgatggccgaggtgtccaccccatttgtgtgcctgggcaagatcctgatccagtacaagcagcagcacaccctgctgcacaaggtgaatggagccctgatgctgctgtccttcctgtgctgccgggtgctgctcttcccctacctgtactgggcctacggcagacatgctggcctgcccctgctggccgtgcccctggccatcccagcccacgtgaacctgggcgccgccctgctgctggccccccagctgtactggttcttcctgatctgccgcggggcctgccgcctcttctggcccaggagcaggcctcctccagcctgccaggcccaggactag

SEQ ID NO: 34229 - DNA, 825 bp, Artificial Sequence
  Description of Artificial Sequence: Synthetic coding sequence
atgctgacccccatggtggccggcggcgtggtgtttcctggcctcttcctgctgagcaagaacaccctgcagaggctgccccagctgcgctgggaggaggctgatgctgtgattgtgtctgcccggctggtgtcctctgtgcaggccatcatggccagcacagctggctacatcgtgtccaccagctgcaagcacatcattgatgaccagcactggctgagcagcgcctacacccagtttgctgtgccctacttcatctatgacatctatgccatgttcctgtgccactggcacaagcaccaggtgaagggccatggaggagatgatggagctgcccgggcccctggcagcacctgggccatcgcccggggctacctgcacaaggagttcctgatggtgctgcaccacgccgccatggtgctggtgtgcttccccctgtctgtggtgtggaggcagggcaagggggacttcttcctgggctgcatgctgatggccgaggtgtccaccccatttgtgtgcctgggcaagatcctgatccagtacaagcagcagcacaccctgctgcacaaggtgaatggagccctgatgctgctgtccttcctgtgctgccgggtgctgctcttcccctacctgtactgggcctacggcagacatgctggcctgcccctgctggccgtgcccctggccatcccagcccacgtgaacctgggcgccgccctgctgctggccccccagctgtactggttcttcctgatctgccgcggggcctgccgcctcttctggcccaggagccggcccccaccagcctgccaggcccaggactag

SEQ ID NO: 34230 - DNA, 1287 bp, Artificial Sequence
  Description of Artificial Sequence: Synthetic coding sequence
atggcccggagcctgtgccctggggcctggctgaggaagccctactacctgcaggcccgcttctcctatgtgaggatgaagtacctgttcttctcctggctggtggtgtttgtgggctcctggatcatctacgtgcagtacagcacctacacagagctgtgccggggcaaggactgcaagaagatcatctgtgacaagtacaagacaggagtgattgatggccctgcctgcaacagcctgtgtgtgacagagaccctgtactttgggaagtgcctgagcaccaagcccaacaaccagatgtacctgggcatctgggacaacctgcccggggtggtgaagtgccagatggagcaggccctgcacctggactttggaacagagctggagcccaggaaggagatcgtgctgtttgacaagcccacccggggcaccaccgtgcagaagttcaaggagatggtgtacagcctcttcaaggccaagctgggggaccagggcaacctgtctgagctggtgaacctgatcctgactgtggctgatggagacaaggatggccaggtgtccctgggggaggccaagagcgcctgggccctgctgcagctgaatgagttcctgctgatggtgatcctgcaggacaaggagcacacccccaagctgatgggcttctgtggggacctgtatgtgatggagagcgtggagtacaccagcctgtatggcatcagcctgccctgggtgattgagctgttcatccccagcggcttccgccgctccatggaccagctgttcacccccagctggcccaggaaggccaagatcgccatcggcctgctggagtttgtggaggatgtgttccacggcccctacggcaacttcctgatgtgtgacaccagcgccaagaacctgggctacaatgacaagtatgacctgaagatggtggacatgaggaagatcgtgcctgagaccaacctgaaggagctgatcaaggacagacactgtgagagtgacctggactgtgtgtatggaacagactgcaggaccagctgtgaccagagcaccatgaagtgcaccagcgaggtgatccagcccaacctggccaaggcctgccagctgctgaaggactacctgctgcggggggcccccagcgagatccgggaggagctggagaagcagctgtacagctgcatcgccctgaaggtgacagccaaccagatggagatggagcacagcctcatcctgaacaacctgaagaccctgctgtggaagaagatctcctacaccaatgacagctag

SEQ ID NO: 34231 - DNA, 489 bp, Artificial Sequence
  Description of Artificial Sequence: Synthetic coding sequence
atggcccggagcctgtgccctggggcctggctgaggaagccctactacctgcaggcccgcttctcctatgtgaggatgaagtacctgttcttctcctggctggtggtgtttgtgggctcctggatcatctacgtgcagtacagcacctacacagagctgtgccggggcaaggactgcaagaagatcatctgtgacaagtacaagacaggagtgattgatggccctgcctgcaacagcctgtgtgtgacagagaccctgtactttgggaagtgcctgagcaccaagcccaacaaccagatgtacctgggcatctgggacaacctgcccggggtggtgaagtgccagatggagcaggccctgcacctggactttggaacagagctggagcccaggaaggagatcgtgctgtttgacaagcccacccggggcaccaccgtgcagaagttcaaggagatggtgtacagcctcttcaaggacagacacaggtag

SEQ ID NO: 34232 - DNA, 1035 bp, Artificial Sequence
  Description of Artificial Sequence: Synthetic coding sequence
atggtggagtggaggacctgcctgtctgtggcccctggccagcaggtgtacagcggcctgtggagggacaaggatgtgaccatcaagtgtggcatcgaggagaccctggacagcaaggcccggagtgatgctgccccccggcgggagctggtgctgtttgacaagcccacccggggcaccagcatcaaggagttccgggagatgaccctgtccttcctgaaggccaacctgggggacctgcccagcctgcctgccctggtgggccaggtgctgctgatggctgacttcaacaaggacaacagagtgtccctggccgaggccaagtctgtgtgggccctgctgcagagaaatgagttcctgctgctgctgagcctgcaggagaaggagcacgccagccggctgctgggctactgtggggacctgtacctgacagagggcgtgccccatggagcctggcacgccgccgccctgccccccctgctgcggcccctgctgcccccagccctgcagggcgccctgcagcagtggctgggccctgcctggccctggagggccaagatcgccatcggcctgctggagtttgtggaggagctgttccacggcagctatggcaccttctacatgtgtgagaccaccctggccaacgtgggctacacagccacctatgacttcaagatggctgacctgcagcaggtggcccctgaggccaccgtgcggcgcttcctgcagggcagaagatgtgagcacagcacagactgcacctacggccgggactgccgggccccctgtgaccggctgatgaggcagtgcaagggggacctgatccagcccaacctggccaaggtgtgtgccctgctgcggggctacctgctgcccggggccccagctgacctgcgggaggagctgggcacccagctgcggacctgcaccaccctgagcggcctggccagccaggtggaggcccaccacagcctggtgctgagccacctgaagaccctgctgtggaagaagatcagcaacaccaagtacagctag

SEQ ID NO: 34233 - DNA, 1296 bp, Artificial Sequence
  Description of Artificial Sequence: Synthetic coding sequence
atgaggcggctgcggcggctggcccacctggtgctcttctgccccttcagcaagaggctgcagggccgcctgcccggcctgcgggtgcgctgcatcttcctggcctggctgggcgtgtttgctggctcctggctggtgtatgtgcactacagcagctacagcgagcgctgccggggccacgtgtgccaggtggtgatctgtgaccagtacaggaagggcatcatcagcggctctgtgtgccaggacctgtgtgagctgcacatggtggagtggaggacctgcctgtctgtggcccctggccagcaggtgtacagcggcctgtggagggacaaggatgtgaccatcaagtgtggcatcgaggagaccctggacagcaaggcccggagtgatgctgccccccggcgggagctggtgctgtttgacaagcccacccggggcaccagcatcaaggagttccgggagatgaccctgtccttcctgaaggccaacctgggggacctgcccagcctgcctgccctggtgggccaggtgctgctgatggctgacttcaacaaggacaacagagtgtccctggccgaggccaagtctgtgtgggccctgctgcagagaaatgagttcctgctgctgctgagcctgcaggagaaggagcacgccagccggctgctgggctactgtggggacctgtacctgacagaaggagtgccccacggggcctggcatgctgctgccctgccccccctgctgcggcccctgctgcccccagccctgcagggcgccctgcagcagtggctgggccctgcctggccctggagggccaagatcgccatcggcctgctggagtttgtggaggagctgttccacggcagctatggcaccttctacatgtgtgagaccaccctggccaacgtgggctacacagccacctatgacttcaagatggctgacctgcagcaggtggcccctgaggccaccgtgcggcgcttcctgcagggccgccgctgtgagcacagcacagactgcacctacggccgggactgccgggccccctgtgaccggctgatgaggcagtgcaagggggacctgatccagcccaacctggccaaggtgtgtgccctgctgcggggctacctgctgcccggggccccagctgacctgcgggaggagctgggcacccagctgcggacctgcaccaccctgagcggcctggccagccaggtggaggcccaccacagcctggtgctgagccacctgaagaccctgctgtggaagaagatcagcaacaccaagtacagctag

SEQ ID NO: 34234 - DNA, 1260 bp, Artificial Sequence
  Description of Artificial Sequence: Synthetic coding sequence
atggcccgggctgctggggcccggggccctgctggctggtgcagaagaagaggccgctgtggccggggcaccctgctggcctttgctgcctggacagctggctgggtgctggccgccgccctgctgctgcgggcccaccctggggtgctgtctgagcgctgcacagatgagaagagccgccgcatcctggccgccctgtgccaggactaccagggcggcaccctggccggggacctgtgtgaggacctgtgtgtggccggggagctgctcttccagcgctgcctgcactacaacagaggcaagaaggtgctgcaggccgactggaggggccggcctgtggtgctgaagagcaaggaggaggccttcagcagcttcccccccctgagcctgctggaggaggaggccggggagggcggccaggacatgcctgaggccgagctgctgctgatggtggccggggaggtgaagagcgccctgggcctggagctgagcaacagcagcctgggcccctggtggccaggaagaagaggcccccgctggaggggccagctggccagcctgtgggccctgctgcagcaggaggagtatgtgtacttcagcctgctgcaggacctgagcccccacgtgctgcctgtgctgggcagctgtggccacttctatgctgtggagttcctggccgccggcagcccccaccaccgggccctcttccccctggaccgggcccctggggcccctgggggcggccaggccaaggccatcagtgacatcgccctgtccttcctggacatggtgaaccactttgacagcgacttcagccaccggctgcacctgtgtgacatcaagccagaaaattttgccatccgcagtgacttcaccgtggtggccattgatgtggacatggccttctttgagcccaagatgagggagatcctggagcagaactgcacaggagatgaggactgcaacttctttgactgcttcagccgctgtgacctgcgggtgaacaagtgtggggcccagagggtgaacaacaacctgcaggtgatctgtgacaagatcttccgccactggttcagcgcccccctgaagagcagcgctgtgtccttccagctgcagctgcagctgcaggaggccgtgcaggagtgtgccgaccccggggtgcccagcggcaacaccaggagagctgccagcagcgtcttctggaagctgcggcagctgctgcaggccaccctgcgggagctgcaggaggccgagaagtag

SEQ ID NO: 34235 - DNA, 1050 bp, Artificial Sequence
  Description of Artificial Sequence: Synthetic coding sequence
atgcaccagagcctgacccagcagaggagcagtgacatgagcctgcctgacagcatgggcgccttcaacagaaggaagagaaattccatctacgtgacagtgaccctgctgattgtgtctgtgctgatcctgactgtgggcctggccgccaccaccaggacccagaatgtgacagtgggcggctactacccaggagtcatcctgggcttcggcagcttcctgggcatcatcggcagcaacctgattgagaacaagaggcagatgctggtggccagcatcgtgttcatcagctttggagtgattgctgccttctgctgtgccatcgtggatggagtgtttgctgcccggcacatcgacctgaagcccctgtatgccaaccgctgccactacgtgcccaagaccagccagaaggaggccgaggaggtgatcagcagcagcaccaagaacagccccagcaccagggtgatgaggaacctgacccaggccgcccgggaggtgaactgcccccacctgagccgggagttctgcaccccccgcatccggggcaacacctgcttctgctgtgacctgtacaactgtggcaacagagtggagatcaccggcggctactatgagtacattgatgtgagcagctgccaggacatcatccacctgtaccacctgctgtggagcgccaccatcctgaacatcgtgggcctcttcctgggcatcatcacagctgctgtgctgggcggcttcaaggacatgaaccccaccctgcctgccctgaactgcagcgtggagaacacccaccccaccgtgtcctactatgcccacccccaggtggccagctacaacacctactaccacagccccccccacctgcccccctacagcgcctatgacttccagcacagcggggtcttccccagcagcccccccagcggcctgagtgatgagccccagagcgccagccccagccccagctacatgtggagcagcagcgccccaccccgctacagccccccctactaccccccatttgagaagcccccaccctacagcccctag

SEQ ID NO: 34236 - DNA, 558 bp, Artificial Sequence
  Description of Artificial Sequence: Synthetic coding sequence
atggtgaactgcccccacctgagccgggagttctgcaccccccgcatccggggcaacacctgcttctgctgtgacctgtacaactgtggcaacagagtggagatcaccggcggctactatgagtacattgatgtgagcagctgccaggacatcatccacctgtaccacctgctgtggagcgccaccatcctgaacatcgtgggcctcttcctgggcatcatcacagctgctgtgctgggcggcttcaaggacatgaaccccaccctgcctgccctgaactgcagcgtggagaacacccaccccaccgtgtcctactatgcccacccccaggtggccagctacaacacctactaccacagccccccccacctgcccccctacagcgcctatgacttccagcacagcggggtcttccccagcagcccccccagcggcctgagtgatgagccccagagcgccagccccagccccagctacatgtggagcagcagcgccccaccccgctacagccccccctactaccccccatttgagaagcccccaccctacagcccctag

SEQ ID NO: 34237 - DNA, 978 bp, Artificial Sequence
  Description of Artificial Sequence: Synthetic coding sequence
atgcaccagagcctgacccagcagaggagcagtgacatgagcctgcctgacagcatgggcgccttcaacagaaggaagagaaattccatctacgtgacagtgaccctgctgattgtgtctgtgctgatcctgactgtgggcctggccgccaccaccaggacccagaatgtgacagtgggcggctactacccaggagtcatcctgggcttcggcagcttcctgggcatcatcggcagcaacctgattgagaacaagaggcagatgctggtggccagcatcgtgttcatcagctttggagtgattgctgccttctgctgtgccatcgtggatggagtgtttgctgcccggcacatcgacctgaagcccctgtatgccaaccgctgccactacgtgcccaagaccagccagaaggaggccgaggaggtgaactgcccccacctgagccgggagttctgcaccccccgcatccggggcaacacctgcttctgctgtgacctgtacaactgtggcaacagagtggagatcaccggcggctactatgagtacattgatgtgagcagctgccaggacatcatccacctgtaccacctgctgtggagcgccaccatcctgaacatcgtgggcctcttcctgggcatcatcacagctgctgtgctgggcggcttcaaggacatgaaccccaccctgcctgccctgaactgcagcgtggagaacacccaccccaccgtgtcctactatgcccacccccaggtggccagctacaacacctactaccacagccccccccacctgcccccctacagcgcctatgacttccagcacagcggggtcttccccagcagcccccccagcggcctgagtgatgagccccagagcgccagccccagccccagctacatgtggagcagcagcgccccaccccgctacagccccccctactaccccccatttgagaagcccccaccctacagcccctag

SEQ ID NO: 34238 - DNA, 726 bp, Artificial Sequence
  Description of Artificial Sequence: Synthetic coding sequence
atgcaccagagcctgacccagcagaggagcagtgacatgagcctgcctgacagcatgggcgccttcaacagaaggaagagaaattccatctacgtgacagtgaccctgctgattgtgtctgtgctgatcctgactgtgggcctggccgccaccaccaggacccagaatgtgacagtgggcggctactacccaggagtcatcctgggcttcggcagcttcctgggcatcatcggcagcaacctgattgagaacaagaggcagatgctggtggccagcatcgtgttcatcagctttggagtgattgctgccttctgctgtgccatcgtggatggagtgtttgctgcccggcacatcgacctgaagcccctgtatgccaaccgctgccactacgtgcccaagaccagccagaaggaggccgaggagaaccccaccctgcctgccctgaactgcagcgtggagaacacccaccccaccgtgtcctactatgcccacccccaggtggccagctacaacacctactaccacagccccccccacctgcccccctacagcgcctatgacttccagcacagcggggtcttccccagcagcccccccagcggcctgagtgatgagccccagagcgccagccccagccccagctacatgtggagcagcagcgccccaccccgctacagccccccctactaccccccatttgagaagcccccaccctacagcccctag

SEQ ID NO: 34239 - DNA, 981 bp, Artificial Sequence
  Description of Artificial Sequence: Synthetic coding sequence
atgcagccccctgtgcccggccccctgggcctgctggaccctgctgagggcctgagcaggaggaagaagaccagcctgtggtttgtgggcagcctgctgctggtgtctgtgctgattgtgacagtgggcctggccgccaccaccaggacagaaaatgtgacagtgggcggctactacccaggcatcatcctgggcttcggcagcttcctgggcatcatcggcatcaacctggtggagaacagacggcagatgctggtggccgccatcgtgttcatcagctttggagtggtggccgccttctgctgtgccatcgtggatggagtgtttgctgcccagcacatcgagccccggcccctgaccaccggccgctgccagttctacagcagtggagtgggctacctgtatgatgtgtaccagacagaggtgacctgccacagcctggatggcaagtgccagctgaaggtgcgcagcaacacctgctactgctgtgacctgtatgcctgtggcagcgctgagcccagccctgcctactatgagttcatcggcgtgtctggctgccaggatgtgctgcacctgtaccgcctgctgtgggccagcgctgtgctgaatgtgctgggcctcttcctgggcatcatcacagctgctgtgctgggcgccttcaaggacatggtgcccctgagccagctggcctacggccctgctgtgcccccccagaccctgtacaacccagcccagcagatcctggcctatgccggcttccggctgaccccagagcctgtgcccacctgcagcagctaccccctgcccctgcagccctgcagccgcttccctgtggcccccagcagcgccctggccagcagcgaggacctgcagccccccagccccagcagcagcggcagcggcctgcccggccaggccccaccctgctacgcccccacctacttccccccaggagagaagcccccaccctatgccccctag

SEQ ID NO: 34240 - DNA, 1899 bp, Artificial Sequence
  Description of Artificial Sequence: Synthetic coding sequence
atgtctgactgctgcagcgcccctggcatctcctgggaggccggcgtgggccggcctgctgtgcccggcctggagctgcagatcagaagaggagccatgtctgaggagaccgtgtctgagagccagttcagcctgaagacagctgccctgcgggtgtttgacctgcccctgacctggtactacagcctgagccagatcaagttcagccctgtggccaagaagctgtttgtggtgacagctgtgtctgccatcagcgtcatcttcctggcccaccacttcaagaggaagaggggcaagaagaagggcaagatcctgccctgggagcctgagcacctgatcctggagtacaccaagagagctgccagtgacaagggcagcagctgcagcagcagccggcagaacctgaccctgagcctgagcagcaccaaggacaagggcagccaggtgtgcaactatgccaacggcggcctcttcagcaagtacagcggcagcgcccagagcctggcctctgtgcagagcgtgaacagctgccacagctgtgcctgtggcaacagcaacagctgggacaaggcagatgaagatgacatcaagctggtgaacatccctgtgaccaccccagaaaatctctacctgatgggcatggagctgtttgaggaggccctgcggcgctgggagcaggccctgaccttcaggaaccggcaggccgaggatgaggcctgtggcagcatcaagctgggcgctggagatgccatcgccgaggagaatgtggatgacatcatcagcacagagttcatccacaagctggaggccctgctgcagagggcctaccgcctgcaggaggagtttgaggccaccctgggcgccagtgaccccaacagcctggctgatgacatcgacaaggacacagacatcaccatgaagggaaatgtggaggactttggcctgcgggacaccctgagcatcgccagcacagacagctttgccagcgctgctgagctggccgagcaccgggaggtgcgccacacctacagcctggagagcctgtgccactgccccttctatgaggaggccatgcacctggtggaggagggcaagatctacagccgggtgctgaggacagagatgctggagtgcctgggggacagcgacttcctggccaagctgcactgcatccggcaggccttccaggtgatcctgtctgagagcgccaaccgcatcttcctggccgagagcggcaggaagatcctgagcgccctgattgtgaaggccaggaagaaccccaagaagtttgaagatgtgtttgatgagatgatctacttcctggagcagacagaccactggggcagcacagagatggagctggccgcccggggcgtgaagaacctgaacttctatgatgtggtgctggacttcatcctgatggacagctttgaggacctggagaacccccccaccagcatccagaatgtggtgaacaaccgctggctgaacagcagcttcaaggagacagctgtggccagcagctgctggagcgtgctgaagcagaagaggcagcagatgaagatcccagatggcttctttgcccacttctacgccatctgtgagcacatcagccctgtgctggcctggggcttcctgggccccaggaacagcctgtatgacctgtgctgcttcttcaagaaccaggtgctgctcttcctgaaggacatctttgattttgagaaggtgcgctacagcagcacagagaccctggccgaggacctgatgcagctgctgatccggaggacagagctgctgatggcctacctggaggctgatgccctgcggcacaccagcagctgcctgagcagccacggccacgtgatgagcacaggcctgctggaggccaaggtgcagtag

SEQ ID NO: 34241 - DNA, 1788 bp, Artificial Sequence
  Description of Artificial Sequence: Synthetic coding sequence
atgtctgactgctgcagcgcccctggcatctcctgggaggccggcgtgggccggcctgctgtgcccggcctggagctgcagatcaagttcagccctgtggccaagaagctgtttgtggtgacagctgtgtctgccatcagcgtcatcttcctggcccaccacttcaagaggaagaggggcaagaagaagggcaagatcctgccctgggagcctgagcacctgatcctggagtacaccaagagagctgccagtgacaagggcagcagctgcagcagcagccggcagaacctgaccctgagcctgagcagcaccaaggacaagggcagccaggtgtgcaactatgccaacggcggcctcttcagcaagtacagcggcagcgcccagagcctggcctctgtgcagagcgtgaacagctgccacagctgtgcctgtggcaacagcaacagctgggacaaggcagatgaagatgacatcaagctggtgaacatccctgtgaccaccccagaaaatctctacctgatgggcatggagctgtttgaggaggccctgcggcgctgggagcaggccctgaccttcaggaaccggcaggccgaggatgaggcctgtggcagcatcaagctgggcgctggagatgccatcgccgaggagaatgtggatgacatcatcagcacagagttcatccacaagctggaggccctgctgcagagggcctaccgcctgcaggaggagtttgaggccaccctgggcgccagtgaccccaacagcctggctgatgacatcgacaaggacacagacatcaccatgaagggaaatgtggaggactttggcctgcgggacaccctgagcatcgccagcacagacagctttgccagcgctgctgagctggccgagcaccgggaggtgcgccacacctacagcctggagagcctgtgccactgccccttctatgaggaggccatgcacctggtggaggagggcaagatctacagccgggtgctgaggacagagatgctggagtgcctgggggacagcgacttcctggccaagctgcactgcatccggcaggccttccaggtgatcctgtctgagagcgccaaccgcatcttcctggccgagagcggcaggaagatcctgagcgccctgattgtgaaggccaggaagaaccccaagaagtttgaagatgtgtttgatgagatgatctacttcctggagcagacagaccactggggcagcacagagatggagctggccgcccggggcgtgaagaacctgaacttctatgatgtggtgctggacttcatcctgatggacagctttgaggacctggagaacccccccaccagcatccagaatgtggtgaacaaccgctggctgaacagcagcttcaaggagacagctgtggccagcagctgctggagcgtgctgaagcagaagaggcagcagatgaagcagatcccagatggcttctttgcccacttctacgccatctgtgagcacatcagccctgtgctggcctggggcttcctgggccccaggaacagcctgtatgacctgtgctgcttcttcaagaaccaggtgctgctcttcctgaaggacatctttgattttgagaaggtgcgctacagcagcacagagaccctggccgaggacctgatgcagctgctgatcagaagaacagagctgctgatggcctacctggaggctgatgccctgcggcacaccagcagctgcctgagcagccacggccacgtgatgagcacaggcctgctggaggccaaggtgcagtag

SEQ ID NO: 34242 - DNA, 972 bp, Artificial Sequence
  Description of Artificial Sequence: Synthetic coding sequence
atggccttccggcgggcagagggcacctccatgatccaggccctggccatgacagtggccgagatccctgtgttcctgtacaccaccttcggccagagcgccttcagccagctgcggctgaccccaggcctgaggaaggtgctgtttgccacagccctgggcaccgtggccctggccctggccgcccaccagctgaagagaagaagaagaaggaagaagcaggtgggccctgagatgggcggggagcagctgggcaccgtgcccctgcccatcctgctggccaggaaggtgcccagcgtgaagaagggctacagcagcagaagagtgcagagccccagcagcaagagcaatgacaccctgagcggcatcagcagcattgagcccagcaagcacagcggcagcagccacagcgtggcctccatgatggctgtgaacagcagcagccccacagctgcctgcagcggcctgtgggatgcccggggcatggaggagagcctgaccaccagtgatggaaatgctgagagcctgtacatgcagggcatggagctgtttgaggaggccctgcagaagtgggagcaggccctgtctgtgggccagagaggagacagcggcagcacccccatgcccagagatggcctgaggaaccctgagacagccagcgagcccctgtctgaaacagagagccacagcgtggcccggctggagtgcagcggggccatcagcgcccagtgcaacctgcgcttcctgggcagccgggacagccctgccagcgccagccaggtggccggcatcacagcccgggtgacagctgagggcgtgtgccgggaggccggcgtgcctgctgccccctgcctgcccccagctgggggcgtgcggctgcacctgccccggcggcagcacgccgcccggccccgggaggacccccacgccgccccagaccggggcctggccgctgctgctgggggccgctag

SEQ ID NO: 34243 - DNA, 1782 bp, Artificial Sequence
  Description of Artificial Sequence: Synthetic coding sequence
atggccttccggcgggcagagggcacctccatgatccaggccctggccatgacagtggccgagatccctgtgttcctgtacaccaccttcggccagagcgccttcagccagctgcggctgaccccaggcctgaggaaggtgctgtttgccacagccctgggcaccgtggccctggccctggccgcccaccagctgaagagaagaagaagaaggaagaagcaggtgggccctgagatgggcggggagcagctgggcaccgtgcccctgcccatcctgctggccaggaaggtgcccagcgtgaagaagggctacagcagcagaagagtgcagagccccagcagcaagagcaatgacaccctgagcggcatcagcagcattgagcccagcaagcacagcggcagcagccacagcgtggcctccatgatggctgtgaacagcagcagccccacagctgcctgcagcggcctgtgggatgcccggggcatggaggagagcctgaccaccagtgatggaaatgctgagagcctgtacatgcagggcatggagctgtttgaggaggccctgcagaagtgggagcaggccctgtctgtgggccagagaggagacagcggcagcacccccatgcccagagatggcctgaggaaccctgagacagccagcgagcccctgtctgagcctgagagccagaggaaggagtttgctgagaagctggagagcctgctgcaccgggcctaccacctgcaggaggagtttggcagcaccttccctgctgacagcatgctgctggacctggagaggaccctgatgctgcccctgacagagggcagcctgcggctgcgggcagatgatgaggacagcctgaccagcgaggacagcttcttcagcgccacagagctgtttgagagcctgcagacaggagactaccccatccccctgagcaggcctgctgctgcctatgaggaggccctgcagctggtgaaggagggccgggtgccctgcaggaccctgaggacagagctgctgggctgctacagcgaccaggacttcctggccaagctgcactgtgtgcggcaggcctttgagggcctgctggaggacaagagcaaccagctgttcttcggcaaggtgggccggcagatggtgacaggcctgatgaccaaggccgagaagagccccaagggcttcctggagagctatgaggagatgctgtcctatgccctgcggcctgagacctgggccaccacccggctggagctggagggccggggcgtggtgtgcatgtccttctttgacatcgtgctggacttcatcctgatggatgcctttgaggacctggagaaccccccagcctctgtgctggccgtgctgaggaaccgctggctgagtgacagcttcaaggagacagccctggccacagcctgctggagcgtgctgaaggccaagaggcggctgctgatggtgcctgatggcttcatcagccacttctacagcgtgtctgaacatgtgtcccctgtgctggccttcggcttcctgggccccaagccccagctggccgaggtgtgtgccttcttcaagcaccagatcgtgcagtacctgcgggacatgtttgacctggacaacgtgcgctacaccagcctgcctgccctggctgatgacatcctgcagctgagcagaagaagaagtgagatcctgctgggctacctgggcgtgcctgctgccagcagcgctggggtgaatggagccctgcccagagaaaatggccccctgggggagctgcagtag

SEQ ID NO: 34244 - DNA, 1050 bp, Artificial Sequence
  Description of Artificial Sequence: Synthetic coding sequence
atggccttccggcgggcagagggcacctccatgatccaggccctggccatgacagtggccgagatccctgtgttcctgtacaccaccttcggccagagcgccttcagccagctgcggctgaccccaggcctgaggaaggtgctgtttgccacagccctgggcaccgtggccctggccctggccgcccaccagctgaagagaagaagaagaaggaagaagcaggtgggccctgagatgggcggggagcagctgggcaccgtgcccctgcccatcctgctggccaggaaggtgcccagcgtgaagaagggctacagcagcagaagagtgcagagccccagcagcaagagcaatgacaccctgagcggcatcagcagcattgagcccagcaagcacagcggcagcagccacagcgtggcctccatgatggctgtgaacagcagcagccccacagctgcctgcagcggcctgtgggatgcccggggcatggaggagagcctgaccaccagtgatggaaatgctgagagcctgtacatgcagggcatggagctgtttgaggaggccctgcagaagtgggagcaggccctgtctgtgggccagagaggagacagcggcagcacccccatgcccagagatggcctgaggaaccctgagacagccagcgagcccctgtctgagcctgagagccagaggaaggagtttgctgagaagctggagagcctgctgcaccgggcctaccacctgcaggaggagtttggcagcaccttccctgctgacagcatgctgctggacctggagaggaccctgatgctgcccctgacagagggcagcctgcggctgcgggcagatgatgaggacagcctgaccagcgaggacagcttcttcagcgccacagagctgtttgagagcctgcagacaggagactaccccatccccctgagcaggcctgctgctgcctatgaggaggccctgcagctggtgaaggagggccgggtgccctgcaggaccctgcgggcccccaaggcctcctggagggccacccggcgctgctag

SEQ ID NO: 34245 - DNA, 303 bp, Artificial Sequence
  Description of Artificial Sequence: Synthetic coding sequence
atggccttccggcgggcagagggcacctccatgatccaggccctggccatgacagtggccgagatccctgtgttcctgtacaccaccttcggccagagcgccttcagccagctgcggctgaccccaggcctgaggaaggtgctgtttgccacagccctgggcaccgtggccctggccctggccgcccaccagctgaagagaagaagaagaaggaagaagcaggtgggccctgagatgggcggggagcagctgggcaccgtgcccctgcccatcctgctggccaggaaggtgcccagcgtgtag

SEQ ID NO: 34246 - DNA, 384 bp, Artificial Sequence
  Description of Artificial Sequence: Synthetic coding sequence
atgtggagggagctgcggggctgccctggaggagatgtggagacagcccagaggctgagccagaggagaagaggcaagagcagcgaggccgtgcctgagaagacctggagggcccagaggatgagccagaggagaagaggagagagcagcgaggccgtgcctgagaagacctggaaggagctgaggaacagcgagaccgtgcctgagaagacctggaagcagctgcggcgctgcctgcaggaggatgtggagcgggtgcagaggctgagcctgctgctgcacctggccgtgttcctgtggatcatcatcgccatcaacttcagcaacagcggcgtgaagagccagagcagcacctacctgcccagcggcaagatcctgaagtag

SEQ ID NO: 34247 - DNA, 384 bp, Artificial Sequence; identical to SEQ ID NO: 34246
  Description of Artificial Sequence: Synthetic coding sequence

SEQ ID NO: 34248 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccgctgtgatgacccccccagccccagccctgggaagaggaaatgtcctgtgggcagaagaagaagaccccggggccgcatgaagaaccacagcctgcgggccggccgggagtgcccccggggcctgcaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagccccccaccacccaagggcttcaccgccccacccctgcgggacagcaccctcatcacccccagccactgtgacagcgtggccctgcccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctaccagatggaggccggcagcctcttcctgctgagcagtgatggccagaatgctgtgggcatccaggtgacagaaacagccaaggtgaacatctgggaggagaaggaaaatgtgggcagcttcacagacaggatgaccccagagaagcacctgaacagcctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagccccccagccacctgggccctgagtgccagcccttcatcagcagcaccccccagttccggcccacccccatggcccaggccgaggcccaggcccacctgcagagcagcttccctgtgctgagccctgccttccccagcctcatcaagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagagcgagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacggccccctgaagcccccacctgctggccaggagggccgctggcccagcaagcccctgacctacagcctgaccggcagcacccagcagagccgcagcctgggcgcccagagcagcaaggccggggagacccgggaggccgtgccccagtgccgggtgcccctggagacctgcatgctggccaacctgcaggccaccagcgaggacatgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcctgctggcaacatgagggccagccaggagctgcatgacctgatggccgcccggcgcagcaagctggtgcatgaggagcccaggaaccccaactgccagggcagctgcaagaaccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagccactttggaggcaacatcaagcagttcttccagtggatcttcagcaagaagaagagcaagccagcccctgtgacagctgagagccagaagacagtgaagaacagaagctgtgtgtacagcagcagcgctgaggcccagggcctgatgacagctgtgggccagatgctggatgagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccctgcagcactggcccaagaccagcggggccagcagccaccaccaccactgccccaggcactgcctgctgtgggagggcatctag

SEQ ID NO: 34249 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccgctgtgatgacccccccagccccagccctgggaagaggaaatgtcctgtgggcagaagaagaagaccccggggccgcatgaagaaccacagcctgcgggccggccgggagtgccggcggggcctgcaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagccccccaccacccaagggcttcaccgccccacccctgcgggacagcaccctcatcacccccagccactgtgacagcgtggccctgcccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctaccagatggaggccggcagcctcttcctgctgagcagtgatggccagaatgctgtgggcatccaggtgacagaaacagccaaggtgaacatctgggaggagaaggaaaatgtgggcagcttcacagacaggatgaccccagagaagcacctgaacagcctgaggaacctggccaagagcctggatgctgagcaggacaccaccaaccccaagcccttctggaacatgggagagaacagcaagcagctgcccggcccccagaagttcagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagccccccagccacctgggccctgagtgccagcccttcatcagcagcaccccccagttccggcccacccccatggcccaggccgaggcccaggcccacctgcagagcagcttccctgtgctgagccctgccttccccagcctcatcaagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagagcgagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacggccccctgaagcccccacctgctggccaggagggccgctggcccagcaagcccctgacctacagcctgaccggcagcacccagcagagccgcagcctgggcgcccagagcagcaaggccggggagacccgggaggccgtgccccagtgccgggtgcccctggagacctgcatgctggccaacctgcaggccaccagcgaggacatgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagccactttggaggcaacatcaagcagttcttccagtggatcttcagcaagaagaagagcaagccagcccctgtgacagctgagagccagaagacagtgaagaacagaagctgtgtgtacagcagcagcgctgaggcccagggcctgatgacagctgtgggccagatgctggatgagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccctgcagcactggcccaagaccagcggggccagcagccaccaccaccactgccccaggcactgcctgctgtgggagggcatctag

SEQ ID NO: 34250 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccgctgtgatgacccccccagccccagccctgggaagaggaaatgtcctgtgggcagaagaagaagaccccggggccgcatgaagaaccacagcctgcgggccggccgggagtgccggcggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagcctgctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagcctgcccccacccaagggcttcaccgccccacccctgcgggacagcaccctcatcacccccagccactgtgacagcgtggccctgcccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaacaggatgaccccagagaagcacctgaacagcctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccacctgggccctgagtgccagcccttcatcagcagcaccccccagttccggcccacccccatggcccaggccgaggcccaggcccacctgcagagcagcttccctgtgctgagccctgccttccccagcctcatccagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgcaggatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagctggagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacgagcccctgaagcccccacctgctggccaggagggccgctggcccagcaagcccctgacctacagcctgaccggcagcacccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgtctgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaagcccaactgccagggcagctgcaagagccagaggcccatgtttcctcccatccacaagtctgagaagttcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagcccctttggagagaacatcaagcagatcttccagtggatcttcagcaagaagaagagcaagccagcccctgtgacagctgagagccagaagacagtgaagaacagaagctgtgtgtacagcagcagcgctgaggcccagggcctgatgacagctgtgggccagatgctggatgagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34251 - DNA, 4074 bp, Artificial Sequence
  Description of Artificial Sequence: Synthetic coding sequence
tgactgctggagagcaatgcccccatccacatggagaacctgcccttccccctgaagctgctgagcgccagcagcctgaatgcccccagcagcaccccctgggtgctggacatcttcctgaccctggtgtttgccctgggcttcttctttgtgctgctgccctacctgagctacttccgctgtgatgacccccccagccccagccctgggaagaggaaatgtcctgtgggcagaagaagaagaccccggggccgcatgaagaaccacagcctgcgggccggccgggagtgccggcggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagcctgcccccacccaagggcttcaccgccccacccctgcgggacagcaccctcatcacccccagccactgtgacagcgtggccttccccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaacaggatgaccccagagaagcacctgaacagcctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccacctgggccctgagtgccagcccttcatcagcagcaccccccagttccggcccacccccatggcccaggccgaggcccaggcccacctgcagagcagcttccctgtgctgagccctgccttccccagcctcatccagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagctggagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacgagcccctgaagcccccacctgctggccaggagggccgctggcccagcaagcccctgacctacagcctgaccggcagcatccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagcccctttggagagaacatcaagcagatcttccagtggatcttcagcaagaagaagagcaagccagcccctgtgacagctgagagccagaagacagtgaagaacagaagccgggtgtacagcagcagcgctgaggcccagggcctgatgacagctgtgggccagatgctggacaagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34252 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttctttgtgctgctgccctacctgagctacttccgctgtgatgacccccccagccccagccctgggaagaggaaatgtcctgtgggcagaagaagaagaccccggggccgcatgaagaaccacagcctgcgggccggccgggagtgccggcggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagcctgcccccacccaagggcttcaccgccccacccctgcgggacagcaccctcatcacccccagccactgtgacagcgtggccttccccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaacaggatgaccccagagaagcacctgaacagcctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccacctgggccctgagtgccagcccttcatcagcagcaccccccagttccggcccacccccatggcccaggccgaggcccaggcccacctgcagagcagcttccctgtgctgagccctgccttccccagcctcatccagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagctggagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacgagcccctgaagcccccacctgctggccaggagggccgctggcccagcaagcccctgacctacagcctgaccggcagcatccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagcccctttggagagaacatcaagcagatcttccagtggatcttcagcaagaagaagagcaagccagcccctgtgacagctgagagccagaagacagtgaagaacagaagccgggtgtacagcagcagcgctgaggcccagggcctgatgacagctgtgggccagatgctggacaagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34253 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccgctgtgatgacccccccagccccagccctgggaagaggaaatgtcctgtgggcagaagaagaagaccccggggccgcatgaagaaccacagcctgcgggccggccgggagtgccggcggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagcctgcccccacccaagggcttcaccgccccacccctgcgggacagcaccctcatcacccccagccactgtgacagcgtggccttccccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaacaggatgaccccagagaagcacctgaacagcctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccacctgggccctgagtgccagcccttcatcagcagcaccccccagttccggcccacccccatggcccaggccgaggcccaggcccacctgcagagcagcttccctgtgctgagccctgccttccccagcctcatccagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagggcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagctggagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgtgtgtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacgagcccctgaagcccccacctgctggccaggagggccgctggcccagcaagcccctgacctacagcctgaccggcagcatccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagcccctttggagagaacatcaagcagatcttccagtggatcttcagcaagaagaagagcaagccagcccctgtgacagctgagagccagaagacagtgaagaacagaagccgggtgtacagcagcagcgctgaggcccagggcctgatgacagctgtgggccagatgctggatgagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34254 - DNA, 4032 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccactgtgatgacccccccagccccagccctgggaagaggaaatgtcctgtgggcagaagaagaagaccccggggccgcatgaagaaccacagcctgcgggccggccgggagtgcccccggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagccccccaccacccaagggcttcaccgccccacccctgcgggacagcaccctcatcacccccagccactgtgacagcgtggccctgcccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccccctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaaccagatgaccccagagaagcacctgaacagcctgggcaacctggccaagagcctggatgctgagcaggacaccaccaaccccaagcccttctggaacatgggagagaacagcaagcagctgcccggcccccagaagtgcagcgacccccggctgctgcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccaccggcagcccttcatcagcagcaccccccagttcctgcccacccccatggcccaggccgaggcccaggcccacctgcagagcagcttccctgtgctgagccctgccttccccagcctcatcaagaacacaggagtggcctgcccagccagccagaacaaggtgcaggccctgagcctgcctgagacccagcaccctgagtggcccctgctgaggaagcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagcagcaccagcactggagagagcagcaaggaggcccagaaggtgaagttccagctggagcgggacctgtgcccccacctgggccagatcctgggggagaccccccagaacctgagccgggacatgaagagcttccccaggaaggtgctgggcgtgaccagcgaggagagcgagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgcgggtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacggccccctgaagcccccacctgctggccaggagggccgctggcccagcaagcccctgacctacagcctgaccggcagcacccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgtctgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcaggaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagccactttggagagaacatcaagcagttcttccagtggatcttcagcaagaagaagagcaagccagcccctgtgacagctgagagccagaagacagtgaagaacagaagctgtgtgtacagcagcagcgctgaggcccagggcctgatgacagctgtgggccagatgctggacaagaagatgagcctgtgccacgcccaccacgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34255 - DNA, 4044 bp, Artificial Sequence
  Description of Artificial Sequence: Synthetic coding sequence
atggagaacctgcccttccccctgaagctgctgagcgccagcagcctgaatgcccccagcagcaccccctgggtgctggacatcttcctgaccctggtgtttgccctgggcttcttcttcctgctgctgccctacctgagctacttccgctgtgatgacccccccagccccagccctgggaagaggaaatgtcctgtgggcagaagaagaagaccccggggccgcatgaagaaccacagcctgcgggccggccgggagtgcccccggggcctggaggagaccagtgacctgctgagccagctgcagagcctgctgggcccccacctggacaagggggactttggccagctgagcggccctgaccccccaggagaggtgggggagcgggccccagatggagccagccagagcagccatgagcccatggaggatgctgcccccatcctgagccccctggccagcccagacccccaggccaagcacccccaggacctggccagcacccccagccctggccccatgaccacctctgtgagcagcctgagcgccagccagcccccagagcccagcctgcccctggagcaccccagccctgagcccccagccctcttcccccaccccccccacaccccagaccccctggcctgcagcctgcccccacccaagggcttcaccgccccacccctgcgggacagcaccctcatcacccccagccactgtgacagcgtggccttccccctgggcaccgtgccccagagcctgagcccccatgaggacctggtggcctctgtgcctgccatcagcggcctgggcggcagcaacagccacgtgtctgccagcagccgctggcaggagacagcccggaccagctgtgccttcaacagctctgtgcagcaggaccacctgagccgccaccccccagagacctgccagatggaggccggcagcctcttcctgctgagcagtgatggccagaatgtggtgggcatccaggtgacagaaacagccaaggtgaacatctgggaggagaaggaaaatgtgggcagcttcaccaacaggatgaccccagagaagcacctgaactacctgaggaacctggccaagagcctggatgctgagcaggacaccaccaaccccaagcccttctggaacatgggagagaacagcaagcagctgcccggcccccagaagctgagtgacccccggctgtggcaggagagcttctggaagaactacagccagctgttctggggcctgcccagcctgcacagcgagagcctggtggccaatgcctgggtgacagacaggagctacaccctgcagagcccccccttcctgttcaatgagatgagcaatgtgtgccccatccagcgggagaccaccatgagccccctgctcttccaggcccagcccctgagccacctgggccctgagtgccagcccttcatcagcagcaccccccagttccggcccacccccatggcccaggccgaggcccaggcccacctgcagagcagcttccctgtgctgagccctgccttccccagcctcatccagaacacaggagtggcctgcccagccagccagaacaaggtgcaggccctgagcctgcctgagacccagcaccctgagtggcccctgctgcggcggcagctggagggccgcctggccctgcccagccgggtgcagaagagccaggatgtgttttctgtgtccacccccaacctgccccaggagagcctgaccagcatcctgcctgagaacttccctgtgtccccagagctgcggcggcagctggagcagcacatcaagaagtggatcatccagcactggggcaacctgggccgcatccaggagagcctggacctgatgcagctgagagatgagagccctggcaccagccaggccaagggcaagcccagcccctggcagagctccatgagcactggagagagcagcaaggaggcccagaaggtgaagttccagctggagcgggacccctgcccccacctgggccagatcctgggggagaccccccagaacctgagccgggacatgaagagcttccccaggaaggtgctgggcgtgaccagcgaggagctggagaggaacctgaggaagcccctgcggagtgacagcggcagtgacctgctgcgctgcacagagaggacccacatcgagaacatcctgaaggcccacatgggcaggaacctgggccagaccaatgaaggcctcatccctgtgtgtgtgagaagatcctggctggccgtgaaccaggccctgcctgtgagcaacacccacgtgaagaccagcaacctggccgcccccaagagcggcaaggcctgtgtgaacacagcccaggtgctgtccttcctggagccctgcacccagcagggcctgggcgcccacatcgtgcgcttctgggccaagcaccgctggggcctgcccctgcgggtgctgaagcccatccagtgcttcaagctggagaaggtgagcagcctgagcctgacccagctggccggccccagcagcgccacctgtgagagcggggccggcagcgaggtggaggtggacatgttcctgaggaagccacccatggccagcctgaggaagcaggtgctgaccaaggccagtgaccacatgcctgagagcctgctggccagcagccctgcctggaagcagttccagagggccccccggggcatccccagctggaatgaccacgagcccctgaagcccccacctgctggccaggagggccgctggcccagcaagcccctgacctacagcctgaccggcagcatccagcagagccgcagcctgggcgcccagagcagcaaggccggggagacccgggaggccgtgccccagtgccgggtgcccctggagacctgcatgctggccaacctgcaggccaccagtgaagatgtgcacggctttgaggcccctggcaccagcaagagcagcctgcacccccgggtgtctgtgtcccaggaccccaggaagctgtgcctgatggaggaggtggtgaatgaatttgagcccggcatggccaccaagtctgagacccagccccaggtgtgtgccgctgtggtgctgctgcctgatggccaggcctctgtggtgccccacgccagcgagaacctggtgtcccaggtgccccagggccacctgcagagcatgcccactggaaacatgagggccagccaggagctgcatgacctgatggccgcccggcgcagcaagctggtgcatgaggagcccaggaaccccaactgccagggcagctgcaagagccagaggcccatgtttcctcccatccacaagtctgagaagagcaggaagcccaacctggagaagcatgaggagcggctggagggcctgcggaccccccagctgacccctgtgaggaagacagaggacacccaccaggatgaaggagtgcagctgctgcccagcaagaagcagcccccatctgtgagcccctttggagagaacatcaagcagatcttccagtggatcttcagcaagaagaagagcaagccagcccctgtgacagctgagagccagaagacagtgaagaacagaagccgggtgtacagcagcagcgctgaggcccagggcctgatgacagctgtgggccagatgctggatgagaagatgagcctgtgccacgcccggcatgccagcaaggtgaaccagcacaagcagaagttccaggcccctgtgtgtggcttcccctgcaaccaccgccacctgttctacagcgagcacggccgcatcctgtcctatgctgccagcagccagcaggccaccctgaagagccagggctgccccaacagagaccggcagatccggaaccagcagcccctgaagtctgtgcgctgcaacaatgagcagtggggcctgcggcacccccagatcctgcaccccaagaaggctgtgtcccctgtgagccccccccagcactggcccaagaccagcggggccagcagccaccaccaccactgccccaggcactgcctgctgtgggagggcatctag

SEQ ID NO: 34256 - DNA, 4731 bp, Artificial Sequence
  Description of Artificial Sequence: Synthetic coding sequence
atggagaacatcctgtgcttcctgaacagctacacagagaccggcctgagcccagacagccactggctggacatcgaccccaacttcatctgcctgagcggcctgggcctcttcatcctgtacctgttctacgtggtgctgaccctgtacagcagccccacagagaagaacaatgacatccagaagcaccagggccgggccaagagaagaaggaagggcggcaccttcaagggcttcccagactggaagagcttccagcgggaggaggaggaggagaggaagctgctgagcctgctgaagagctttggcccccctgtgtcctgcagcccccggggccagcaccacgacaccaaccacttccggcggctgctgtgcccagaccctgtgtgccgggtgtgcaagagggccacagctgacatccagcagctgctgtcctgggagagcctgaaggatgctgcccccagcgtgagccccctggccagcagcgccagcgccacagagagcagcttcaccctggccagcaccccatctgccaccccacctgaggacctgatcctgagcccccggcccaaggccagccccccaccacccctcatcctgagcccagacctgatcaccaccctggccgacctcttcagccccagccccctgcgggaccccctgcccccccagcctgtgagccccctggacagcaagttccccatcgaccacagccccccccagcagctgcccttccccctgctgcccccccaccacatcgagcgggtggagagcagcctgcagcctgaggccagcctgagcctgaacaccatcttctcctttggcagcaccctgtgccaggacatcagccaggccatgaaccccatcgacagctgtgcccggcaccacggcccccccatccccagcgccctgcccccagaggactgcaccgtgacccagagcaagagcagcctgaccatcctgaagaccttccctgagatgctgagcctgggcggcagcggcggcagcagcaccagcgcccccaccatcaagggcatcgaccacagccacctggccagcagcgagttcacctggtggcagccccacgccaaggacagcttcagcagcaactttgtgcccagcgacttcatggaggagctgctgaccctgcacagcagcgaggccttcctgggcggccacagcgtggccaacctgattgagcctgtgaacatctccttcctgagccatgacatcctggccctgctggagcggcaggtgaagaagagaggagacttcctgatgtggaaggaaaatggcaagaagccaggcagcttccccaagcagctgcggcccaactaccagctgaacagcagcaggaacatgctgaccagcattgctgtgaagcatgacctggccgagagcttccccttctgggccagcaagggcaagctggagtggcagcacatccaccagcagcccccccacagcaagtgctttgaggaccacctggagcagaagtatgtgcagctgttctggggcctgcccagcctgcacagcgagagcctgcaccccaccgtgctggtgcagaggggccacagctccatgtttgtgttcttcaacggcatcaccaacaccagcatcagccatgagagccctgtgctgcccccaccccagcccctgagcctgcccagcacccagcccctgcccctgccccagaccctgccccagggccagagcccccacctgacccaggtgaagagcctggcccagccccagagccccttccgggccctgctgcccagccccctcttcctgatccgcatctgtggggtgtgcttccaccggccccagaatgaggcccggagcctgctgcccagcgagatcaaccacctggagtggaatgtgctgcagaaggtgcaggagagcctgtggggcctgcccagcgtggtgcagaagagccaggaggacttctgccccccagcccccaaccctgagctggtgaggaagagcttcaaggtgcacgtgcccatcagcatcatccctggggacttccccctgagcagcgaggtgaggaagaagctggagcagcacatcagaagaagactcatccagaggcgctggggcctgccccggcgcatccacgagagcctgagcctgctgcggccccagagcaagatcagcgagctgtctgtgtctgagcgcatccacggccccctgaacatcagcctggtggagggccagcgctgcaatgtgctgaagaagagcgccagcagcttccccaggagcttccacgagaggagcagcaacatgctgtccatggagaatgtgggcaactaccagggctacagccaggagaccgtgcccaaggaccacctgctgcacggccctgagaccagcagtgacaaggacctgcggagcaacagcgagcgggacctggagacccacatgatgcacctgtctggaaatgattctggagtgcggctgggccagaagcagctggagaatgccctgactgtgcggctgagcaagaagtttgaggagatcaatgaaggaaggatgcctggcaccgtgcacagctcctggcacagcgtgaagcagaccatgagcctgcctgagaagagccacagccagatcaagcacaggaacctggtgaccctggtgtctgaggaccactgtgtggacaccagccaggagatctccttcctgagcagcaacaagcagaagatgctggaggcccacatcaagaccttcaggatgaggatgctgtggggcctgcccctgaaggtgctggagagcattgagatcttcaagagcaaggctgacctgagcaccagcttcagccactttgacctgcccagcagcgccaccttcatcagccagggcgacagcaaggatggagtgtccaagagccgcagccgcagcaccttccagggcgagaagctgggcaccaccagctctgtgcccatcctggaccggccccaccctgtgagcagccctgtggtgcaggagggccagggcaccctgcggcggcagttcagtgacacagaccatgacctgattgaaacagacagcaaggatggagccagcaccagcctgcggcggggcaccacagacttccagagcgagaagctggacagcaccagcagcttccccatcctgggccacagctacctggtgaccagccctgtgaaccaggagaagcagggcaccctgcggcgggagttcagtgacacagacaatgacctgacagagagcgtgaggaccacagaagatggccggcagaccttcctgcccccaccccacagcatcgtggatgaggtgtcccagaagcagacagtgctggccagccgctgcagcgctgagctgcccatcatgcaggccggggccggctgtgagagctgggacaagaggaagagcagcttccacaacgtggaccggctgcagggcagcaggaagaccttccctgtgaccaatgccctgcagagccagaccaggaacaacctgaccaccagcaagagcggcagctgcagcctgaccaacgtgaaggccagcaccagcaatgaaacagagatcttccccccacgcatctctgtgccccaggaccccaagagcagctacctgaagaaccagatgctgagccagctgaagctggtgcagaggaagcacagccagccccagagccacttcacagacatgagctttgccctggacaacctgagcagcaaggacctgctgaccaacagccagggcatcagcagcggggacatgggcaccagccaggtggtgcacgtgcacctggaggacagcggcatccgggtggcccagaagcaggagccccgggtgcccacctgtgtgctgcagaagtgccaggtgaccaacttccccccagctgtgaacagagtgtcccctgtgcggcccaagggcggggagctggatggaggagatgctggcctgggcaccagccagaggaggaggaagagcctgcctgtgcacaacaagaccagcggggaggtgctgggcagcaagagcagccccaccctgaagacccagcccccaccagaaaatctcttcaggaagtggatgaagaccagcctgcagtggttcaacaagcccagcatctcctatgaggagcaggagagctcctgggagaagggcagcagcctgagcagctgtgtgcagaacatcggccgggtcatccgggccgccttcaccggcaccacagaggcccagaagatcaggaaggacacccgggagttcctggaggagaagctgggccacagacatggaattgacatcacctgcccccaggagcccctgtccttccctgtgggcctgggcaaggcccagcacaaccctgaggtgcacgtgcgggcagagcctgtgcagggctgcccctgcaactaccgggcccccagctgcaaggtgaccaggaccaagagctgcagccagcaggccatctttgtgggccagaactaccccacccgcatccggcagatcatcgacaaggaccggcagccccagaaggtggaggccttcaagggcaagatcctgtgccagagccacccccagagcatgccccacaggaagcctgtgccccaccccaaccccacctgccggcggcaggtgtccctggtgtgcccagctgtgcccaccagcgccaagagccctgtgttcagtgatgtgcccttcctgaccggccagaagatgctgcccaagcacctgcagggcggcaagtttcctcccaccaagtag

SEQ ID NO: 34257 - DNA, 1242 bp, Artificial Sequence
  Description of Artificial Sequence: Synthetic coding sequence
atggccgagggccctgaggaggcccggggccaccccccaggccaggatgatggcggcggggaccacgagcctgtgcccagcctgcggggcccccccaccacagctgtgccctgccccagagatgacccccaggccgagccccaggcccctggccggcccacagcccctggcctggccgctgctgctgctgctgacaagctggagcccccccgggagctgaggaagagaggagaggccgccagcggcagcggggctgagctgcaggagcaggccggctgtgaggcccctgaggccgccgccccccgggagaggcctgcccggctgagcgcccgggagtacagccggcaggtgcatgagtggctgtggcagagctactgcggctacctgacctggcacagcggcctggccgccttccctgcctactgcagcccccagcccagcccccagagcttccccagcggcggcgctgctgtgccccaggccgccgcccctcctccaccccagctgggctactacaaccccttctacttcctgagccctggagctgctggccctgaccccaggacagctgctggcatcagcaccccagcccctgtggccggcctgggcccccgggccccccacgtgcaggcctctgtgcgggccacccctgtgaccagggtgggcagcgctgcccccagccgcagccccagcgagaccggccggcaggccggccgggagtatgtgatccccagcctggcccaccgcttcatggccgagatggtggacttcttcatcctcttcttcatcaaggccaccatcgtgctgagcatcatgcacctgagcggcatcaaggacatcagcaagtttgccatgcactacatcatcgaggagattgatgaggacacctccatggaggacctgcagaagatgatggtggtggccctgatctaccgcctgctggtgtgcttctatgagatcatctgcatctggggcgctgggggcgccaccccaggcaagttcctgctgggcctgcgggtggtgacctgtgacacctctgtgctgattgcccccagccgggtgctggtgatccccagcagcaatgtgtccatcaccaccagcaccatccgggccctgatcaagaacttcagcatcgccagcttcttccctgccttcatcaccctgctcttcttccagcacaacagaacagcctatgacatcgtggccggcaccatcgtggtgaagagaaatggagtgaggtag

SEQ ID NO: 34258 - DNA, 492 bp, Artificial Sequence
  Description of Artificial Sequence: Synthetic coding sequence
atggccgagatggtggacttcttcatcctcttcttcatcaaggccaccatcgtgctgagcatcatgcacctgagcggcatcaaggacatcagcaagtttgccatgcactacatcatcgaggagattgatgaggacacctccatggaggacctgcagaagatgatggtggtggccctgatctaccgcctgctggtgtgcttctatgagatcatctgcatctggggcgctgggggcgccaccccaggcaagttcctgctgggcctgcgggtggtgacctgtgacacctctgtgctgattgcccccagccgggtgctggtgatccccagcagcaatgtgtccatcaccaccagcaccatccgggccctgatcaagaacttcagcatcgccagcttcttccctgccttcatcaccctgctcttcttccagcacaacagaacagcctatgacatcgtggccggcaccatcgtggtgaagagaaatggagtgaggtag

SEQ ID NO: 34259 - DNA, 915 bp, Artificial Sequence
  Description of Artificial Sequence: Synthetic coding sequence
atgaacatcgtgttcagccgggacagccaggtgcgggtgatggagaacacagtggccaacacagagaagtacttcggccagttctgcagcctgctggccgcctacaccaggaagacagcccggctgcgggacaaggctgaccagctggtgaagcagctgattgactttgccaacagcgagaaccctgagctgcgggccaccatgaggggctttgctgaggacctggccaaggtgcaggactaccggcaggcccaggtggagcggctggagaccaaggtggtgaaccccctgaagctgtatggagcccagatcaagcagaccagggctgagatcaagaagttcaagcacgtgcagaaccacgagatcaagcagctggagaagctggagaagctgcggcagaagagccccagcgaccagcagatgattggccaggccgagaccagggtgcagagagctgctgtggacagcagcaggaccaccctgcagctggaggagaccgtggatggcttccagaggcagaagctgaaggacctgcagaagttcttctgtgactttgtgaccatcgagatggtgttccacgccaaggctgtggaggtgtacagcagcgccttccagaccctggagaagtatgacctggagcgggacctgctggacttccgggccaagatgcagggcgtgtatggccactatgacacccggctgctggccaacaccagccccccaccttctgtgctgcagagcctggccagccagggcaccctgcaggtgcagctgagccgggccaatgaagatcctgagcacccccacgccaaccacggccgcttcagcctgtgtgagtgggtggtgaagggccagcctgcccactgtgtgtgtggccagggcggccacctgatgctgcccggccacagcctgtag

SEQ ID NO: 34260 - DNA, 915 bp, Artificial Sequence
  Description of Artificial Sequence: Synthetic coding sequence
atgaacatcgtgttcagccgggacagccaggtgcgggtgatggagaacacagtggccaacacagagaagtacttcggccagttctgcagcctgctggccgcctacaccaggaagacagcccggctgcgggacaaggctgaccagctggtgaagcagctgattgactttgccaacagcgagaaccctgagctgcgggccaccatgaggggctttgctgaggacctggccaaggtgcaggactaccggcaggcccaggtggagcggctggagaccaaggtggtgaaccccctgaagctgtatggagcccagatcaagcagaccagggctgagatcaagaagttcaagcacgtgcagaaccacgagatcaagcagctggagaagctggagaagctgcggcagaagagccccagcgaccagcagatgatcagccaggccgagaccagggtgcagagagctgctgtggacagcagcaggaccaccctgcagctggaggagaccgtggatggcttccagaggcagaagctgaaggacctgcagaagttcttctgtgactttgtgaccatcgagatggtgttccacgccaaggctgtggaggtgtacagcagcgccttccagaccctggagaagtatgacctggagcgggacctgctggacttccgggccaagatgcagggcgtgtatggccactatgacacccggctgctggccaacaccagccccccaccttctgtgctgcagagcctggccagccagggcaccctgcaggtgcagctgagccgggccaatgaagatcctgagcacccccacgccaaccacggccgcttcagcctgtgtgagtgggtggtgaagggccagcctgcccactgtgtgtgtggccagggcggccacctgatgctgcccggccacagcctgtag

SEQ ID NO: 34261 - DNA, 3402 bp, Artificial Sequence
  Description of Artificial Sequence: Synthetic coding sequence
atggcccccaagaccaagaagggctgcaaggtgaccctgcctgagaagcctgtgaagctggccagccacacccgggacaccaccggggtgtcccagatgttccccagcagcaaggcccggaccaagagcctgctgggagatgatgtgttcagcaccatggccggcctggaggaggctgatgctgaggtgtctggcatcagcgaggccgacccccaggccctgctgcaggccatgaaggacctggatggcatggatgctgacatcctgggcctgaagaagagcaacagcgcccccagcaagaaggccgccaaggaccccgggaagggggagctgcccaaccaccccaagccagctgggggcgccatccccaccaagaagagcctgcccagccccagcagcagcggccaccagaacagacgcttcagcagcgaggacctggaggaccccctgcggggcctgctgtcctatgatgaaggaggcatcaccaagcagccccctgtgacccagagcaagacagccagtgacaagagccccagcacagtgcgggaccagggccccagcatccccctgacccctggggacacccccatcaggaagaaggaggagctgctgtttgatgatggagatgacatcatggccaccctgggctttggagacagccccaaggccgagaagaggcagatcggggaccaggagggccccaggcctgcccggagcaccctggatgagctgctgggccggggcatggccaccaagctgctggcccggcccggcactggagagcaccgggagttcaagctggacaagaagtaccagaggccccaggacagcgaggacatgtggggagatgaggacttcaccttcggggcctaccagcccaccgtggtgagcagcgagggccggcagagccggcggcagagcgtgcgcttctttgctgacagcggggctgaccccaagggggagcccggcagcaagcagagcccccccatggccagcagccccatccagcccaggaaaggaggagctgactggctgggcctgaaggatgaggacctggacctcttccctgccagccccacccgggaggcccaccgggagagctctgtgcctgtgacccccagcgtgcccccaccagccagccagcacagcaccccagctggcctgccccccagccgggccaagcccccaacagaaggagctggcagccctgccaaggccagccaggccagcaagctgcgggccagcaaggaggagaaggaggactggctgagccacgccctgagcaggaagaagagccagggcctggcccgggagcagcacgccggcaccagcgagggcctgcacctggccggcacagctggccacccccccagcggcagccagcccctgaccagcacccagggcctggagcacgccgccgccggcggcagcagcggcaccacagcccgggagcggccctgtgtgcggcctggggtgtctggcagccctgtgacccagaaccacgccgccagcgccctgcccaccggcagccccaagaggggcacagcccctggggacctgagcgccacagagcccgccacctgcttccccagcacccagaagcccacagagcccagcgtgcctgtgcagcccctgctgcctgagagcctggcccggagcctgctgcccagcacagagtaccagaagcagctgctggccgcccaggtgcagctgcagtgcagccctgctgagctgcaggccgagctgctgcacagccaggcccggctggccgagctggaggcccaggtgaggaagctggagctggagcgggcccagcacgagctgctgctgggcagcctgcagcagcagcaccaggccgacctggagctgattgagagcgcccacaggagccgcatcaaggtgctggagaccagctaccagcagcgggaggagcggctgcggagagaaaatgaggagctgagcgcccgctacctgagccagtgccaggaggccgagcaggcccgggcagagctgacagcccagcaccagaggcggctggccgccatcgcccaggagaaggaccaggagatggagcggctgcgggagctgcagagggccagcatcctggacatgagaagagaccacgaggagcagctgcagaggctgaagctgctgaaggaccgggaggtggatgctgccaccagcgccaccagccacaccaggagcctgaacagcatcatccaccagatggagaagttcagcagcagcctgcacgagctgagcagccgggtggaggccagccacctgaccaccagccaggagcgggagctgggcatccggcagagagatgagcagctgcgggccctgcaggagcggctgggccagcagcagagggacatggaggaggagaggagccggcagcaggaggtgattggcaagatggaggcccggctgaatgagcagagccggctgctggagcaggagcgctggagggtgacagctgagcagagcaaggccgagagcatgcagagggccctggaggagcagaggaaggtgacagcccagcagatggccatggagagagctgagctggagcgggccaagagcgccctgctggaggagcagaagtctgtgatgctgaagtgtggggaggagcggcggcggctggccgctgagtgggccgagttcagcgcccagcagaagctgagcaaggagcgggcagagcgggaggccgagcgggccctgcaggtggacacccagcgggagggcaccctcatcagcctggccaaggagcaggccgagctgaagatccgggccagcgagctgcgggcagaggagaagcagctggccgctgagagagctgccctggagcaggagcggcaggagctgcggctggagaaggagcgcatcaatgccacagccctgcgggtgaagctgcgggcagaggaggtggagagcatgagcaaggtggccagcgagaagtatgaggagggggagcgggccctgcgggaggcccagcaggtgcaggccgagcagcaggcccggctgcaggccgtgcagcagcagcaggagcggctgaggaagcaggagcagcacatgcaccaggagcacctgagcctggcccagcagaggctgcagctggaccgggcccggcaggacctgcccagcagcctggtgggcctcttcccccgggcccagggccctgctgccagcagccagagcgccctgatgcccccagcccccaccacccgctggtgcagccagccccccaccggcctggaccccagccccctgcacctgcacgcccggctggccctgctgcggcacatggccgagcaggaccgggacttcctggagaatgagcagttcttcctggagaccctgaagaagggcagctacaacctgaccagccacagcgcctag

SEQ ID NO: 34262 - DNA, 2493 bp, Artificial Sequence
  Description of Artificial Sequence: Synthetic coding sequence
atggcccccaagaccaagaagggctgcaaggtgaccctgcctgagaagcctgtgaagctggccagccacacccgggacaccaccggggtgtcccagatgttccccagcagcaaggcccggaccaagagcctgctgggagatgatgtgttcagcaccatggccggcctggaggaggctgatgctgaggtgtctggcatcagcgaggccgacccccaggccctgctgcaggccatgaaggacctggatggcatggatgctgacatcctgggcctgaagaagagcaacagcgcccccagcaagaaggccgccaaggaccccgggaagggggagctgcccaaccaccccaagccagctgggggcgccatccccaccaagaagagcctgcccagccccagcagcagcggccaccagaacagacgcttcagcagcgaggacctggaggaccccctgcggggcctgctgtcctatgatgaaggaggcatcaccaagcagccccctgtgacccagagcaagacagccagtgacaagagccccagcacagtgcgggaccagggccccagcatccccctgacccctggggacacccccatcaggaagaaggaggagctgctgtttgatgatggagatgacatcatggccaccctgggctttggagacagccccaaggccgagaagaggcagatcggggaccaggagggccccaggcctgcccggagcaccctggatgagctgctgggccggggcatggccaccaagctgctggcccggcccggcactggagagcaccgggagttcaagctggacaagaagtaccagaggccccaggacagcgaggacatgtggggagatgaggacttcaccttcggggcctaccagcccaccgtggtgagcagcgagggccggcagagccggcggcagagcgtgagccgcttctttgctgacagcggggctgaccccaagggggagcccggcagcaagcagagcccccccatggccagcagccccatccagcccaggaagggcggcgctgactggctgggcctgaaggatgaggacctggacctcttccctgccagccccacccgggaggcccaccgggagagctctgtgcctgtgaccccatctgtgcccccaccagccagccagcacagcaccccagctggcctgccccccagccgggccaagccacccacagagggcgccggcagccctgccaaggccagccaggccagcaagctgcgggccagcaaggaggagaaggaggactggctgagccacgccctgagcaggaagaagagccagggcctggcccgggagcagcacgccggcaccagcgagggcctgcacctggccggcacagctggccaccccccatctggcagccagcccctgaccagcacccagggcctggagcacgccgctgctgggggcagcagcggcaccacagcccgggagcggccctgtgtgcggcctggggtgtctggcagccctgtgacccagaaccacgccgccagcgccctgcccaccggcagccccaagaggggcacagcccctggggacctgagcgccacagagcccgccacctgcttccccagcacccagaagcccacagagcccagcgtgcctgtgcagcccctgctgcctgagagcctggcccggagcctgctgcccagcacagagtaccagaagcagctgctggccgcccaggtgcagctgcagtgcagccctgctgagctgcaggccgagctgctgcacagccaggcccggctggccgagctggaggcccaggtgaggaagctggagctggagcgggcccagcacgagctgctgctgggcagcctgcagcagcagcaccaggccgacctggagctgattgaaagtgcccacaggagccgcatcaaggtgctggagaccagctaccagcagcgggaggagcggctgcggcgggagaatgaggagctgagcgcccgctacctgagccagtgccaggaggccgagcaggcccgggcagagctgacagcccagcaccagaggcggctggccgccatcgcccaggagaaggaccaggagatggagcggctgcgggagctgcagagggccagcatcctggacatgaggcgggaccacgaggagcagctgcagaggctgaagctgctgaaggaccgggaggtggatgctgccaccagcgccaccagccacaccaggagcctgaacagcatcatccaccagatggagaagttcagcagcagcctgcacgagctgagcagccgggtggaggccagccacctgaccaccagccaggagcgggagctgggcatccggcagagagatgagcagctgcgggccctgcaggagcggctgggccagcagcagagggacatgggcagagatgaggagggcagcctgtgtgccgcccacctgcccaaggcccagctgagcggctatgctgtggaggccaccaggaaccagagccagctgcagcgcttcctgtag

SEQ ID NO: 34263 - DNA, 3405 bp, Artificial Sequence
  Description of Artificial Sequence: Synthetic coding sequence
atggcccccaagaccaagaagggctgcaaggtgaccctgcctgagaagcctgtgaagctggccagccacacccgggacaccaccggggtgtcccagatgttccccagcagcaaggcccggaccaagagcctgctgggagatgatgtgttcagcaccatggccggcctggaggaggctgatgctgaggtgtctggcatcagcgaggccgacccccaggccctgctgcaggccatgaaggacctggatggcatggatgctgacatcctgggcctgaagaagagcaacagcgcccccagcaagaaggccgccaaggaccccgggaagggggagctgcccaaccaccccaagccagctgggggcgccatccccaccaagaagagcctgcccagccccagcagcagcggccaccagaacagacgcttcagcagcgaggacctggaggaccccctgcggggcctgctgtcctatgatgaaggaggcatcaccaagcagccccctgtgacccagagcaagacagccagtgacaagagccccagcacagtgcgggaccagggccccagcatccccctgacccctggggacacccccatcaggaagaaggaggagctgctgtttgatgatggagatgacatcatggccaccctgggctttggagacagccccaaggccgagaagaggcagatcggggaccaggagggccccaggcctgcccggagcaccctggatgagctgctgggccggggcatggccaccaagctgctggcccggcccggcactggagagcaccgggagttcaagctggacaagaagtaccagaggccccaggacagcgaggacatgtggggagatgaggacttcaccttcggggcctaccagcccaccgtggtgagcagcgagggccggcagagccggcggcagagcgtgagccgcttctttgctgacagcggggctgaccccaagggggagcccggcagcaagcagagcccccccatggccagcagccccatccagcccaggaagggcggcgctgactggctgggcctgaaggatgaggacctggacctcttccctgccagccccacccgggaggcccaccgggagagctctgtgcctgtgaccccatctgtgcccccaccagccagccagcacagcaccccagctggcctgccccccagccgggccaagccacccacagagggcgccggcagccctgccaaggccagccaggccagcaagctgcgggccagcaaggaggagaaggaggactggctgagccacgccctgagcaggaagaagagccagggcctggcccgggagcagcacgccggcaccagcgagggcctgcacctggccggcacagctggccaccccccatctggcagccagcccctgaccagcacccagggcctggagcacgccgctgctgggggcagcagcggcaccacagcccgggagcggccctgtgtgcggcctggggtgtctggcagccctgtgacccagaaccacgccgccagcgccctgcccaccggcagccccaagaggggcacagcccctggggacctgagcgccacagagcccgccacctgcttccccagcacccagaagcccacagagcccagcgtgcctgtgcagcccctgctgcctgagagcctggcccggagcctgctgcccagcacagagtaccagaagcagctgctggccgcccaggtgcagctgcagtgcagccctgctgagctgcaggccgagctgctgcacagccaggcccggctggccgagctggaggcccaggtgaggaagctggagctggagcgggcccagcacgagctgctgctgggcagcctgcagcagcagcaccaggccgacctggagctgattgaaagtgcccacaggagccgcatcaaggtgctggagaccagctaccagcagcgggaggagcggctgcggcgggagaatgaggagctgagcgcccgctacctgagccagtgccaggaggccgagcaggcccgggcagagctgacagcccagcaccagaggcggctggccgccatcgcccaggagaaggaccaggagatggagcggctgcgggagctgcagagggccagcatcctggacatgaggcgggaccacgaggagcagctgcagaggctgaagctgctgaaggaccgggaggtggatgctgccaccagcgccaccagccacaccaggagcctgaacagcatcatccaccagatggagaagttcagcagcagcctgcacgagctgagcagccgggtggaggccagccacctgaccaccagccaggagcgggagctgggcatccggcagagagatgagcagctgcgggccctgcaggagcggctgggccagcagcagagggacatggaggaggagaggagccggcagcaggaggtgattggcaagatggaggcccggctgaatgagcagagccggctgctggagcaggagcgctggagggtgacagctgagcagagcaaggccgagagcatgcagagggccctggaggagcagaggaaggtgacagcccagcagatggccatggagcgggcagagctggagcgggccaagagcgccctgctggaggagcagaagtctgtgatgctgaagtgtggggaggagcggcggcggctggccgctgagtgggccgagttcagcgcccagcagaagctgagcaaggagagagctgagcgggaggccgagcgggccctgcaggtggacacccagcgggagggcaccctcatcagcctggccaaggagcaggccgagctgaagatccgggccagcgagctgcgggcagaggagaagcagctggccgctgagcgggccgccctggagcaggagcggcaggagctgcggctggagaaggagcgcatcaatgccacagccctgcgggtgaagctgcgggcagaggaggtggagagcatgagcaaggtggccagcgagaagtatgaggagggggagcgggccctgcgggaggcccagcaggtgcaggccgagcagcaggcccggctgcaggccgtgcagcagcagcaggagcggctgaggaagcaggagcagcacatgcaccaggagcacctgagcctggcccagcagaggctgcagctggaccgggcccggcaggacctgcccagcagcctggtgggcctcttcccccgggcccagggccctgctgccagcagccagagcgccctgatgcccccagcccccaccacccgctggtgcagccagcccccaacaggcctggaccccagccccctgcacctgcacgcccggctggccctgctgcggcacatggccgagcaggaccgggacttcctggagaatgagcagttcttcctggagaccctgaagaagggcagctacaacctgaccagccacagcgcctag

SEQ ID NO: 34264 - DNA, 3444 bp, Artificial Sequence
  Description of Artificial Sequence: Synthetic coding sequence
gcccccaagaccaagaagggctgcaagggcagcattgatgacttcctgggggacctgctgggagatgacatgaccctgcctgagaagcctgtgaagctggccagccacacccgggacaccactggagtgtcccagatgttccccagcagcaaggcccggaccaagagcctgctgggagatgatgtgttcagcaccatggccggcctggaggaggctgatgctgaggtgtctggcatcagcgaggccgacccccaggccctgctgcaggccatgaaggacctggatggcatggatgctgacatcctgggcctgaagaagagcaacagcgcccccagcaagaaggccgccaaggaccctggaaaaggagagctgcccaaccaccccaagccagctggaggagccatccccaccaagaagagcctgcccagccccagcagcagcggccaccagaacagacgcttcagcagcgaggacctggaggaccccctgcggggcctgctgtcctatgatgagggcggcatcaccaagcagccccctgtgacccagagcaagacagccagtgacaagagccccagcacagtgcgggaccagggccccagcatccccctgacccctggggacacccccatcaggaagaaggaggagctgctgtttgatgatggagatgacatcatggccaccctgggctttggagacagccccaaggccgagaagaggcagattggagaccaggagggccccaggcctgcccggagcaccctggatgagctgctgggccggggcatggccaccaagctgctggcccggcccggcaccggggagcaccgggagttcaagctggacaagaagtaccagaggccccaggacagcgaggacatgtggggagatgaggacttcacctttggagcctaccagcccaccgtggtgtcctctgagggccggcagagccggcggcagagcgtgagccgcttctttgctgacagcggggctgaccccaagggggagcccggcagcaagcagagcccccccatggccagcagccccatccagcccaggaaaggaggagctgactggctgggcctgaaggatgaggacctggacctcttccctgccagccccacccgggaggcccaccgggagagctctgtgcctgtgacccccagcgtgcccccaccagccagccagcacagcaccccagctggcctgccccccagccgggccaagcccccaacagaaggagctggcagccctgccaaggccagccaggccagcaagctgcgggccagcaaggaggagaaggaggactggctgagccacgccctgagcaggaagaagagccagggcctggcccgggagcagcacgccggcaccagcgagggcctgcacctggccggcacagctggccacccccccagcggcagccagcccctgaccagcacccagggcctggagcacgccgccgccggcggcagcagcggcaccacagcccgggagcggccctgtgtgcggcctggggtgtctggcagccctgtgacccagaaccacgccgccagcgccctgcccaccggcagccccaagaggggcacagcccctggggacctgagcgccacagagcccgccacctgcttccccagcacccagaagcccacagagcccagcgtgcctgtgcagcccctgctgcctgagagcctggcccggagcctgctgcccagcacagagtaccagaagcagctgctggccgcccaggtgcagctgcagtgcagccctgctgagctgcaggccgagctgctgcacagccaggcccggctggccgagctggaggcccaggtgaggaagctggagctggagcgggcccagcacgagctgctgctgggcagcctgcagcagcagcaccaggccgacctggagctgattgagagcgcccacaggagccgcatcaaggtgctggagaccagctaccagcagcgggaggagcggctgcggagagaaaatgaggagctgagcgcccgctacctgagccagtgccaggaggccgagcaggcccgggcagagctgacagcccagcaccagaggcggctggccgccatcgcccaggagaaggaccaggagatggagcggctgcgggagctgcagagggccagcatcctggacatgagaagagaccacgaggagcagctgcagaggctgaagctgctgaaggaccgggaggtggatgctgccaccagcgccaccagccacaccaggagcctgaacagcatcatccaccagatggagaagttcagcagcagcctgcacgagctgagcagccgggtggaggccagccacctgaccaccagccaggagcgggagctgggcatccggcagagagatgagcagctgcgggccctgcaggagcggctgggccagcagcagagggacatggaggaggagaggagccggcagcaggaggtgattggcaagatggaggcccggctgaatgagcagagccggctgctggagcaggagcgctggagggtgacagctgagcagagcaaggccgagagcatgcagagggccctggaggagcagaggaaggtgacagcccagcagatggccatggagagagctgagctggagcgggccaagagcgccctgctggaggagcagaagtctgtgatgctgaagtgtggggaggagcggcggcggctggccgctgagtgggccgagttcagcgcccagcagaagctgagcaaggagcgggcagagcgggaggccgagcgggccctgcaggtggacacccagcgggagggcaccctcatcagcctggccaaggagcaggccgagctgaagatccgggccagcgagctgcgggcagaggagaagcagctggccgctgagagagctgccctggagcaggagcggcaggagctgcggctggagaaggagcgcatcaatgccacagccctgcgggtgaagctgcgggcagaggaggtggagagcatgagcaaggtggccagcgagaagtatgaggagggggagcgggccctgcgggaggcccagcaggtgcaggccgagcagcaggcccggctgcaggccgtgcagcagcagcaggagcggctgaggaagcaggagcagcacatgcaccaggagcacctgagcctggcccagcagaggctgcagctggaccgggcccggcaggacctgcccagcagcctggtgggcctcttcccccgggcccagggccctgctgccagcagccagagcgccctgatgcccccagcccccaccacccgctggtgcagccagccccccaccggcctggaccccagccccctgcacctgcacgcccggctggccctgctgcggcacatggccgagcaggaccgggacttcctggagaatgagcagttcttcctggagaccctgaagaagggcagctacaacctgaccagccacagcgcctag

SEQ ID NO: 34265 - DNA, 831 bp, Artificial Sequence
  Description of Artificial Sequence: Synthetic coding sequence
atgaagaagacccctgtgttcctggagagcctggtgaccaacatgctgcggctgcgggccatctgccccttctcctggagggtcttccagttccggcccatcagctgtgagcccctcatcatccagatgaacaagtgcacagatgaggagcagatgtttggcttcatcgagaggaacaaggccatcctgtctgagaagcaggtgggctgtgcctttgacatgctgtggaagctgcagaagcagaagaccagcctgctgaagaatgcagaatatgtgcgggaccacccccagttcctgaccctgcacaacctggccaccaacaagttcaagctgatgaatgatgacaccctggtgaatgtgctgtatgtgacccagcagtttgctggggaggcccatgaccccctggtggaggccctggtgacagaggcctggaggcggctggagagatttgacatcaagctgctgtctgagttcagcagctgcctggccgaccagcacctgtacttcagccccctgatgggcaagattgctgacatcgtgcacaggaacctggagaccacccaggacctgagcagcctgtctgtgctgatggtgaacatcagcagcctcatcagccgccacttccagcagcagctggtgaacaagacagagctgctgtttgacaccatcgacagcagcgaggtgaatgtggccaagagcatcgccaagttcctgagaaatgtgcgctaccgctaccagcccctgctggagcgctgcaacaacgtgttcctgagcaatgtggaccacctggacctggacagcatcagcaagatcctgtctgtgtacaagtag

SEQ ID NO: 34266 - DNA, 2544 bp, Artificial Sequence
  Description of Artificial Sequence: Synthetic coding sequence
atgaagaagacccctgtgttcctggagagcctggtgaccaacatgctgcggctgcgggccatctgccccttctcctggagggtcttccagttccggcccatcagctgtgagcccctcatcatccagatgaacaagtgcacagatgaggagcagatgtttggcttcatcgagaggaacaaggccatcctgtctgagaagcaggtgggctgtgcctttgacatgctgtggaagctgcagaagcagaagaccagcctgctgaagaatgcagaatatgtgcgggaccacccccagttcctgaccctgcacaacctggccaccaacaagttcaagctgatgaatgatgacaccctggtgaatgtgctgtatgtgacccagcagtttgctggggaggcccatgaccccctggtggaggccctggtgacagaggcctggaggcggctggagagatttgacatcaagctgctgtctgagttcagcagctgcctggccgaccagcacctgtacttcagccccctgatgggcaagattgctgacatcgtgcacaggaacctggagaccacccaggacctgagcagcctgtctgtgctgatggtgaacatcagcagcctcatcagccgccacttccagcagcagctggtgaacaagacagagctgctgtttgacaccatcgacagcagcgaggtgaatgtggccaagagcatcgccaagttcctgagaaatgtgcgctaccgctaccagcccctgctggagcgctgcaacaacgtgttcctgagcaatgtggaccacctggacctggacagcatcagcaagatcctgtctgtgtacaagttcctgcagttcaacagctttgagttcatcatcatggccaagaagaagctgacagagatgatccccctgtgcaaccacccagccagctttgtgaagctgtttgtggccctgggccccatcgccggccctgaggagaagaagcagctgaagagcaccatgctgctgatgtctgaggacctgactggagagcaggccctggccgtgctgggcgccatgggagacatggagagcaggaacagctgcctgatcaagagggtgacctctgtgctgcacaagcacctggatggctacaagcccctggagctgctgaagatcacccaggagctgaccttcctgcacttccagaggaaggagttctttgccaagctgcgggagctgctgctgagctacctgaagaacagcttcatccccacagaggtgtctgtgctggtgcgggccatcagcctgctgcccagcccccacctggatgaggtgggcatcagcagaattgaagctgtgctgccccagtgtgacctgaacaacctgagcagctttgccacctctgtgctgcgctggatccagcacgaccacatgtacctggacaacatgacagccaagcagctgaagctgctgcagaagctggaccactacggccggcagaggctgcagcacagcaacagcctggacctgctgaggaaggagctgaagagcctgaagggcaacaccttccctgagagcctgctggaggagatgattgccaccctgcagcacttcatggatgacatcaactacatcaacgtgggggagatcgccagcttcatcagcagcacagactacctgagcaccctgctgctggacagaattgcctctgtggccgtgcagcagatcgagaagatccaccccttcaccatcccagccatcatccggcccttctctgtgctgaactatgaccccccccagagagatgagttcctgggcacctgtgtgcagcacctgaacagctacctgggcatcctggaccccttcatcctggtgttcctgggcttcagcctggccaccctggagtacttccctgaggacctgctgaaggccatcttcaacatcaagttcctggcccggctggacagccagctggagatcctgagccccagccgcagcgcccgggtgcagttccacctgatggagctgaacagatctgtgtgcctggagtgcccagagttccagatcccctggttccatgaccgcttctgccagcagtacaacaagggcattggaggcatggatggcacccagcagcagatcttcaagatgctggccgaggtgctgggcggcatcaactgtgtgaaggcctctgtgctgaccccctactaccacaaggtggactttgagtgcatcctggacaagaggaagaagcccctgccctacggcagccacaacatcgccctgggccagctgcctgagatgccctgggagagcaacattgaaattgtgggcagccggctgcccccaggagctgagagaattgccctggagttcctggacagcaaggccctgtgcaggaacatcccccacatgaagggcaagagcgccatgaagaagaggcacctggagatcctgggctacagagtcatccagatcagccagtttgagtggaacagcatggccctgagcaccaaggatgccaggatggactacctgcgggagtgcatctttggagaggtgaagagctgcctgtag

SEQ ID NO: 34267 - DNA, 2415 bp, Artificial Sequence
  Description of Artificial Sequence: Synthetic coding sequence
atgaagaagacccctgtgttcctggagagcctggtgaccaacatgctgcggctgcgggccatctgccccttctcctggagggtcttccagttccggcccatcagctgtgagcccctcatcatccagatgaacaagtgcacagatgaggagcagatgtttggcttcatcgagaggaacaaggccatcctgtctgagaagcaggtgggctgtgcctttgacatgctgtggaagctgcagaagcagaagaccagcctgctgaagaatgcagaatatgtgcgggaccacccccagttcctgaccctgcacaacctggccaccaacaagttcaagctgatgaatgatgacaccctggtgaatgtgctgtatgtgacccagcagtttgctggggaggcccatgaccccctggtggaggccctggtgacagaggcctggaggcggctggagagatttgacatcaagctgctgtctgagttcagcagctgcctggccgaccagcacctgtacttcagccccctgatgggcaagattgctgacatcgtgcacaggaacctggagaccacccaggacctgagcagcctgtctgtgctgatggtgaacatcagcagcctcatcagccgccacttccagcagcagctggtgaacaagacagagctgctgtttgacaccatcgacagcagcgaggtgaatgtggccaagagcatcgccaagttcctgagaaatgtgcgctaccgctaccagcccctgctggagcgctgcaacaacgtgttcctgagcaatgtggaccacctggacctggacagcatcagcaagatcctgtctgtgtacaagttcctgcagttcaacagctttgagttcatcatcatggccaagaagaagctgacagagatgatccccctgtgcaaccacccagccagctttgtgaagctgtttgtggccctgggccccatcgccggccctgaggagaagaagcagctgaagagcaccatgctgctgatgtctgaggacctgactggagagcaggccctggccgtgctgggcgccatgggagacatggagagcaggaacagctgcctgatcaagagggtgacctctgtgctgcacaagcacctggatggctacaagcccctggagctgctgaagatcacccaggagctgaccttcctgcacttccagaggaaggagttctttgccaagctgcgggagctgctgctgagctacctgaagaacagcttcatccccacagaggtgtctgtgctggtgcgggccatcagcctgctgcccagcccccacctggatgaggtgggcatcagcagaattgaagctgtgctgccccagtgtgacctgaacaacctgagcagctttgccacctctgtgctgcgctggatccagcacgaccacatgtacctggacaacatgacagccaagcagctgaagctgctgcagaagctggaccactacggccggcagaggctgcagcacagcaacagcctggacctgctgaggaaggagctgaagagcctgaagggcaacaccttccctgagagcctgctggaggagatgattgccaccctgcagcacttcatggatgacatcaactacatcaacgtgggggagatcgccagcttcatcagcagcacagactacctgagcaccctgctgctggacagaattgcctctgtggccgtgcagcagatcgagaagatccaccccttcaccatcccagccatcatccggcccttctctgtgctgaactatgaccccccccagagagatgagttcctgggcacctgtgtgcagcacctgaacagctacctgggcatcctggaccccttcatcctggtgttcctgggcttcagcctggccaccctggagtacttccctgaggacctgctgaaggccatcttcaacatcaagttcctggcccggctggacagccagctggagagcatcggcggcatggatggcacccagcagcagatcttcaagatgctggccgaggtgctgggcggcatcaactgtgtgaaggcctctgtgctgaccccctactaccacaaggtggactttgagtgcatcctggacaagaggaagaagcccctgccctacggcagccacaacatcgccctgggccagctgcctgagatgccctgggagagcaacatcgagatcgtgggcagccggctgcccccaggagctgagcgcatcgccctggagttcctggacagcaaggccctgtgcaggaacatcccccacatgaagggcaagagcgccatgaagaagaggcacctggagatcctgggctacagagtcatccagatcagccagtttgagtggaacagcatggccctgagcaccaaggatgccaggatggactacctgcgggagtgcatctttggagaggtgaagagctgcctgtag

SEQ ID NO: 34268 - DNA, 1989 bp, Artificial Sequence
  Description of Artificial Sequence: Synthetic coding sequence
atggccctgatcaccctgaggaagaacctgtaccgcctgagtgacttccagatgcaccgggccctggccgccctgaagaacaagcccctgaaccacgtgcacaaggtggtgaaggagcggctgtgcccctggctgtgcagccggcagcctgagccctttggagtgaagttccaccacgcccactgcaagaagttccacagcaagaatggaaatgacctgcaccccctgggcggccctgtgttcagccaggtgtctgactgtgaccggctggagcagaatgtgaagaatgaggagagccagatgttctaccgccgcctgagcaacctgaccagcagcgaggaggtgctgtccttcatcagcaccatggagaccctgcctgacaccatggctgctggggccctgcagaggatctgtgaggtggagaagaaggatggagaccagggcctgcccaaggagatcctggagaacagcatcttccaggccctgtgcttccagtttgagaaggagcccagccagctgagcaacaccagcctggtgacagccctgcaggccctgatcctgctgcacgtggacccccagagcagcctgctgctgaacctggtggccgagtgccagaaccggctgaggaagggcggcatggaggtgaggaacctgtgcatcctgggggagagcctcatcaccctgcacagcagcggctgtgtgaccctggagctgatcatcaaccagctgcagggcgagaagctggagaccttcaccccagaggacatcgtggccctgtaccgcatcctgcaggcctgcacagagaaggtggatgagcaccagaccttcctgaacaagatcaacaacttcagcctgagcatcgtgagcaacctgagccccaagctgatcagccagatgctgacagccctggtggtgctggaccagagccaggccttccccctcatcatcaagctgggcaagtatgtggtgagacatgtgccccacttcaccaatgaggagctgcggcgggtgctggaggccttcatctacttcggccaccacgacaccttcttcaccaaggccctggagcaccgggtggccgctgtgtgcctgaccctggaccctgaggtggtgtgccgggtgatggagtactgcagccgggagctgatcctgagcaagcccatcctgaatgctgtggccgagacctttgtgtgccagacagagaagttcagcccccggcagatcagcgccctgatggagccctttgggaagctgaactacctgcccccaaatgccagcgccctcttcaggaagctggagaatgtgctcttcacccacttcaactacttcccccccaagagcctgctgaagctgctgcacagctgcagcctgaatgaatgccaccctgtgaacttcctggccaagatcttcaagcccctcttcctgcagaggctgcagggcaaggagagccacctggacaccctgagccgggcccagctgacccagctgttcctggcctctgtgctggagtgccccttctacaagggccccaagctgctgcccaagtaccaggtgaagagcttcctgaccccctgctgcagcctggagacccctgtggacagccagctgtaccgctacgtgaagattggcctgaccaacctgctgggcgcccggctgtactttgcccccaaggtgctgaccccctactgctacaccattgatgtggagatcaagctggatgaggagggctttgtgctgcccagcacagccaatgaagacatccacaagagaattgccctgtgcattgatggccccaagcgcttctgcagcaacagcaagcacctgctgggcaaggaggccatcaagcagaggcacctgcagctgctgggctaccaggtggtgcagatcccctaccacgagatcggcatgctgaagagccggcgggagctggtggagtacctgcagaggaagctgttcagccagaacacagtgcactggctgcaggagtag

SEQ ID NO: 34269 - DNA, 738 bp, Artificial Sequence
  Description of Artificial Sequence: Synthetic coding sequence
atggccctgatcaccctgaggaagaacctgtaccgcctgagtgacttccagatgcaccgggccctggccgccctgaagaacaagcccctgaaccacgtgcacaaggtggtgaaggagcggctgtgcccctggctgtgcagccggcagcctgagccctttggagtgaagttccaccacgcccactgcaagaagttccacagcaagaatggaaatgacctgcaccccctgggcggccctgtgttcagccaggtgtctgactgtgaccggctggagcagaatgtgaagaatgaggagagccagatgttctaccgccgcctgagcaacctgaccagcagcgaggaggtgctgtccttcatcagcaccatggagaccctgcctgacaccatggctgctggggccctgcagaggatctgtgaggtggagaagaaggatggagaccagggcctgcccaaggagatcctggagaacagcatcttccaggccctgtgcttccagtttgagaaggagcccagccagctgagcaacaccagcctggtgacagccctgcaggccctgatcctgctgcacgtggacccccagagcagcctgctgctgaacctggtggccgagtgccagaaccggctgaggaagggcggcatggaggtgaggaacctgtgcatcctgggggagagcctcatcaccctgcacagcagcggctgtgtgaccctggagctgatcatcaaccagctgcagggctag

SEQ ID NO: 34270 - DNA, 879 bp, Artificial Sequence
  Description of Artificial Sequence: Synthetic coding sequence
atggagcggggccctgtggtgggcgccggcctgggcgctggggcccgcatccaggccctgctgggctgcctgctgaaggtgctgctgtgggtggccagcgccctgctgtacttcggcagcgagcaggccgcccggctgctgggcagcccctgcctgcggcggctgtaccacgcctggctggccgctgtggtgatcttcggccccctgctgcagttccacgtgaaccccaggaccatctttgccagccacggcaacttcttcaacatcaagtttgtgaacagcgcctggggctggacctgcaccttcctgggcggctttgtgctgctggtggtgttcctggccacccggcgggtggccgtgacagcccggcacctgagccggctggtggtgggcgctgctgtgtggaggggggccggccgggccttcctgctgattgaggacctgaccggcagctgctttgagcccctgccccagggcctgctgctgcacgagctgcctgaccggcgcagctgcctggccgccggccaccagtggaggggctacacagtgagcagccacaccttcctgctgaccttctgctgcctgctgatggccgaggaggccgctgtgtttgccaagtacctggcccacggcctgcctgctggggcccccctgcggctggtgttcctgctgaatgtgctgctgctgggcctgtggaacttcctgctgctgtgcaccgtcatctacttccaccagtacacccacaaggtggtgggcgctgctgtgggcacctttgcctggtacctgacctacggctcctggtaccaccagccctggagccctggcagccctggccacggcctcttcccccggccccacagcagcaggaagcacaactag

SEQ ID NO: 34271 - DNA, 789 bp, Artificial Sequence
  Description of Artificial Sequence: Synthetic coding sequence
atggagcacctggagcgctgtgagtggctgctgcggggcaccctggtgcgggctgctgtgcggcgctacctgccctgggccctggtggcctccatgctggccggcagcctgctgaaggagctgagccccctgcctgagagctacctgagcaacaagagaaatgtgctgaatgtgtactttgtgaaggtggcctgggcctggaccttctgcctgctgctgcccttcatcgccctgaccaactaccacctgaccgggaaggccggcctggtgctgcggcggctgagcaccctgctggtgggcacagccatctggtacatctgcaccagcatcttcagcaacatcgagcactacacaggcagctgctaccagagccctgccctggagggcgtgaggaaggagcaccagagcaagcagcagtgccaccaggagggcggcttctggcacggctttgacatcagcggccacagcttcctgctgaccttctgtgccctgatgattgtggaggagatgtctgtgctgcacgaggtgaagacagacaggagccactgcctgcacacagccatcaccaccctggtggtggccctgggcatcctgaccttcatctgggtgctgatgttcctgtgcacagctgtgtacttccacaacctgagccagaaggtgtttggcaccctgtttggcctgctgtcctggtacggcacctacggcttctggtaccccaaggccttcagccctggcctgcccccccagagctgcagcctgaacctgaagcaggacagctacaagaagtag

SEQ ID NO: 34272 - DNA, 1053 bp, Artificial Sequence
  Description of Artificial Sequence: Synthetic coding sequence
atggagcccacagagcccatggagcccacagagcccatggagcccgcccggagcgcccaccggggcggggaggccctgctgcgggagctggaggtgctggtgcaggatgtggtgaggaccagctcctggtgggagagacatggagtggactgtgccatcctggccctgagcctgtttgccctgcctgctggcttcctgtgcctgcgctgggagaatgccctggtgtttgccagcggcatcaccatcctgggcgtgtgccactacaccctgactgtgaagggcagccacctggccacccacggggccctgacagagagcaagcgctggagcaagatctggctgctcttctttgtggaggtgtgcacagccttcaccgctgagcacgccacccacggccacgtgaagatgcaccacgcctacaccaacgtggtgggcctgggggacagcagcacctggaggctgccctgcctgaaccgctacgtgtacatgttcctggcccccttcctgctgcccatcgccacccccctggtggccgtggagcggctgaggaaggtggagctgggcacagccctgcggaccctggccctgatcagcctgggcctgtacagccactactggctgctgctgaatgtgtctggcttcaagaaccccagcagcgccctgggctgcatgttcctgaccaggagcctgctggcccacccctacctgcacgtgaacatcttccagcacatcggcctgcccatgttcagccgggacaacaagccccggcgcatccacatgatgagcctgggcgtgctgaacctggcccggctgcctgtgctggactgggccttcggccacagcatcatcagctgccacgtggagcaccacctgttcccccggctgagtgacaacatgtgcctgaaggtgaagcctgtggtgtcccagttcctgcgggagaagcagctgccctacaatgaagacagctacctggcccgcttccagctgttcctgcggcgctatgaggagttcatggtgcaggccccacccatcacagagctggtgggcctgtag

SEQ ID NO: 34273 - DNA, 615 bp, Artificial Sequence
  Description of Artificial Sequence: Synthetic coding sequence
atgcagggcctgcggcgctggggctgcagccctggcagccagaggagctgcatcgcccagctgtgcctgaccggcacccctgtgtccttcctggtgcccagcagccgctgtgcccagcccagcctgcagagcacccccaggatgggcaccagccgctgcaccatgcccacccccacctggtgggcctggggcaccccagcccggggcggctgcctggccagcacagccatgagcacctgcagcctgctgctgagcagcagccccagccccctgcactggtggctgagccacatcggcctgcccatgttcagccgggacaacaagccccggcgcatccacatgatgagcctgggcgtgctgaacctggcccggctgcctgtgctggactgggccttcggccacagcatcatcagctgccacgtggagcaccacctgttcccccggctgagtgacaacatgtgcctgaaggtgaagcctgtggtgtcccagttcctgcgggagaagcagctgccctacaatgaagacagctacctggcccgcttccagctgttcctgcggcgctatgaggagttcatggtgcaggccccacccatcacagagctggtgggcctgtag

SEQ ID NO: 34274 - DNA, 1548 bp, Artificial Sequence
  Description of Artificial Sequence: Synthetic coding sequence
atggtgtccatccctgagtactatgagggcaagaatgtgctgctgaccggggccaccggcttcctgggcaaggtgctgctggagaagctgctgcggagctgccccaaggtgaacagcgtgtatgtgctggtgcggcagaaggccggccagaccccccaggagcgggtggaggaggtgctgagcggcaagctgtttgaccggctgagagatgaaaatccagacttccgggagaagatcatcgccatcaacagcgagctgacccagcccaagctggccctgtctgaggaggacaaggaggtgatcatcgacagcaccaacatcatcttccactgtgccgccaccgtgcgcttcaatgaaaacctgagagatgctgtgcagctgaatgtcatcgccacccggcagctgatcctgctggcccagcagatgaagaacctggaggtgttcatgcacgtgtccacagcctatgcctactgcaacaggaagcacattgatgaggtggtgtacccacctcctgtggaccccaagaagctgattgacagcctggagtggatggatgatggcctggtgaatgacatcacccccaagctgattggagaccggcccaacacctacatctacaccaaggccctggccgagtatgtggtgcagcaggagggcgccaagctgaatgtggccatcgtgcggcccagcatcgtgggcgcctcctggaaggagcccttccctggctggattgacaacttcaacggccccagcggcctcttcatcgctgctgggaagggcatcctgcggaccatccgggccagcaacaatgccctggccgacctggtgcctgtggatgtggtggtgaacatgagcctggccgccgcctggtacagcggcgtgaaccggcccaggaacatcatggtgtacaactgcaccaccggcagcaccaaccccttccactggggcgaggtggagtaccacgtgatcagcaccttcaagaggaaccccctggagcaggccttccggcggcccaacgtgaacctgaccagcaaccacctgctgtaccactactggattgctgtgagccacaaggccccagccttcctgtatgacatctacctgaggatgacaggccgcagccccaggatgatgaagaccatcacccggctgcacaaggccatggtgttcctggagtacttcaccagcaacagctgggtgtggaacacagaaaatgtgaacatgctgatgaaccagctgaaccctgaggacaagaagaccttcaacattgatgtgcggcagctgcactgggccgagtacatcgagaactactgcctgggcaccaagaagtatgtgctgaatgaggagatgagcggcctgcctgctgccaggaagcacctgaacaagctgaggaacatccgctatggcttcaacaccatcctggtgatcctgatctggaggatcttcatcgcccggagccagatggccaggaacatctggtactttgtggtgtccctgtgctacaagttcctgagctacttccgggccagcagcaccatgagatactag

SEQ ID NO: 34275 - DNA, 1029 bp, Artificial Sequence
  Description of Artificial Sequence: Synthetic coding sequence
atggtgtccatccctgagtactatgagggcaagaatgtgctgctgaccggggccaccggcttcctgggcaaggtgctgctggagaagctgctgcggagctgccccaaggtgaacagcgtgtatgtgctggtgcggcagaaggccggccagaccccccaggagcgggtggaggaggtgctgagcggcaagctgtttgaccggctgagagatgaaaatccagacttccgggagaagatcatcgccatcaacagcgagctgacccagcccaagctggccctgtctgaggaggacaaggaggtgatcatcgacagcaccaacatcatcttccactgtgccgccaccgtgcgcttcaatgaaaacctgagagatgctgtgcagctgaatgtcatcgccacccggcagctgatcctgctggcccagcagatgaagaacctggaggtgttcatgcacgtgtccacagcctatgcctactgcaacaggaagcacattgatgaggtggtgtacccacctcctgtggaccccaagaagctgattgacagcctggagtggatggatgatggcctggtgaatgacatcacccccaagctgattggagaccggcccaacacctacatctacaccaaggccctggccgagtatgtggtgcagcaggagggcgccaagctgaatgtggccatcgtgcggcccagcatcgtgggcgcctcctggaaggagcccttccctggctggattgacaacttcaacggccccagcggcctcttcatcgctgctgggaagggcatcctgcggaccatccgggccagcaacaatgccctggccgacctggtgcctgtggatgtggtggtgaacatgagcctggccgccgcctggtacagcggcgtgaaccggcccaggaacatcatggtgtacaactgcaccaccggcagcaccaaccccttccactggggcgaggtgggcatgatcctgcctgtgttcctgaatgtgcgcatcaacctgaaggagcccaggaagaagaagaagaagaagtag

SEQ ID NO: 34276 - DNA, 1548 bp, Artificial Sequence
  Description of Artificial Sequence: Synthetic coding sequence
atgagcaccatcgccgccttctacggcggcaagagcatcctgatcaccggggccaccggcttcctgggcaaggtgctgatggagaagctgttccgcaccagcccagacctgaaggtgatctacatcctggtgcggcccaaggccggccagaccctgcagcagagggtcttccagatcctggacagcaagctgtttgagaaggtgaaggaggtgtgccccaacgtgcatgagaagatccgggccatctatgctgacctgaaccagaatgactttgccatcagcaaggaggacatgcaggagctgctgagctgcaccaacatcatcttccactgtgccgccaccgtgcgctttgatgacaccctgcggcatgctgtgcagctgaatgtgacagccacccggcagctgctgctgatggccagccagatgcccaagctggaggccttcatccacatcagcacagcctacagcaactgcaacctgaagcacattgatgaggtgatctacccctgccctgtggagcccaagaagatcatcgacagcctggagtggctggatgatgccatcattgatgagatcacccccaagctgatccgggactggcccaacatctacacctacaccaaggccctgggggagatggtggtgcagcaggagagcaggaacctgaacatcgccatcatccggcccagcatcgtgggcgccacctggcaggagcccttccctggctgggtggacaacatcaatggccccaacggcatcatcatcgccaccgggaagggcttcctgcgggccatcaaggccacccccatggctgtggctgatgtgattcctgtggacacagtggtgaacctgatgctggccgtgggctggtacacagctgtgcaccggcccaagagcaccctggtgtaccacatcaccagcggcaacatgaacccctgcaactggcacaagatgggcgtgcaggtgctggccacctttgagaagatcccctttgagcggcccttccggcggcccaatgccaacttcaccagcaacagcttcaccagccagtactggaatgctgtgagccaccgggccccagccatcatctatgactgctacctgcggctgactggaaggaagcccaggatgaccaagctgatgaaccggctgctgaggacagtgtccatgctggagtacttcatcaacagatcctgggagtggagcacctacaacacagagatgctgatgtctgagctgagccctgaggaccagagggtcttcaactttgatgtgcggcagctgaactggctggagtacattgaaaattatgtgctgggcgtgaagaagtacctgctgaaggaggacatggccggcatccccaaggccaagcagaggctgaagaggctgaggaacatccactacctgttcaacacagccctcttcctgattgcctggaggctgctgattgcccggagccagatggccagaaatgtgtggttcttcatcgtgtccttctgctacaagttcctgagctacttccgggccagcagcaccctgaaggtgtag

SEQ ID NO: 34277 - DNA, 1548 bp, Artificial Sequence; identical to SEQ ID NO: 34276
  Description of Artificial Sequence: Synthetic coding sequence

SEQ ID NO: 34278 - DNA, 609 bp, Artificial Sequence
  Description of Artificial Sequence: Synthetic coding sequence
atgctgctgtggagcctgctggtgatctttgagcgggtgcgggagaacctggacagcctgaccctggtggcccccagctctgtgtttgaaggagacagcatcgtgctgaagtgccagggcgagcagaactggaagatccagaagatggcctaccacaaggacaacaaggagctgtctgtgttcaagaagttcagtgacttcctgatccagagcgctgtgctgagtgacagcggcaactacttctgcagcaccaagggccagctgttcctgtgggacaagaccagcaacatcgtgaagatcaaggtgcagggcccagatggctacagaagagacctgatgacagctggggtgctgtggggcctgtttggagtgctgggcttcaccggggtggccctgctgctgtatgccctcttccacaagatcagcggggagagcagcgccaccaatgagcccaggggggccagccggcccaacccccaggagttcacctacagcagccccaccccagacatggaggagctgcagcctgtgtatgtgaatgccaacatccgcaccctgctggagaacaaggacagccaggtgatctacagctctgtgaagaagagctag

SEQ ID NO: 34279 - DNA, 1527 bp, Artificial Sequence
  Description of Artificial Sequence: Synthetic coding sequence
atgctgctgtggagcctgctggtgatctttgatgctgtgacagagcaggccgacagcctgaccctggtggcccccagctctgtgtttgaaggagacagcatcgtgctgaagtgccagggcgagcagaactggaagatccagaagatggcctaccacaaggacaacaaggagctgtctgtgttcaagaagttcagtgacttcctgatccagagcgctgtgctgagtgacagcggcaactacttctgcagcaccaagggccagctgttcctgtgggacaagaccagcaacatcgtgaagatcaaggtgcaggagctgttccagaggcctgtgctgacagccagcagcttccagcccattgaaggaggccctgtgtccctgaagtgtgagacccggctgagcccccagaggctggatgtgcagctgcagttctgcttcttccgggagaaccaggtgctgggcagcggctggagcagcagccctgagctgcagatctctgctgtgtggagcgaggacaccggcagctactggtgcaaggccgagaccgtgacccaccgcatcaggaagcagagcctgcagagccagatccacgtgcagaggatccccatcagcaatgtgtccctggagatccgggcccctgggggccaggtgacagagggccagaagctgatcctgctgtgcagcgtggccggcggcactggaaatgtgaccttctcctggtaccgggaggccaccggcacctccatgggcaagaagacccagaggagcctgtctgctgagctggagatcccagctgtgaaggagagtgatgctgggaagtactactgcagagctgacaatggacatgtgcccatccagagcaaggtggtgaacatccctgtgcgcatccctgtgtccaggcctgtgctgaccctgcggagccctggggcccaggccgctgtgggggacctgctggagctgcactgtgaggccctgcggggcagcccccccatcctgtaccagttctaccatgaagatgtgaccctgggcaacagcagcgcccccagcggcggcggggccagcttcaacctgagcctgacagctgagcacagcggcaactacagctgtgaggccaacaacggcctgggcgcccagtgcagcgaggccgtgcctgtgtccatcagcggcccagatggctacagaagagacctgatgacagctggggtgctgtggggcctgtttggagtgctgggcttcaccggggtggccctgctgctgtatgccctcttccacaagatcagcggggagagcagcgccaccaatgagcccaggggggccagccggcccaacccccaggagttcacctacagcagccccaccccagacatggaggagctgcagcctgtgtatgtgaatgtgggctctgtggatgtggatgtggtgtacagccaggtgtggagcatgcagcagcctgagagcagcgccaacatccgcaccctgctggagaacaaggacagccaggtgatctacagctctgtgaagaagagctag

SEQ ID NO: 34280 - DNA, 609 bp, Artificial Sequence
  Description of Artificial Sequence: Synthetic coding sequence
atgctgctgtggagcctgctggtgatctttgatgctgtgacagagcaggccgacagcctgaccctggtggcccccagctctgtgtttgaaggagacagcatcgtgctgaagtgccagggcgagcagaactggaagatccagaagatggcctaccacaaggacaacaaggagctgtctgtgttcaagaagttcagtgacttcctgatccagagcgctgtgctgagtgacagcggcaactacttctgcagcaccaagggccagctgttcctgtgggacaagaccagcaacatcgtgaagatcaaggtgcagggcccagatggctacagaagagacctgatgacagctggggtgctgtggggcctgtttggagtgctgggcttcaccggggtggccctgctgctgtatgccctcttccacaagatcagcggggagagcagcgccaccaatgagcccaggggggccagccggcccaacccccaggagttcacctacagcagccccaccccagacatggaggagctgcagcctgtgtatgtgaatgccaacatccgcaccctgctggagaacaaggacagccaggtgatctacagctctgtgaagaagagctag

SEQ ID NO: 34281 - DNA, 1335 bp, Artificial Sequence
  Description of Artificial Sequence: Synthetic coding sequence
atgctgctgtggagcctgctggtgatctttgatgctgtgacagagcaggccgacagcctgaccctggtggcccccagctctgtgtttgaaggagacagcatcgtgctgaagtgccagggcgagcagaactggaagatccagaagatggcctaccacaaggacaacaaggagctgtctgtgttcaagaagttcagtgacttcctgatccagagcgctgtgctgagtgacagcggcaactacttctgcagcaccaagggccagctgttcctgtgggacaagaccagcaacatcgtgaagatcaaggtgcaggagctgttccagaggcctgtgctgacagccagcagcttccagcccattgaaggaggccctgtgtccctgaagtgtgagacccggctgagcccccagaggctggatgtgcagctgcagttctgcttcttccgggagaaccaggtgctgggcagcggctggagcagcagccctgagctgcagatctctgctgtgtggagcgaggacaccggcagctactggtgcaaggccgagaccgtgacccaccgcatcaggaagcagagcctgcagagccagatccacgtgcagaggatccccatcagcaatgtgtccctggagatccgggcccctgggggccaggtgacagagggccagaagctgatcctgctgtgcagcgtggccggcggcactggaaatgtgaccttctcctggtaccgggaggccaccggcacctccatgggcaagaagacccagaggagcctgtctgctgagctggagatcccagctgtgaaggagagtgatgctgggaagtactactgcagagctgacaatggacatgtgcccatccagagcaaggtggtgaacatccctgtgcgcatccctgtgtccaggcctgtgctgaccctgcggagccctggggcccaggccgctgtgggggacctgctggagctgcactgtgaggccctgcggggcagcccccccatcctgtaccagttctaccatgaagatgtgaccctgggcaacagcagcgcccccagcggcggcggggccagcttcaacctgagcctgacagctgagcacagcggcaactacagctgtgaggccaacaacggcctgggcgcccagtgcagcgaggccgtgcctgtgtccatcagcggcccagatggctacagaagagacctgatgacagctggggtgctgtggggcctgtttggagtgctgggcttcaccggggtggccctgctgctgtatgccctcttccacaagatcagcggggagagcagcgccaccaatgagcccaggacccccaagagcagcaccctgctgtag

SEQ ID NO: 34282 - DNA, 579 bp, Artificial Sequence
  Description of Artificial Sequence: Synthetic coding sequence
atgtgggagtggaagatctgcaacagccacggggcccggccctttgctgagcctgctggctgggagtttgtgaacctgctgcggcaccacaagagcttcctgattgcccccctgtgcctgtctgtgcctgtgtccaggcctgtgctgaccctgcggagccctggggcccaggccgctgtgggggacctgctggagctgcactgtgaggccctgcggggcagcccccccatcctgtaccagttctaccatgaagatgtgaccctgggcaacagcagcgcccccagcggcggcggggccagcttcaacctgagcctgacagctgagcacagcggcaactacagctgtgaggccaacaacggcctgggcgcccagtgcagcgaggccgtgcctgtgtccatcagcggcccagatggctaccgccgggacctgatgacagctggggtgctgtggggcctgtttggagtgctgggcttcaccggggtggccctgctgctgtatgccctcttccacaagatcagcggctgcatctaccacctggacagcccctactttgccatgaccttccccctgctgatctag

SEQ ID NO: 34283 - DNA, 2124 bp, Artificial Sequence
  Description of Artificial Sequence: Synthetic coding sequence
atgctgctgtggctgctgctgctgatcctgaccccaggccgggagcagagcggcgtggcccccaaggctgtgctgctgctgaaccccccctggagcacagccttcaagggggagaaggtggccctgatctgcagcagcatcagccacagcctggcccagggcgacacctactggtaccatgatgagaagctgctgaagatcaagcatgacaagatccagatcacagagcccggcaactaccagtgcaagacccggggcagcagcctgagtgatgctgtgcacgtggagttctccccagactggctgatcctgcaggccctgcaccctgtgtttgaaggagacaacgtcatcctgcgctgccagggcaaggacaacaagaacacccaccagaaggtgtactacaaggatggcaagcagctgcccaacagctacaacctggagaagatcaccgtgaacagcgtgtcccgggacaacagcaagtaccactgcacagcctacaggaagttctacatcctggacatcgaggtgaccagcaagcccctgaacatccaggtgcaggagctgttcctgcaccctgtgctgcgggccagcagcagcacccccatcgagggcagccccatgaccctgacctgtgagacccagctgagcccccagaggccagatgtgcagctgcagttcagcctcttccgggacagccagaccctgggcctgggctggagccgcagcccccggctgcagatcccagccatgtggacagaagattctggcagctactggtgtgaggtggagaccgtgacccacagcatcaagaagaggagcctgcggagccagatccgggtgcagagggtgcctgtgtccaatgtgaacctggagatccggcccactggaggccagctgattgaaggagagaacatggtgctgatctgcagcgtggcccagggcagcggcaccgtgaccttctcctggcacaaggagggccgggtgcgcagcctgggcaggaagacccagaggagcctgctggccgagctgcacgtgctgactgtgaaggagagtgatgctggccgctactactgtgccgctgacaacgtgcacagccccatcctgagcacctggatccgggtgacagtgcgcatccctgtgagccaccctgtgctgaccttccgggccccccgggcccacacagtggtgggggacctgctggagctgcactgtgagagcctgcggggcagcccccccatcctgtaccgcttctaccatgaagatgtgaccctgggcaacagcagcgcccccagcggcggcggggccagcttcaacctgagcctgacagctgagcacagcggcaactacagctgtgatgctgacaatggcctgggcgcccagcacagccatggagtgtccctgcgggtgacagtgcctgtgtccaggcctgtgctgaccctgcgggcccctggggcccaggccgtggtgggggacctgctggagctgcactgtgagagcctgcggggcagcttccccatcctgtactggttctaccatgaagatgacaccctgggcaacatcagcgcccacagcggcggcggggccagcttcaacctgagcctgaccacagagcacagcggcaactacagctgtgaggccgacaatggcctgggcgcccagcacagcaaggtggtgaccctgaatgtgacaggcaccagcaggaacagaacaggcctgacagctgctggcatcaccggcctggtgctgagcatcctggtgctggccgctgctgctgccctgctgcactacgcccgggcccggaggaagccaggcggcctgagcgccaccggcaccagcagccacagccccagcgagtgccaggagcccagcagcagccggcccagcagaattgacccccaggagcccacccacagcaagcccctggcccccatggagctggagcccatgtacagcaatgtgaaccctggggacagcaaccccatctacagccagatctggagcatccagcacaccaaggaaaattctgccaactgccccatgatgcaccaggagcacgaggagctgactgtgctgtacagcgagctgaagaaggagcagagcagccgcttctccatgagcctgtag

SEQ ID NO: 34284 - DNA, 2205 bp, Artificial Sequence
  Description of Artificial Sequence: Synthetic coding sequence
atgctgctgtggctgctgctgctgatcctgaccccaggccgggagcagagcggcgtggcccccaaggctgtgctgctgctgaaccccccctggagcacagccttcaagggggagaaggtggccctgatctgcagcagcatcagccacagcctggcccagggcgacacctactggtaccatgatgagaagctgctgaagatcaagcatgacaagatccagatcacagagcccggcaactaccagtgcaagacccggggcagcagcctgagtgatgctgtgcacgtggagttctccccagactggctgatcctgcaggccctgcaccctgtgtttgaaggagacaacgtcatcctgcgctgccagggcaaggacaacaagaacacccaccagaaggtgtactacaaggatggcaagcagctgcccaacagctacaacctggagaagatcaccgtgaacagcgtgtcccgggacaacagcaagtaccactgcacagcctacaggaagttctacatcctggacatcgaggtgaccagcaagcccctgaacatccaggtgcaggagctgttcctgcaccctgtgctgcgggccagcagcagcacccccatcgagggcagccccatgaccctgacctgtgagacccagctgagcccccagaggccagatgtgcagctgcagttcagcctcttccgggacagccagaccctgggcctgggctggagccgcagcccccggctgcagatcccagccatgtggacagaagattctggcagctactggtgtgaggtggagaccgtgacccacagcatcaagaagaggagcctgcggagccagatccgggtgcagagggtgcctgtgtccaatgtgaacctggagatccggcccactggaggccagctgattgaaggagagaacatggtgctgatctgcagcgtggcccagggcagcggcaccgtgaccttctcctggcacaaggagggccgggtgcgcagcctgggcaggaagacccagaggagcctgctggccgagctgcacgtgctgactgtgaaggagagtgatgctggccgctactactgtgccgctgacaacgtgcacagccccatcctgagcacctggatccgggtgacagtgcgcatccctgtgagccaccctgtgctgaccttccgggccccccgggcccacacagtggtgggggacctgctggagctgcactgtgagagcctgcggggcagcccccccatcctgtaccgcttctaccatgaagatgtgaccctgggcaacagcagcgcccccagcggcggcggggccagcttcaacctgagcctgacagctgagcacagcggcaactacagctgtgatgctgacaatggcctgggcgcccagcacagccatggagtgtccctgcgggtgacagtgcctgtgtccaggcctgtgctgaccctgcgggcccctggggcccaggccgtggtgggggacctgctggagctgcactgtgagagcctgcggggcagcttccccatcctgtactggttctaccatgaagatgacaccctgggcaacatcagcgcccacagcggcggcggggccagcttcaacctgagcctgaccacagagcacagcggcaactacagctgtgaggccgacaatggcctgggcgcccagcacagcaaggtggtgaccctgaatgtgacaggcaccagcaggaacagaacaggcctgacagctgctggcatcaccggcctggtgctgagcatcctggtgctggccgctgctgctgccctgctgcactacgcccgggcccggaggaagccaggcggcctgagcgccaccggcaccagcagccacagccccagcgagtgccaggagcccagcagcagccggcccagcagaattgacccccaggagcccacccacagcaagcccctggcccccatggagctggagcccatgtacagcaatgtgaaccctggggacagcaaccccatctacagccagatctggagcatccagcacaccaaggaaaattctgccaactgccccatgatgcaccaggagcacgaggagctgactgtgctgtacagcgagctgaagaagacccacccagatgattctgctggggaggccagcagccggggccgggcccacgaggaggatgatgaggagaactatgaaaatgtgccccgggtgctgctggccagtgaccactag

SEQ ID NO: 34285 - DNA, 2229 bp, Artificial Sequence
  Description of Artificial Sequence: Synthetic coding sequence
atgctgctgtggctgctgctgctgatcctgaccccaggccgggagcagagcggcgtggcccccaaggctgtgctgctgctgaaccccccctggagcacagccttcaagggggagaaggtggccctgatctgcagcagcatcagccacagcctggcccagggcgacacctactggtaccatgatgagaagctgctgaagatcaagcatgacaagatccagatcacagagcccggcaactaccagtgcaagacccggggcagcagcctgagtgatgctgtgcacgtggagttctccccagactggctgatcctgcaggccctgcaccctgtgtttgaaggagacaacgtcatcctgcgctgccagggcaaggacaacaagaacacccaccagaaggtgtactacaaggatggcaagcagctgcccaacagctacaacctggagaagatcaccgtgaacagcgtgtcccgggacaacagcaagtaccactgcacagcctacaggaagttctacatcctggacatcgaggtgaccagcaagcccctgaacatccaggtgcaggagctgttcctgcaccctgtgctgcgggccagcagcagcacccccatcgagggcagccccatgaccctgacctgtgagacccagctgagcccccagaggccagatgtgcagctgcagttcagcctcttccgggacagccagaccctgggcctgggctggagccgcagcccccggctgcagatcccagccatgtggacagaagattctggcagctactggtgtgaggtggagaccgtgacccacagcatcaagaagaggagcctgcggagccagatccgggtgcagagggtgcctgtgtccaatgtgaacctggagatccggcccactggaggccagctgattgaaggagagaacatggtgctgatctgcagcgtggcccagggcagcggcaccgtgaccttctcctggcacaaggagggccgggtgcgcagcctgggcaggaagacccagaggagcctgctggccgagctgcacgtgctgactgtgaaggagagtgatgctggccgctactactgtgccgctgacaacgtgcacagccccatcctgagcacctggatccgggtgacagtgcgcatccctgtgagccaccctgtgctgaccttccgggccccccgggcccacacagtggtgggggacctgctggagctgcactgtgagagcctgcggggcagcccccccatcctgtaccgcttctaccatgaagatgtgaccctgggcaacagcagcgcccccagcggcggcggggccagcttcaacctgagcctgacagctgagcacagcggcaactacagctgtgatgctgacaatggcctgggcgcccagcacagccatggagtgtccctgcgggtgacagtgcctgtgtccaggcctgtgctgaccctgcgggcccctggggcccaggccgtggtgggggacctgctggagctgcactgtgagagcctgcggggcagcttccccatcctgtactggttctaccatgaagatgacaccctgggcaacatcagcgcccacagcggcggcggggccagcttcaacctgagcctgaccacagagcacagcggcaactacagctgtgaggccgacaatggcctgggcgcccagcacagcaaggtggtgaccctgaatgtgacaggcaccagcaggaacagaacaggcctgacagctgctggcatcaccggcctggtgctgagcatcctggtgctggccgctgctgctgccctgctgcactacgcccgggcccggaggaagccaggcggcctgagcgccaccggcaccagcagccacagccccagcgagtgccaggagcccagcagcagccggcccagcagaattgacccccaggagcccacccacagcaagcccctggcccccatggagctggagcccatgtacagcaatgtgaaccctggggacagcaaccccatctacagccagatctggagcatccagcacaccaaggaaaattctgccaactgccccatgatgcaccaggagcacgaggagctgactgtgctgtacagcgagctgaagaagacccacccagatgattctgctggggaggccagcagccggggccgggcccacgaggaggatgatgaggagaactatgagaacatcctgaaccccaggaagaacaaggtgcaggacttcccctgcctgtgcaacacctag

SEQ ID NO: 34286 - DNA, 2205 bp, Artificial Sequence; identical to SEQ ID NO: 34284
  Description of Artificial Sequence: Synthetic coding sequence

SEQ ID NO: 34287 - DNA, 1548 bp, Artificial Sequence
  Description of Artificial Sequence: Synthetic coding sequence
atgctgctgtgggccagcctgctggcctttgcccctgtgtgtggccagagcgctgctgcccacaagcctgtgatctctgtgcaccccccctggaccaccttcttcaagggggagcgggtgaccctgacctgcaatggcttccagttctacgccacagagaagaccacctggtaccaccgccactactggggcgagaagctgaccctgaccccaggcaacaccctggaggtgcgggagagcggcctgtaccgctgccaggcccggggcagccccaggagcaaccctgtgcggctgctcttcagcagtgacagcctcatcctgcaggccccctacagcgtgtttgaaggagacaccctggtgctgcgctgccacagaagaaggaaggagaagctgacagctgtgaagtacacctggaatggaaacatcctgagcatcagcaacaagtcctgggacctgctgatcccccaggccagcagcaacaacaacggcaactaccgctgcatcggctatggagatgaaaatgatgtgttccgcagcaacttcaagatcatcaagatccaggagctgttcccccaccctgagctgaaggccacagacagccagcccacagagggcaacagcgtgaacctgagctgtgagacccagctgcccccagagaggagtgacacccccctgcacttcaacttcttcagagatggagaggtgatcctgagtgactggagcacctacccagagctgcagctgcccaccgtgtggagggagaacagcggcagctactggtgtggggctgagaccgtgcggggcaacatccacaagcacagccccagcctgcagatccacgtgcagagaattcctgtgtctggagtgctgctggagacccagcccagcggcggccaggccgtggagggggagatgctggtgctggtgtgcagcgtggccgagggcaccggggacaccaccttctcctggcaccgggaggacatgcaggagagcctgggcaggaagacccagaggagcctgcgggcagagctggagctgcctgccatccggcagagccacgccggcggctactactgcacagctgacaacagctatggccctgtgcagagcatggtgctgaatgtgacagtgcgggagaccccaggcaacagagatggcctggtggccgccggggccactggaggcctgctgagcgccctgctgctggccgtggccctgctcttccactgctggaggaggaggaagagcggcgtgggcttcctgggagatgagacccggctgcccccagcccctggccctggagagagcagccacagcatctgcccagcccaggtggagctgcagagcctgtatgtggatgtgcaccccaagaagggggacctggtgtacagcgagatccagaccacccagctgggggaggaggaggaggccaacaccagcaggaccctgctggaggacaaggatgtgtctgtggtgtacagcgaggtgaagacccagcacccagacaacagcgctgggaagatcagcagcaaggatgaggagagctag

SEQ ID NO: 34288 - DNA, 2934 bp, Artificial Sequence
  Description of Artificial Sequence: Synthetic coding sequence
atgctgctgtgggtgatcctgctggtgctggtgcccagccctggccagttccccaggaccccccggcccatcatcttcctgcagcccccctggaccaccgtcttccagggcgagcgggtgaccctgacctgcaagggcttccgcttctacagcccccagaagaccaagtggtaccaccgctacctgggcaaggagatcctgcgggagaccccagacaacatcctggaggtgcaggagagcggggagtaccgctgccaggcccagggcagccccctgagcagccctgtgcacctggacttcagcagcgccagcctcatcctgcaggcccccctgtctgtgtttgaaggagacagcgtggtgctgcgctgccgggccaaggccgaggtgaccctgaacaacaccatctacaagaatgacaacgtgctggccttcctgaacaagaggacagacttccacatcccccacgcctgcctgaaggacaatggagcctaccgctgcaccggctacaaggagagctgctgccctgtgagcagcaacacagtgaagatccaggtgcaggagcccttcaccaggcctgtgctgcgggccagcagcttccagcccatcagcggcaaccctgtgaccctgacctgtgagacccagctgagcctggagaggagtgatgtgcccctgcgcttccgcttcttcagagatgaccagaccctgggcctgggctggagcctgagccccaacttccagatcacagccatgtggagcaaggacagcggcttctactggtgcaaggccgccaccatgccctacagcgtcatcagtgacagccccaggtcctggatccaggtgcagatcccagccagccaccctgtgctgaccctgagccctgagaaggccctgaactttgagggcaccaaggtgaccctgcactgtgagacccaggaggacagcctgcggaccctgtaccgcttctaccatgaaggagtgcccctgcggcacaagtctgtgcgctgtgagcggggggccagcatctccttcagcctgaccacagagaacagcggcaactactactgcacagctgacaatggcctgggcgccaagcccagcaaggctgtgtccctgtctgtgacagtgcctgtgagccaccctgtgctgaacctgagcagccctgaggacctgatctttgagggcgccaaggtgaccctgcactgtgaggcccagaggggcagcctgcccatcctgtaccagttccaccacgagggcgccgccctggagaggagaagtgccaacagcgctggaggagtggccatctccttcagcctgacagctgagcacagcggcaactactactgcacagctgacaatggcttcggcccccagaggagcaaggctgtgtccctgtctgtgacagtgcctgtgagccaccctgtgctgaccctgagcagcgctgaggccctgacctttgaaggagccaccgtgaccctgcactgtgaggtgcagaggggcagcccccagatcctgtaccagttctaccacgaggacatgcccctgtggagcagcagcaccccatctgtgggccgggtgtccttctccttcagcctgacagagggccacagcggcaactactactgcacagctgacaatggatttggcccccagaggtctgaggtggtgtccctgtttgtgacagtgcctgtgtcccggcccatcctgaccctgcgggtgccccgggcccaggccgtggtgggggacctgctggagctgcactgtgaggccccccggggcagcccccccatcctgtactggttctaccatgaagatgtgaccctgggcagcagcagcgcccccagcggcggggaggccagcttcaacctgagcctgacagctgagcacagcggcaactacagctgtgaggccaacaacggcctggtggcccagcacagcgacaccatcagcctgtctgtgattgtgcctgtgtcccggcccatcctgaccttccgggccccccgggcccaggccgtggtgggggacctgctggagctgcactgtgaggccctgcggggcagcagccccatcctgtactggttctaccatgaagatgtgaccctgggcaagatcagcgcccccagcggcggcggggccagcttcaacctgagcctgaccacagagcacagcggcatctacagctgtgaggccgacaatggcctggaggcccagaggtctgagatggtgaccctgaaggtggccgtgcctgtgtccaggcctgtgctgaccctgcgggcccctggcacccatgctgctgtgggggacctgctggagctgcactgtgaggccctgcggggcagccccctcatcctgtaccgcttcttccatgaagatgtgaccctgggcaacagaagcagccccagcggcggggccagcctgaacctgagcctgacagctgagcacagcggcaactacagctgtgaggccgacaatggcctgggcgcccagaggtctgagaccgtgaccctgtacatcaccggcctgacagccaacagaagtggcccctttgccaccggggtggccggcggcctgctgagcattgctggcctggccgccggggccctgctgctgtactgctggctgagcaggaaggccggcaggaagccagccagtgaccctgcccggagccccagcgacagcgacagccaggagcccacctaccacaacgtgcctgcctgggaggagctgcagcctgtgtacaccaatgccaaccccagaggagaaaatgtggtgtacagcgaggtgcgcatcatccaggagaagaagaagcatgctgtggccagtgaccccaggcacctgaggaacaagggcagccccatcatctacagcgaggtgaaggtggccagcacccctgtgtctggcagcctcttcctggccagcagcgccccccacaggtag

SEQ ID NO: 34289 - DNA, 2934 bp, Artificial Sequence
  Description of Artificial Sequence: Synthetic coding sequence
atgctgctgtgggtgatcctgctggtgctggcccctgtgtctggccagtttgcccggaccccccggcccatcatcttcctgcagcccccctggaccaccgtcttccagggcgagcgggtgaccctgacctgcaagggcttccgcttctacagcccccagaagaccaagtggtaccaccgctacctgggcaaggagatcctgcgggagaccccagacaacatcctggaggtgcaggagagcggggagtaccgctgccaggcccagggcagccccctgagcagccctgtgcacctggacttcagcagcgccagcctcatcctgcaggcccccctgtctgtgtttgaaggagacagcgtggtgctgcgctgccgggccaaggccgaggtgaccctgaacaacaccatctacaagaatgacaacgtgctggccttcctgaacaagaggacagacttccacatcccccacgcctgcctgaaggacaatggagcctaccgctgcaccggctacaaggagagctgctgccctgtgagcagcaacacagtgaagatccaggtgcaggagcccttcaccaggcctgtgctgcgggccagcagcttccagcccatcagcggcaaccctgtgaccctgacctgtgagacccagctgagcctggagaggagtgatgtgcccctgcgcttccgcttcttcagagatgaccagaccctgggcctgggctggagcctgagccccaacttccagatcacagccatgtggagcaaggacagcggcttctactggtgcaaggccgccaccatgccctacagcgtcatcagtgacagccccaggtcctggatccaggtgcagatcccagccagccaccctgtgctgaccctgagccctgagaaggccctgaactttgagggcaccaaggtgaccctgcactgtgagacccaggaggacagcctgcggaccctgtaccgcttctaccatgaaggagtgcccctgcggcacaagtctgtgcgctgtgagcggggggccagcatctccttcagcctgaccacagagaacagcggcaactactactgcacagctgacaatggcctgggcgccaagcccagcaaggctgtgtccctgtctgtgacagtgcctgtgagccaccctgtgctgaacctgagcagccctgaggacctgatctttgagggcgccaaggtgaccctgcactgtgaggcccagaggggcagcctgcccatcctgtaccagttccaccacgagggcgccgccctggagaggagaagtgccaacagcgctggaggagtggccatctccttcagcctgacagctgagcacagcggcaactactactgcacagctgacaatggcttcggcccccagaggagcaaggctgtgtccctgtctgtgacagtgcctgtgagccaccctgtgctgaccctgagcagcgctgaggccctgacctttgaaggagccaccgtgaccctgcactgtgaggtgcagaggggcagcccccagatcctgtaccagttctaccacgaggacatgcccctgtggagcagcagcaccccatctgtgggccgggtgtccttctccttcagcctgacagagggccacagcggcaactactactgcacagctgacaatggatttggcccccagaggtctgaggtggtgtccctgtttgtgacagtgcctgtgtcccggcccatcctgaccctgcgggtgccccgggcccaggccgtggtgggggacctgctggagctgcactgtgaggccccccggggcagcccccccatcctgtactggttctaccatgaagatgtgaccctgggcagcagcagcgcccccagcggcggggaggccagcttcaacctgagcctgacagctgagcacagcggcaactacagctgtgaggccaacaacggcctggtggcccagcacagcgacaccatcagcctgtctgtgattgtgcctgtgtcccggcccatcctgaccttccgggccccccgggcccaggccgtggtgggggacctgctggagctgcactgtgaggccctgcggggcagcagccccatcctgtactggttctaccatgaagatgtgaccctgggcaagatcagcgcccccagcggcggcggggccagcttcaacctgagcctgaccacagagcacagcggcatctacagctgtgaggccgacaatggcctggaggcccagaggtctgagatggtgaccctgaaggtggccgtgcctgtgtccaggcctgtgctgaccctgcgggcccctggcacccatgctgctgtgggggacctgctggagctgcactgtgaggccctgcggggcagccccctcatcctgtaccgcttcttccatgaagatgtgaccctgggcaacagaagcagccccagcggcggggccagcctgaacctgagcctgacagctgagcacagcggcaactacagctgtgaggccgacaatggcctgggcgcccagaggtctgagaccgtgaccctgtacatcaccggcctgacagccaacagaagtggcccctttgccaccggggtggccggcggcctgctgagcattgctggcctggccgccggggccctgctgctgtactgctggctgagcaggaaggccggcaggaagccagccagtgaccctgcccggagccccagcgacagcgacagccaggagcccacctaccacaacgtgcctgcctgggaggagctgcagcctgtgtacaccaatgccaaccccagaggagaaaatgtggtgtacagcgaggtgcgcatcatccaggagaagaagaagcatgctgtggccagtgaccccaggcacctgaggaacaagggcagccccatcatctacagcgaggtgaaggtggccagcacccctgtgtctggcagcctcttcctggccagcagcgccccccacaggtag

SEQ ID NO: 34290 - DNA, 375 bp, Artificial Sequence
  Description of Artificial Sequence: Synthetic coding sequence
atgctgctgtgggtgatcctgctggtgctggcccctgtgtctggccagtttgcccggaccccccggcccatcatcttcctgcagcccccctggaccaccgtcttccagggcgagcgggtgaccctgacctgcaagggcttccgcttctacagcccccagaagaccaagtggtaccaccgctacctgggcaaggagatcctgcgggagaccccagacaacatcctggaggtgcaggagagcggggagtaccgctgccaggcccagggcagccccctgagcagccctgtgcacctggacttcagcagcgagatgggcttcccccatgctgcccaggccaacgtggagctgctgggcagcagtgacctgctgacctag

SEQ ID NO: 34291 - DNA, 1779 bp, Artificial Sequence
  Description of Artificial Sequence: Synthetic coding sequence
atgctgctgtgggtgatcctgctggtgctggcccctgtgtctggccagtttgcccggaccccccggcccatcatcttcctgcagcccccctggaccaccgtcttccagggcgagcgggtgaccctgacctgcaagggcttccgcttctacagcccccagaagaccaagtggtaccaccgctacctgggcaaggagatcctgcgggagaccccagacaacatcctggaggtgcaggagagcggggagtaccgctgccaggcccagggcagccccctgagcagccctgtgcacctggacttcagcagcgccagcctcatcctgcaggcccccctgtctgtgtttgaaggagacagcgtggtgctgcgctgccgggccaaggccgaggtgaccctgaacaacaccatctacaagaatgacaacgtgctggccttcctgaacaagaggacagacttccacatcccccacgcctgcctgaaggacaatggagcctaccgctgcaccggctacaaggagagctgctgccctgtgagcagcaacacagtgaagatccaggtgcaggagcccttcaccaggcctgtgctgcgggccagcagcttccagcccatcagcggcaaccctgtgaccctgacctgtgagacccagctgagcctggagaggagtgatgtgcccctgcgcttccgcttcttcagagatgaccagaccctgggcctgggctggagcctgagccccaacttccagatcacagccatgtggagcaaggacagcggcttctactggtgcaaggccgccaccatgccctacagcgtcatcagtgacagccccaggtcctggatccaggtgcagatcccagccagccaccctgtgctgaccctgagccctgagaaggccctgaactttgagggcaccaaggtgaccctgcactgtgagacccaggaggacagcctgcggaccctgtaccgcttctaccatgaaggagtgcccctgcggcacaagtctgtgcgctgtgagcggggggccagcatctccttcagcctgaccacagagaacagcggcaactactactgcacagctgacaatggcctgggcgccaagcccagcaaggctgtgtccctgtctgtgacagtgcctgtgagccaccctgtgctgaacctgagcagccctgaggacctgatctttgagggcgccaaggtgaccctgcactgtgaggcccagaggggcagcctgcccatcctgtaccagttccaccacgagggcgccgccctggagaggagaagtgccaacagcgctggaggagtggccatctccttcagcctgacagctgagcacagcggcaactactactgcacagctgacaatggcttcggcccccagaggagcaaggctgtgtccctgtctgtgacagtgcctgtgagccaccctgtgctgaccctgagcagcgctgaggccctgacctttgaaggagccaccgtgaccctgcactgtgaggtgcagaggggcagcccccagatcctgtaccagttctaccacgaggacatgcccctgtggagcagcagcaccccatctgtgggccgggtgtccttctccttcagcctgacagagggccacagcggcaactactactgcacagctgacaatggatttggcccccagaggtctgaggtggtgtccctgtttgtgacaggcaagtgctgggtgctggccagccacccccccctggccgagttcagcctgacccacagcttcaagaacctgtttgccctgagcagcttcctgccctag

SEQ ID NO: 34292 - DNA, 2280 bp, Artificial Sequence
  Description of Artificial Sequence: Synthetic coding sequence
atgctgctgtgggtgatcctgctggtgctggcccctgtgtctggccagtttgcccggaccccccggcccatcatcttcctgcagcccccctggaccaccgtcttccagggcgagcgggtgaccctgacctgcaagggcttccgcttctacagcccccagaagaccaagtggtaccaccgctacctgggcaaggagatcctgcgggagaccccagacaacatcctggaggtgcaggagagcggggagtaccgctgccaggcccagggcagccccctgagcagccctgtgcacctggacttcagcagcgccagcctcatcctgcaggcccccctgtctgtgtttgaaggagacagcgtggtgctgcgctgccgggccaaggccgaggtgaccctgaacaacaccatctacaagaatgacaacgtgctggccttcctgaacaagaggacagacttccacatcccccacgcctgcctgaaggacaatggagcctaccgctgcaccggctacaaggagagctgctgccctgtgagcagcaacacagtgaagatccaggtgcaggagcccttcaccaggcctgtgctgcgggccagcagcttccagcccatcagcggcaaccctgtgaccctgacctgtgagacccagctgagcctggagaggagtgatgtgcccctgcgcttccgcttcttcagagatgaccagaccctgggcctgggctggagcctgagccccaacttccagatcacagccatgtggagcaaggacagcggcttctactggtgcaaggccgccaccatgccctacagcgtcatcagtgacagccccaggtcctggatccaggtgcagatcccagccagccaccctgtgctgaccctgagccctgagaaggccctgaactttgagggcaccaaggtgaccctgcactgtgagacccaggaggacagcctgcggaccctgtaccgcttctaccatgaaggagtgcccctgcggcacaagtctgtgcgctgtgagcggggggccagcatctccttcagcctgaccacagagaacagcggcaactactactgcacagctgacaatggcctgggcgccaagcccagcaaggctgtgtccctgtctgtgacagtgcctgtgagccaccctgtgctgaacctgagcagccctgaggacctgatctttgagggcgccaaggtgaccctgcactgtgaggcccagaggggcagcctgcccatcctgtaccagttccaccacgagggcgccgccctggagaggagaagtgccaacagcgctggaggagtggccatctccttcagcctgacagctgagcacagcggcaactactactgcacagctgacaatggcttcggcccccagaggagcaaggctgtgtccctgtctgtgacagtgcctgtgagccaccctgtgctgaccctgagcagcgctgaggccctgacctttgaaggagccaccgtgaccctgcactgtgaggtgcagaggggcagcccccagatcctgtaccagttctaccacgaggacatgcccctgtggagcagcagcaccccatctgtgggccgggtgtccttctccttcagcctgacagagggccacagcggcaactactactgcacagctgacaatggatttggcccccagaggtctgaggtggtgtccctgtttgtgacagtgcctgtgtcccggcccatcctgaccctgcgggtgccccgggcccaggccgtggtgggggacctgctggagctgcactgtgaggccccccggggcagcccccccatcctgtactggttctaccatgaagatgtgaccctgggcagcagcagcgcccccagcggcggggaggccagcttcaacctgagcctgacagctgagcacagcggcaactacagctgtgaggccaacaacggcctggtggcccagcacagcgacaccatcagcctgtctgtgattgtgcctgtgtcccggcccatcctgaccttccgggccccccgggcccaggccgtggtgggggacctgctggagctgcactgtgaggccctgcggggcagcagccccatcctgtactggttctaccatgaagatgtgaccctgggcaagatcagcgcccccagcggcggcggggccagcttcaacctgagcctgaccacagagcacagcggcatctacagctgtgaggccgacaatggcctggaggcccagaggtctgagatggtgaccctgaaggtggccggggagtgggccctgcccaccagcagcaccagcgagaactag

SEQ ID NO: 34293 - DNA, 2025 bp, Artificial Sequence
  Description of Artificial Sequence: Synthetic coding sequence
atgctgctgtgggtgatcctgctggtgctggcccctgtgtctggccagtttgccagcctcatcctgcaggcccccctgtctgtgtttgaaggagacagcgtggtgctgcgctgccgggccaaggccgaggtgaccctgaacaacaccatctacaagaatgacaacgtgctggccttcctgaacaagaggacagacttccacatcccccacgcctgcctgaaggacaacggggcctaccgctgcaccggctacaaggagagctgctgccctgtgagcagcaacacagtgaagatccaggtgcaggagcccttcaccaggcctgtgctgcgggccagcagcttccagcccatcagcggcaaccctgtgaccctgacctgtgagacccagctgagcctggagaggagtgatgtgcccctgcgcttccgcttcttcagagatgaccagaccctgggcctgggctggagcctgagccccaacttccagatcacagccatgtggagcaaggacagcggcttctactggtgcaaggccgccaccatgccctacagcgtcatcagtgacagccccaggtcctggatccaggtgcagatcccagccagccaccctgtgctgaccctgagccctgagaaggccctgaactttgagggcaccaaggtgaccctgcactgtgagacccaggaggacagcctgcggaccctgtaccgcttctaccacgagggcgtgcccctgcggcacaagtctgtgcgctgtgagcggggggccagcatctccttcagcctgaccacagaaaattctggcaactactactgcacagctgacaatggcctgggcgccaagcccagcaaggctgtgtccctgtctgtgacagtgcctgtgagccaccctgtgctgaacctgagcagcccagaagatctcatctttgaaggagccaaggtgaccctgcactgtgaggcccagaggggcagcctgcccatcctgtaccagttccaccatgaaggagctgccctggagcggcgcagcgccaacagcgctgggggcgtggccatctccttcagcctgacagctgagcacagcggcaactactactgcacagctgacaatggatttggcccccagaggagcaaggctgtgtccctgtctgtgacagtgcctgtgagccaccctgtgctgaccctgagcagcgctgaggccctgacctttgagggcgccaccgtgaccctgcactgtgaggtgcagaggggcagcccccagatcctgtaccagttctaccacgaggacatgcccctgtggagcagcagcacccccagcgtgggccgggtgtccttctccttcagcctgacagagggccacagcggcaactactactgcacagctgacaatggcttcggcccccagaggtctgaggtggtgtccctgtttgtgacagtgcctgtgtcccggcccatcctgaccctgcgggtgccccgggcccaggccgtggtgggggacctgctggagctgcactgtgaggccccccggggcagcccccccatcctgtactggttctaccatgaagatgtgaccctgggcagcagcagcgcccccagcggcggggaggccagcttcaacctgagcctgacagctgagcacagcggcaactacagctgtgaggccaacaacggcctggtggcccagcacagcgacaccatcagcctgagcgtcatcgtgcctgtgtcccggcccatcctgaccttccgggccccccgggcccaggccgtggtgggggacctgctggagctgcactgtgaggccctgcggggcagcagccccatcctgtactggttctaccatgaagatgtgaccctgggcaagatcagcgcccccagcggcggcggggccagcttcaacctgagcctgaccacagagcacagcggcatctacagctgtgaggccgacaatggcctggaggcccagaggtctgagatggtgaccctgaaggtggccggggagtgggccctgcccaccagcagcaccagtgaaaattag

SEQ ID NO: 34294 - DNA, 1194 bp, Artificial Sequence
  Description of Artificial Sequence: Synthetic coding sequence
atgctgctgtggacagctgtgctgctgtttgtgccctgtgtgggcaagacagtgtggctgtacctgcaggcctggcccaaccctgtgtttgaaggagatgccctgaccctgcgctgccagggctggaagaacacccccctgagccaggtgaagttctacagagatggcaagttcctgcacttcagcaaggagaaccagaccctgtccatgggcgccgccaccgtgcagagccggggccagtacagctgcagcggccaggtgatgtacatcccccagaccttcacccagaccagcgagacagccatggtgcaggtgcaggagctgttccccccacctgtgctgagcgccatccccagccctgagccccgggagggcagcctggtgaccctgcgctgccagaccaagctgcaccccctgcggagcgccctgcggctgctcttctccttccacaaggatggccacaccctgcaggaccggggcccccaccctgagctgtgcatccctggggccaaggagggggacagcggcctgtactggtgtgaggtggcccctgagggcggccaggtgcagaagcagagcccccagctggaggtgcgggtgcaggcccctgtgtccaggcctgtgctgaccctgcaccacggccctgctgaccctgctgtgggggacatggtgcagctgctgtgtgaggcccagaggggcagcccccccatcctgtacagcttctacctggatgagaagatcgtgggcaaccacagcgccccctgtggcggcaccaccagcctgctcttccctgtgaagtctgagcaggatgctggcaactacagctgtgaggctgaaaattctgtgtcccgggagaggtctgagcccaagaagctgagcctgaagggcagccaggtgctcttcaccccagccagcaactggctggtgccctggctgcctgccagcctgctgggcctgatggtgattgctgctgccctgctggtgtatgtgcgctcctggaggaaggccggccccctgcccagccagatccccccaacagcccctggaggagagcagtgccccctgtatgccaacgtgcaccaccagaagggcaaggatgagggcgtggtgtacagcgtggtgcacaggaccagcaagaggtctgagggccagttctaccacctgtgtggcggggagatgcctgctgcccagtag

SEQ ID NO: 34295 - DNA, 1305 bp, Artificial Sequence
  Description of Artificial Sequence: Synthetic coding sequence
atgctgctgtggacagctgtgctgctgtttgtgccctgtgtgggcaagacagtgtggctgtacctgcaggcctggcccaaccctgtgtttgaaggagatgccctgaccctgcgctgccagggctggaagaacacccccctgagccaggtgaagttctacagagatggcaagttcctgcacttcagcaaggagaaccagaccctgtccatgggcgccgccaccgtgcagagccggggccagtacagctgcagcggccaggtgatgtacatcccccagaccttcacccagaccagcgagacagccatggtgcaggtgcaggagctgttccccccacctgtgctgagcgccatccccagccctgagccccgggagggcagcctggtgaccctgcgctgccagaccaagctgcaccccctgcggagcgccctgcggctgctcttctccttccacaaggatggccacaccctgcaggaccggggcccccaccctgagctgtgcatccctggggccaaggagggggacagcggcctgtactggtgtgaggtggcccctgagggcggccaggtgcagaagcagagcccccagctggaggtgcgggtgcaggcccctgtgtccaggcctgtgctgaccctgcaccacggccctgctgaccctgctgtgggggacatggtgcagctgctgtgtgaggcccagaggggcagcccccccatcctgtacagcttctacctggatgagaagatcgtgggcaaccacagcgccccctgtggcggcaccaccagcctgctcttccctgtgaagtctgagcaggatgctggcaactacagctgtgaggctgaaaattctgtgtcccgggagaggtctgagcccaagaagctgagcctgaagggcagccaggtgctcttcaccccagccagcaactggctggtgccctggctgcctgccagcctgctgggcctgatggtgattgctgctgccctgctggtgtatgtgcgctcctggaggaaggccggccccctgcccagccagatccccccaacagcccctggaggagagcagtgccccctgtatgccaacgtgcaccaccagaagggcaaggatgagggcgtggtgtacagcgtggtgcacaggaccagcaagaggtctgaggcccggtctgctgagttcaccgtgggcaggaaggacagcagcatcatctgtgccgaggtgcgctgcctgcagcccagcgaggtgagcagcacagaggtgaacatgaggagcaggaccctgcaggagcccctgagtgactgtgaggaggtgctgtgctag

SEQ ID NO: 34296 - DNA, 936 bp, Artificial Sequence
  Description of Artificial Sequence: Synthetic coding sequence
atgctgctgtggacagctgtgctgctgtttgtgccctgtgtgggcaagacagtgtggctgtacctgcaggcctggcccaaccctgtgtttgaaggagatgccctgaccctgcgctgccagggctggaagaacacccccctgagccaggtgaagttctacagagatggcaagttcctgcacttcagcaaggagaaccagaccctgtccatgggcgccgccaccgtgcagagccggggccagtacagctgcagcggccaggtgatgtacatcccccagaccttcacccagaccagcgagacagccatggtgcaggtgcaggcccctgtgtccaggcctgtgctgaccctgcaccacggccctgctgaccctgctgtgggggacatggtgcagctgctgtgtgaggcccagaggggcagcccccccatcctgtacagcttctacctggatgagaagatcgtgggcaaccacagcgccccctgtggcggcaccaccagcctgctcttccctgtgaagtctgagcaggatgctggcaactacagctgtgaggccgagaacagcgtgtcccgggagaggtctgagcccaagaagctgagcctgaagggcagccaggtgctcttcaccccagccagcaactggctggtgccctggctgcctgccagcctgctgggcctgatggtgattgctgctgccctgctggtgtatgtgcgctcctggaggaaggccggccccctgcccagccagatccccccaacagcccctggaggagagcagtgccccctgtatgccaacgtgcaccaccagaagggcaaggatgaaggagtggtgtacagcgtggtgcacaggaccagcaagaggtctgaggcccggtctgctgagttcaccgtgggcaggaagttctaccacctgtgtggcggggagatgcctgctgcccagtag

SEQ ID NO: 34297 - DNA, 1581 bp, Artificial Sequence
  Description of Artificial Sequence: Synthetic coding sequence
atggtgaatgaaggccccaaccaggaggagagtgatgacacccctgtgcctgagagcgccctgcaggccgaccccagcgtgtctgtgcaccccagcgtgtctgtgcaccccagcgtgtccatcaaccccagcgtgtctgtgcaccccagcagcagcgcccaccccagcgccctggcccagcccagcggcctggcccaccccagcagcagcggccctgaggacctgagcgtcatcaaggtgtccagaagacgctgggccgtggtgctggtgttcagctgctacagcatgtgcaacagcttccagtggatccagtatggcagcatcaacaacatcttcatgcacttctacggcgtgtctgcctttgccatcgactggctgtccatgtgctacatgctgacctacatccccctgctgctgcctgtggcctggctgctggagaagtttggcctgcggaccatcgccctgaccggcagcgccctgaactgcctgggcgcctgggtgaagctgggcagcctgaagccccacctgtttcctgtgacagtggtgggccagctgatctgcagcgtggcccaggtgttcatcctgggcatgcccagcagaattgcctctgtgtggtttggagccaatgaggtgtccacagcctgcagcgtggccgtgtttggaaaccagctgggcatcgccatcggcttcctggtgccccctgtgctggtgcccaacattgaagatagagatgagctggcctaccacatcagcatcatgttctacatcattggaggagtggccaccctgctgctgatcctggtgatcatcgtgttcaaggagaagcccaagtacccacccagccgggcccagagcctgtcctatgccctgaccagcccagatgccagctacctgggcagcatcgcccggctcttcaagaacctgaactttgtgctgctggtgatcacctacggcctgaatgctggggccttctacgccctgagcaccctgctgaacaggatggtgatctggcactacccaggagaggaggtgaatgccggcagaattggcctgaccatcgtgattgctggcatgctgggcgctgtgatcagcggcatctggctggacaggagcaagacctacaaggagaccaccctggtggtgtacatcatgaccctggtgggcatggtggtgtacaccttcaccctgaacctgggccacctgtgggtggtgttcatcacagctggcaccatgggcttcttcatgacaggctacctgcccctgggctttgaatttgctgtggagctgacctacccagagagcgagggcatcagcagcggcctgctgaacatcagcgcccaggtgtttggcatcatcttcaccatcagccagggccagatcatcgacaactacggcaccaagccaggcaacatcttcctgtgtgtgttcctgaccctgggcgccgccctgacagccttcatcaaggctgacctgcggcggcagaaggccaacaaggagaccctggagaacaagctgcaggaggaggaggaggagagcaacaccagcaaggtgcccacagctgtgtctgaggaccacctgtag

SEQ ID NO: 34298 - DNA, 966 bp, Artificial Sequence
  Description of Artificial Sequence: Synthetic coding sequence
atgtctgctgacaacagcagcaccatctgtgtgtgccgctctgtgcggcaggagctgggcatcgccatcggcttcctggtgccccctgtgctggtgcccaacatcgaggacagagatgagctggcctaccacatcagcatcatgttctacatcatcggcggcgtggccaccctgctgctgatcctggtgatcatcgtgttcaaggagaagcccaagtacccacccagccgggcccagagcctgtcctatgccctgaccagcccagatgccagctacctgggcagcatcgcccggctcttcaagaacctgaactttgtgctgctggtgatcacctacggcctgaatgctggggccttctacgccctgagcaccctgctgaacaggatggtgatctggcactacccaggagaggaggtgaatgccggccgcatcggcctgaccatcgtgattgctggcatgctgggcgccgtcatcagcggcatctggctggacaggagcaagacctacaaggagaccaccctggtggtgtacatcatgaccctggtgggcatggtggtgtacaccttcaccctgaacctgggccacctgtgggtggtgttcatcacagctggcaccatgggcttcttcatgacaggctacctgcccctgggctttgaatttgctgtggagctgacctacccagagagcgagggcatcagcagcggcctgctgaacatcagcgcccaggtgtttggcatcatcttcaccatcagccagggccagatcatcgacaactacggcaccaagccaggcaacatcttcctgtgtgtgttcctgaccctgggcgccgccctgacagccttcatcaaggctgacctgcggcggcagaaggccaacaaggagaccctggagaacaagctgcaggaggaggaggaggagagcaacaccagcaaggtgcccacagctgtgtctgaggaccacctgtag

SEQ ID NO: 34299 - DNA, 5574 bp, Artificial Sequence
  Description of Artificial Sequence: Synthetic coding sequence
atgtttggcctgaaggtgaagaagaagaggaacaaggccgagaagggcctcatcctggccaacaaggccgccaaggacagccagggcgacacagaggccctgcaggaggagcccagccaccaggagggccccaggggggacctggtgcatgatgatgccagcatcttccctgtgcccagcgccagccccaagagaagaagcaagctgctgaccaagatccatgatggagaggtgcgcagccagaactaccagatcgccatcaccatcacagaggcccggcagctggtgggggagaacatcgaccctgtggtgaccatcgagattggagatgagaagaagcagagcacagtgaaggagggcaccaacagccccttctacaatgagtactttgtgtttgacttcatcggcccccaggtgcacctgtttgacaagatcatcaagatctctgtgttccaccacaagctgattggctctgtgctgattggcagcttcaaggtggacctgggcaccgtgtacaaccagcccggccaccagttctgcaacaagtgggccctgctgacagatcctggggacatcagaacaggcaccaagggctacctgaagtgtgacatctctgtgatgggcaaaggagatgtgctgaagaccagccccaagaccagtgacacagaggagcccatcgagaagaacctgctgatccccaacggcttccccctggagcggccctgggcccgcttctacgtgcggctgtacaaggccgagggcctgcccaagatgaacagcagcatcatggccaacgtgaccaaggcctttgtgggggacagcaaggacctggtggacccctttgtggaggtgtcctttgctggccagatgggccgcaccaccgtgcagaagaactgtgccgaccctgtgtggcatgagcaggtgatcttcaaggagatgtttcctcccctgtgcagaagagtgaagatccaggtgtgggatgagggctccatgaatgatgtggccctggccacccacttcatcgacctgaagaagatcagcaatgagcaggatggagacaagggcttcctgcccaccttcggccctgcctggatcaacctgtatggcagccccaggaaccacagcctgatggatgactaccaggagatgaatgaaggatttggagagggcgtgtccttccggggccgcatcctggtggagattgctgtggagatcctgagcggccgggcccaggagagcaagttcagcaaggccctgaaggagctgaagctgcccagcaaggacaaggacagcaagagcagcaagggcaaggacaaggctgacaagacagaagatggcaagagccagcaggccagcaacaagaccaacagcacagaggtggaggtggagagctttgatgtgcccccagaaattgtgcctgagaagaatgaggagttcctgctgtttggagccttctttgaggccaccatgattgacaggaagattggagacaagcccatcagctttgaggtgtccatcggcaactttggaaacctgattgatggcggcagccaccacggcagcaagaagtctgctgagagcgctgaggaggacctgctgcccctgctgcacgagggccagggagatgtggcccatgatgtgcccatccccatggccagcaccacccaccctgagaagcccctggtgacagagggcaacagaaactacaactacctgccctttgaggccaagaagccctgtgtgtacttcatcagctcctggggagaccagaccttccggctgcactggagcaacatgctggagaagatggctgacttcctggaggagagcattgaggaggtgcgggagctgatcaagatcagccaggaggcccctgaggagaagatgaagacagtgctgagtgacttcatcagccgcagcagcgccttcatcagcgaggccgagaagaagcccaagatgctgaaccagaccaccctggacaagaagaggctgaccctgtgctggcaggagctggaggccatgtgcaaggaggccaagggcatcatccagcagcagaagaagaagctgtctgtggatgagatgatccacgaggcccagaactttgtggagaagatccgcttcctggtggatgagccccagcacaccatcccagatgtgttcatctggatgctgagcaacaacagaagagtggcctatgccagaattgccagcaaggacctgctgtacagccctgtggccggccagatgggcaagcactgcggcaagatcaagacccacttcctgaagcccccaggcaagaggcctgctggctggagcgtgcaggccaaggtggatgtgtacctgtggctgggcagcatcaagcacgccagcgccatcctggacaacctgcctgtgggctatgaggccgagatgagcagcaaaggagctggcaccaaccacccccccagcaacctgctgtaccaggagcagcacgtgttccagctgcgggcccacatgtaccaggcccggggcctgattgctgctgacagcaatggcctgagtgacccctttgccaaggtgaccttcctgagccactgccagaccaccaagatcatcagccagaccctgagccccacctggaaccagatgctgctcttcaatgacctggtgctgcatggagatgtgaaggagctggccgagagcccccccctggtggtggtggagctgtatgacagtgatgctgtgggcaagccagagtacctgggcgccaccgtggccgcccctgtggtgaagctggccgaccaggactatgagcccccccggctgtgctaccaccccatcttctgtggcaacctgagcggcggggacctgctggccgtgtttgagctgctgcaggtgccccccagcggcctgcagggcctgccccctgtggagcccccagacatcacccagatctaccctgtgcctgccaacatccggcctgtgctgagcaagtacagagtggaggtgctcttctggggcgtgcgggagatgaagaaggtgcagctgctgtctgtggaccggccccaggccctgattgaatgtggcggccagggcgtgaagagctgtgtgatccagagctacaagaacaaccccaacttcagcatccaggctgatgcctttgaggtggagctgcctgaaaatgagctgctgcacccccccctgagcatctgtgtggtggactggagggccttcggccgcagcaccctggtgggcacctacaccatcaactacctgaagcagttcctgtgcaagctgcgggagcccctggcccccatcacccaggtggatggcacccagcccggccatgacatcagtgacagcctgacagccacagagagcagcggggcccacagcagcagccaggaccccccagctgaccacatctacgtggatgtggagcccccacccaccgtggtgcctgattctgcccaggcccagcctgccatcctggtggatgtgcctgacagcagccccatgctggagcctgagcacacccctgtggcccaggagccccccaaggatggcaagcccaaggaccccaggaagcccagccgccgcagcaccaagaggaggaagaggaccatcgcagatgagagcgcagaaaatgtgattgactggtggagcaagtactatgccagcctgaagaaggcccagaaggccaaggagaggaaccccaagggcaagaagggcaacacagaggccaagccagatgaggtggtggtggacattgaagatggccccaagaagaagaaggacaagatgctgaagaagaagcccaaggatgatggcatccccaacctggccatcctgcagatctatgatggagacctggagagcgagttcaacaactttgaggactgggtgaagacctttgagctgttccggggcaagagcacagaagatgaccacggcctggatggagacagagtcatcggcaagttcaagggcagcttctgcatctacaagagcccccaggacagcagcagtgaagattctggccagctgcgcatccagcagggcatcccccccaaccaccctgtgacagtgctgatccgggtgtacatcgtggccgccttcaacctgagccctgctgaccctgatggcaagagtgacccctacatcgtcatcaagctgggcaagacagagatcaaggaccgggacaagtacatccccaagcagctgaaccctgtgtttggccgcagctttgagatccaggccaccttccccaaggagagcctgctgagcatcctgatctatgaccatgacatgattggaacagatgacctgattggagagaccaagattgacctggagaaccgcttctacagcaagcaccgggccatctgtggcctgcagagccagtatgaaattgagggctacaatgcctggagggacaccagcaagcccacagagatcctgaccaagctgtgcaaggacaacaagctggatggcccctacttccaccctgggaagatccagatcggcaaccaggtgttttctgggaagaccatcttcacagaggaggacacagatgagaccgtggagagctatgagcacctggccctgaaggtgctgcacagctgggaggacatccctgaggtgggctgccgcctggtgcctgagcacatcgagacccggcccctgtaccacaaggacaagccaggcatggagcagggccgcctgcagatgtgggtggacatgttccccaaggacatgccccagcccggcccccctgtggacatcagcccccggcggcccaagggctatgagctgcgggtgaccatctggaacacagaagatgtgatcctggaggatgagaacatcttcaccggccagaagagcagtgacatctacgtgaagggctggctgaagggcctggaggatgacaagcaggagacagatgtgcactacaacagcctgaccggggagggcaacttcaactggaggttcctgttccccttccagtacctgcctgctgagaagcagatggtgatcaccaagcgggagaacatcttcagcctggagaagatggagtgcaagaccccagctgtgctggtgctgcaggtgtgggactttgagcggctgagcagtgatgacttcctgggcaccctggagatgaacctgaacagcttccccagggctgccaagagcgccaaggcctgtgacctggccaagtttgaaaatgccagcgaggagaccaagatcagcatcttccagcagaagagggtgcggggctggtggcccttcagcaagagcaaggagctgaccgggaaggtggaggccgagttccacctggtgacagctgaggaggccgagaagaaccctgtgggcaaggccaggaaggagcctgagcccctggccaagcccaacagaccagacaccagcttctcctggttcatgagccccttcaagtgcctgtactacctgatctggaagaactacaagaagtacatcatcatcgccttcatcctgatcatcctgatcatcttcctggtgctcttcatctacaccctgcccggggccatcagcagaagaattgtggtgggcagctag

SEQ ID NO: 34300 - DNA, 5574 bp, Artificial Sequence; identical to SEQ ID NO: 34299
  Description of Artificial Sequence: Synthetic coding sequence

SEQ ID NO: 34301 - DNA, 189 bp, Artificial Sequence
  Description of Artificial Sequence: Synthetic coding sequence
atggaggagctggagaccagcctcttccagaccaggaaggcccacagaattgagcagatggtggcccgctggctgcggcgcagccgggacagcagcgcccgggccaaggtggccgctgctgatggccctgccaggaaccccacccagaccctcatccctgtgcgccacacagtgaagattgacaagtag

SEQ ID NO: 34302 - DNA, 4737 bp, Artificial Sequence
  Description of Artificial Sequence: Synthetic coding sequence
atggaggagctggagaccagcctcttccagaccaggaaggcccacagaattgagcagatggtggcccgctggctgcggcgcagccgggacagcagcgcccgggccaaggtggccgctgctgatggccctgccaggaaccccacccagaccctcatccctgtgcgccacacagtgaagattgacaaggacaccctgctgcaggactatggcttccacatcagcgagagcctgcccctgactgtggtggccgtgacagctgggggcagcgcccacggcaagctgtttcctggggaccagatcctgcagatgaacaatgaacctgctgaggacctgtcctgggagagagctgtggacatcctgcgggaggccgaggacagcctgagcatcaccgtggtgcgctgcaccagcggcgtgcccaagagcagcttcctgacagaggagaagagggcccggctgaagaccaaccctgtgaaggtgcactttgctgaggaggtgctgatcagcggccacagccagggcaacagcctgctgtgcatgcccaacgtgctgaagctgtacctggagaatggccagaccaaggccttcaagtttgaggccaacaccaccgtgaaggacatcatcctgactgtgaaggagaagctgagcatccgcagcattgagtactttgccctggccctggaggagcagtacagcatcagccggctgcacctgctgcacgaggaggagctgatccagcaggtggtggagcgggaggagagccatgactaccgctgcctcttccgggtgtgctttgtgcccaaggaccccctggacctgctgaaggaggaccctgtggcctttgagtacctgtacctgcagagctgcagtgatgtgctgcaggagagatttgctgtggagatgaagtgcagcagcgccctgcggctggccgccctgcacatccaggagcgcatctatgcctgtgcccagccccagaagatcagcctgaagtacatcgagaaggactggggcatcgagaacttcatcagccccaccctgctgaggaacatgaagggcaaggacatcaagaaggccatctccttccacatgaagaggaaccagaacctgctggagccccggcagaagcagctgatctctgctgcccagctgcggctgaactacctgcagatcctgggggagctgaagacctacggcggccgcatcttcaatgccaccctgatgctgcaggaccgggagagctacatcgccctgctggtgggcgccaagtatggcatcagccaggtgatcaacagcaagctgaacatcatgagcaccctggccgagtttgccaacatcagccgggtggagctgacagaggagagcgagaaggtgtctgtggtgaaggtgtacctgcaggatgtgaaggtgctgaccctgctgctggagagcaacagcgccaaggacctggcctgcctgattgctggctactaccgcctgctggtggaccctgtgaccagcatcttcctgtggccaggcaacaagcagcaggcccaccgggtgtctgctgaggagggctatgagagccgggcctgcagcgacagcgaggagagcagcgaggtggactgtgtgctggagcccctgagtgaccggcggctggtgaagctggccccctgccgcagcctcatcaaggaggagcagcccccaggcaacagccccaccccagaggtggcccggcggggccccagcacctgtggggccagcagcaccacagacagcgctgagagcgaggccagtgacagcgccaacacagagagccggggctaccgcaccagcggcagcagcgagagcatggatgccctggaggaggatgacctggacacctgcagcagcagccgcagcaccttcttccacttcggcagccctggcctggccgagagcattgacagcgacagccaggaggagaggagcggcatcgagaccagcggcttcctgtgcctgctggacctggcccagagggccaacccccagtgccagaagacagagttcagcgagagcgctgccctggagaccttcggctgggcccctgagctgagcacagtgcggctggacccccggctgtatgagggcagccacgccgactactacagcctgtgcagctctgtgtccccagccagctacctgagtgacagcagcgagagcacagccagccggcagggcggggcccccccagcctggggccagcagggctggacagaggcccagcccagctccatgctggagcccctggccctgcacccccccctggcctttgaagatggcagcagtgatgaggagtactatgatgctgctgacaagctgaccccacctggccccccatctggccccagagatgtgtccacagctgagcccagcgccaccagcctgcagaacaaggccagcaccagcagccctgagaacagcctgccctgtggcccagatggccggcagcccagccggcggggcggcgtgaagaagtatgccaagaccctgaggaagaggaggagcttcctgcagacagactacaccagccaggtgtccttccccctggtgcccagcgccagcctggagagcgtggatgatgtgtgctactatgaccgggagccctacctggccctgggcgcccccagccccaccgtgagcagcctgcaggacatgcagggcgagcccggcctgctggagaccaaggccctgggcctgctggcccccctgcgggagaccaagagcaccaacccagccagccgggtgatggagatggagcctgagaccatggagaccaagagcgtcatcgacagccgggtgagcagcatcagcgccatccgcttcagaattgaccccaacaacaaggagaacagcggcgtggtgcctgctgccagcagcagcgccagcaccccccactgcagcaaccctggcagcagcggccctgacacagcccaggcccggcccagccagatcctgcccctgagccaggacctggatggcatcgcccccaaggagcccaccatcgagcacggggacagcagcttcagcctgagcagcggggaccccaacccagaccgggcctgcctggccagcaaccctggcctgaacaacgtgtcccagggcgacaccctggagctgcagctggagccccacgtgcagctggagatgggcctggagagcttctgcaccaaccacatccaggagacagcccccaagtacacagagcccctgctgagccccagagatgagcccaggagtgatgaatgtggcatcaaccctggagagaagatcgccagcatccccaccaaggaggagccccagggccagctgagcctggagcgggaccgggaggtgaccaacaagaatggcaccaacgtgttccaggaggagagcaggaaggacagcggggacagccctggagatgtgagcaacaacgtgtcccagaccctggacatcagcagccctgctgggaagatcgtgaccagcctgagcctggatgcccctgtgactggaacagagcagatccccccccaccccccccgggacccccagggccagagccgggagcccccaggccagggctgccaggcccaggagcagaagctgtttgtggagctggacctggaccctgacttcttcctgggcaagcagacagtgtccccagctgtgcccccagagggcatcaaggccgaggcccccaaccacgtgacaggccaggacatcgccccccgggacagccctgagtgggtgtgcttcaaccctgagcccagcctgcctgagcccctgccctgcccccaggaggacccccacctggagaccagcaaccactgcctgctgtctgagggcaagagtgacagcagcagcatctgcctgtctgctgagaagagcttcctgtgctttgcccctgagagccaccctgaggtgtctgccagcctgcgggtggccaccagcctgggctttgctggcatgaatgagatggtggcccccagaattggcatggaccagtgcagctgccagttctcctatgccacctgcttccggggcccccagcctgagacagaggaggaggaccgggacctggaggcccaccccatggcccccctgaccagccccccatctgctggcagccctgtggtgctgccctggaggcctgcccgggcccacagctgcaccacagcccccctgagcaggaagagccacatctggccagagtactgcagccgggccctgcggcagctgaaggccaccccagccagcaccccagagggcttcatccagctgatggagagcctgctggagctgcaggacatcctggagacctcctggggcgtgggcaacaagcaccccccagagaagtgcacctggcacttcacagagagccgcagccggctgtgcatgggcagccagaagctgctgagcagctgcagacatgtgatccgcatggaccagagccctgaggagatgcagggcgctgtgcgggacaccttccagcacctggtgcagctggccggcctgtgcttccagttcacagactgcagccgctgcagcgcccggcaccgggaggccgccggcaacctgagagatgtggtgtacacctaccaccagttcattgaagctgccaagagcacctgtgagcggggctaccatgacctgtctgtgaagctgctggcccggcagtgcacagccctgacagctgctgtgttctgcctgacccagaagttccgggccagcacagccctgtag

SEQ ID NO: 34303 - DNA, 1905 bp, Artificial Sequence
  Description of Artificial Sequence: Synthetic coding sequence
atgcccaacgtgctgaagctgtacctggagaatggccagaccaaggccttcaagtttgaggccaacaccaccgtgaaggacatcatcctgactgtgaaggagaagctgagcatccgcagcattgagtactttgccctggccctggaggagcagtacagcatcagccggctgcacctgctgcacgaggaggagctgatccagcaggtggtggagcgggaggagagccatgactaccgctgcctcttccgggtgtgctttgtgcccaaggaccccctggacctgctgaaggaggaccctgtggcctttgagtacctgtacctgcagagctgcagtgatgtgctgcaggagagatttgctgtggagatgaagtgcagcagcgccctgcggctggccgccctgcacatccaggagcgcatctatgcctgtgcccagccccagaagatcagcctgaagtacatcgagaaggactggggcatcgagaacttcatcagccccaccctgctgaggaacatgaagggcaaggacatcaagaaggccatctccttccacatgaagaggaaccagaacctgctggagccccggcagaagcagctgatctctgctgcccagctgcggctgaactacctgcagatcctgggggagctgaagacctacggcggccgcatcttcaatgccaccctgatgctgcaggaccgggagagctacatcgccctgctggtgggcgccaagtatggcatcagccaggtgatcaacagcaagctgaacatcatgagcaccctggccgagtttgccaacatcagccgggtggagctgacagaggagagcgagaaggtgtctgtggtgaaggtgtacctgcaggatgtgaaggtgctgaccctgctgctggagagcaacagcgccaaggacctggcctgcctgattgctggctactaccgcctgctggtggaccctgtgaccagcatcttcctgtggccaggcaacaagcagcaggcccaccgggtgtctgctgaggagggctatgagagccgggcctgcagcgacagcgaggagagcagcgaggtggactgtgtgctggagcccctgagtgaccggcggctggtgaagctggccccctgccgcagcctcatcaaggaggagcagcccccaggcaacagccccaccccagaggtggcccggcggggccccagcacctgtggggccagcagcaccacagacagcgctgagagcgaggccagtgacagcgccaacacagagagccggggctaccgcaccagcggcagcagcgagagcatggatgccctggaggaggatgacctggacacctgcagcagcagccgcagcaccttcttccacttcggcagccctggcctggccgagagcattgacagcgacagccaggaggagaggagcggcatcgagaccagcggcttcctgtgcctgctggacctggcccagagggccaacccccagtgccagaagacagagttcagcgagagcgctgccctggagaccttcggctgggcccctgagctgagcacagtgcggctggacccccggctgtatgagggcagccacgccgactactacagcctgtgcagctctgtgtccccagccagctacctgagtgacagcagcgagagcacagccagccggcagggcggggcccccccagcctggggccagcagggctggacagaggcccagcccagctccatgctggagcccctggccctgcacccccccctggcctttgaagatggcagcagtgatgaggagtactatgatgctgctgacaagctgaccccacctggccccccatctggagagcccagcctggccggcctgcagacccggcaggccgccccagaatgtctgcccggcatcaaggcctggggccaggcctag

SEQ ID NO: 34304 - DNA, 4737 bp, Artificial Sequence; identical to SEQ ID NO: 34302
  Description of Artificial Sequence: Synthetic coding sequence

SEQ ID NO: 34305 - DNA, 2046 bp, Artificial Sequence
  Description of Artificial Sequence: Synthetic coding sequence
atggccgaggtgggcggcgtgcccaagagcagcttcctgacagaggagaagagggcccggctgaagaccaaccctgtgaaggtgcactttgctgaggaggtgctgatcagcggccacagccagggcaacagcctgctgtgcatgcccaacgtgctgaagctgtacctggagaatggccagaccaaggccttcaagtttgaggccaacaccaccgtgaaggacatcatcctgactgtgaaggagaagctgagcatccgcagcattgagtactttgccctggccctggaggagcagtacagcatcagccggctgcacctgctgcacgaggaggagctgatccagcaggtggtggagcgggaggagagccatgactaccgctgcctcttccgggtgtgctttgtgcccaaggaccccctggacctgctgaaggaggaccctgtggcctttgagtacctgtacctgcagagctgcagtgatgtgctgcaggagagatttgctgtggagatgaagtgcagcagcgccctgcggctggccgccctgcacatccaggagcgcatctatgcctgtgcccagccccagaagatcagcctgaagtacatcgagaaggactggggcatcgagaacttcatcagccccaccctgctgaggaacatgaagggcaaggacatcaagaaggccatctccttccacatgaagaggaaccagaacctgctggagccccggcagaagcagctgatctctgctgcccagctgcggctgaactacctgcagatcctgggggagctgaagacctatggaggccgcatcttcaatgccaccctgatgctgcaggaccgggagagctacatcgccctgctggtgggcgccaagtatggcatcagccaggtgatcaacagcaagctgaacatcatgagcaccctggccgagtttgccaacatcagccgggtggagctgacagaggagagcgagaaggtgtctgtggtgaaggtgtacctgcaggatgtgaaggtgctgaccctgctgctggagagcaacagcgccaaggacctggcctgcctgattgctggctactaccgcctgctggtggaccctgtgaccagcatcttcctgtggccaggcaacaagcagcaggcccaccgggtgtctgctgaggagggctatgagagccgggcctgcagcgacagcgaggagagcagcgaggtggactgtgtgctggagcccctgagtgaccggcggctggtgaagctggccccctgccgcagcctcatcaaggaggagcagcccccaggcaacagccccaccccagaggtggcccggcggggccccagcacctgtggggccagcagcaccacagattctgctgagagcgaggccagtgacagcgccaacacagagagccggggctaccgcaccagcggcagcagcgagagcatggatgccctggaggaggatgacctggacacctgcagcagcagccgcagcaccttcttccacttcggcagccctggcctggccgagagcattgacagcgacagccaggaggagaggtctggaattgagaccagcggcttcctgtgcctgctggacctggcccagagggccaacccccagtgccagaagacagagttcagcgagagcgctgccctggagaccttcggctgggcccctgagctgagcacagtgcggctggacccccggctgtatgagggcagccatgctgactactacagcctgtgcagctctgtgtccccagccagctacctgagtgacagcagcgagagcacagccagccggcagggcggggcccccccagcctggggccagcagggctggacagaggcccagcccagctccatgctggagcccctggccctgcacccccccctggcctttgaagatggcagcagtgatgaggagtactatgatgctgctgacaagctgaccccacctggcccccccagcggggagcccagcctggccggcctgcagacccggcaggccgcccctgagtgcctgcccggcatcaaggcctggggccaggcctag

SEQ ID NO: 34306 - DNA, 1713 bp, Artificial Sequence
  Description of Artificial Sequence: Synthetic coding sequence
atgctgagccggctgatgagcggcagcagccgcagcctggagcgggagtacagctgcaccgtgcggctgctggatgattctgagtacacctgcaccatccagagagatgccaagggccagtacctgtttgacctgctgtgccaccacctgaacctgctggagaaggactacttcggcatccgctttgtggaccctgacaagcagaggcactggctggagttcaccaagtctgtggtgaagcagctgcggagccagccccccttcaccatgtgcttccgggtgaagttctacccagctgaccctgctgccctgaaggaggagatcacccgctacctggtgttcctgcagatcaagagggacctgtaccacggccgcctgctgtgcaagaccagtgatgctgccctgctggccgcctacatcctgcaggccgagattggagactatgacagcggcaagcaccctgagggctacagcagcaagttccagttcttccccaagcacagcgagaagctggagaggaagattgctgagatccacaagacagagctgagcggccagaccccagccaccagcgagctgaacttcctgaggaaggcccagaccctggagacctatggagtggacccccacccctgcaaggatgtgtctggaaatgctgccttcctggccttcaccccatttggatttgtggtgctgcagggcaacaagagggtgcacttcatcaagtggaatgaggtgaccaagctgaagtttgagggcaagaccttctacctgtatgtgtcccagaaggaggagaagaagatcatcctgacctactttgcccccaccccagaggcctgcaagcacctgtggaagtgtggcatcgagaaccaggccttctacaagctggagaagagcagccaggtgaggacagtgagcagcagcaacctcttcttcaagggcagccgcttccgctacagcggccgggtggccaaggaggtgatggagagcagcgccaagatcaagcgggagcccccagagatccaccgggccggcatggtgcccagccgcagctgccccagcatcacccacggcccccggctgagctctgtgcccaggaccaggagaagagctgtgcacatcagcatcatggagggcctggagagcctgcgggacagcgcccacagcacccctgtgcgcagcaccagccatggagacaccttcctgccccacgtgcgcagcagcaggacagacagcaatgaaagagtggccgtgattgctgatgaggcctacagccctgctgacagcgtgctgcccacccctgtggccgagcacagcctggagctgatgctgctgagccggcagatcaacggggccacctgcagcattgaggaggagaaggagagcgaggccagcacccccacagccacagaggtggaggccctgggcggggagctgcgggccctgtgccagggccacagcggccctgaggaggagcaggtgaacaagtttgtgctgtctgtgctgcggctgctgctggtgaccatgggcctgctgtttgtgctgctgctgctgctgatcatcctgacagaaagtgacctggacatcgccttcttccgggacatccggcagaccccagagtttgagcagttccactaccagtacttctgccccctgcggcgctggtttgcctgcaagatccgctctgtggtgtccctgctgattgacacctag

SEQ ID NO: 34307 - DNA, 1245 bp, Artificial Sequence
  Description of Artificial Sequence: Synthetic coding sequence
atgtgcttccgggtgaagttctacccagctgaccctgctgccctgaaggaggagatcacccgctacctggtgttcctgcagatcaagagggacctgtaccacggccgcctgctgtgcaagaccagtgatgctgccctgctggccgcctacatcctgcaggccgagatcggggactatgattctgggaagcaccctgagggctacagcagcaagttccagttcttccccaagcacagcgagaagctggagaggaagattgctgagatccacaagacagagctgagcggccagaccccagccaccagcgagctgaacttcctgaggaaggcccagaccctggagacctacggcgtggacccccacccctgcaaggatgtgtctggaaatgctgccttcctggccttcacccccttcggctttgtggtgctgcagggcaacaagagggtgcacttcatcaagtggaatgaggtgaccaagctgaagtttgagggcaagaccttctacctgtatgagaagaagatcatcctgacctactttgcccccaccccagaggcctgcaagcacctgtggaagtgtggcatcgagaaccaggccttctacaagctggagaagagcagccaggtgaggacagtgagcagcagcaacctcttcttcaagggcagccgcttccgctacagcggccgggtggccaaggaggtgatggagagcagcgccaagatcaagcgggagcccccagagatccaccgggccggcatggtgcccagccgcagctgccccagcatcacccacggcccccggctgagctctgtgcccaggaccaggagaagagctgtgcacatcagcatcatggagggcctggagagcctgcgggacagcgcccacagcacccctgtgcgcagcaccagccatggagacaccttcctgccccacgtgcgcagcagcaggacagacagcaatgaaagagtggccgtgattgctgatgaggcctacagccctgctgacagcgtgctgcccacccctgtggccgagcacagcctggagctgatgctgctgagccggcagatcaacggggccacctgcagcattgaggaggagaaggagagcgaggccagcacccccacagccacagaggtggaggccctgggcggggagctgcgggccctgtgccagggccacagcggccctgaggaggagcaggccatggtgtgcctgcagaaccccctgtctggagagcccgcccactag

SEQ ID NO: 34308 - DNA, 1869 bp, Artificial Sequence
  Description of Artificial Sequence: Synthetic coding sequence
atgaacaagctgaacttccacaacaacagagtgatgcaggacagaagatctgtgtgcatcttcctgcccaatgatgagagcctgaacatcatcatcaacgtgaagatcctgtgccaccagctgctggtgcaggtgtgtgacctgctgcggctgaaggactgccacctgtttggcctgagcgtcatccagaacaatgaacatgtgtacatggagctgagccagaagctgtacaagtactgccccaaggagtggaagaaggaggccagcaaggtgcggcagtatgaggtgacctggggcatcgaccagtttggaccacccatgatcatccacttccgggtgcagtactacgtggagaatggccgcctcatcagtgacagagctgcccgctactactactactggcacctgaggaagcaggtgctgcacagccagtgtgtgctgcgggaggaggcctacttcctgctggccgcctttgccctgcaggccgacctgggcaacttcaagaggaacaagcactacggcaagtactttgagcctgaggcctacttccccagctgggtggtgtccaagaggggcaaggactacatcctgaagcacatccccaacatgcacaaggaccagtttgccctgacagccagcgaggcccacctgaagtacatcaaggaggccgtgcggctggatgatgtggccgtgcactactaccgcctgtacaaggacaagcgggagattgaggccagcctgaccctgggcctgaccatgaggggcatccagatcttccagaacctggatgaggagaagcagctgctgtatgacttcccctggaccaacgtgggcaagctggtgtttgtgggcaagaagtttgagatcctgcctgatggcctgcccagcgccaggaagctgatctactacacaggctgccccatgaggagccgccacctgctgcagctgctgagcaacagccaccggctgtacatgaacctgcagcctgtgctgcggcacatcaggaagctggaggagaatgaggagaagaagcagtaccgggagagctacatcagtgacaacctggacctggacatggaccagctggagaagaggagccgggccagcggcagcagcgctggctccatgaagcacaagaggctgagccgccacagcacagccagccacagcagcagccacaccagcggcattgaagctgacaccaagccccgggacaccggcccagaagattcctacagcagcagcgccatccacaggaagctgaagacctgcagctccatgaccagccacggcagcagccacaccagcggcgtggagagcggcggcaaggaccggctggaggaggacctgcaggatgatgaaattgagatgctggtggatgacccccgggacctggagcagatgaatgaggagagcctggaggtgtccccagacatgtgcatctacatcacagaggacatgctgatgagcaggaagctgaatggccacagcggcctcatcgtgaaggagatcggcagcagcaccagcagcagcagcgagaccgtggtgaagctgcggggccagagcacagacagcctgccccagaccatctgcaggaagcccaagaccagcacagacagacacagcctgagcctggatgacatccggctgtaccagaaggacttcctgagaattgctggcctgtgccaggacacagcccagagctacaccttcggctgcggccacgagctggatgaggagggcctgtactgcaacagctgcctggcccagcagtgcatcaacatccaggatgccttccctgtgaagaggaccagcaagtacttcagcctggacctgacccatgatgaggtgcctgagtttgtggtgtag

SEQ ID NO: 34309 - DNA, 1845 bp, Artificial Sequence
  Description of Artificial Sequence: Synthetic coding sequence
atgaacaagctgaacttccacaacaacagagtgatgcaggacagaagatctgtgtgcatcttcctgcccaatgatgagagcctgaacatcatcatcaacgtgaagatcctgtgccaccagctgctggtgcaggtgtgtgacctgctgcggctgaaggactgccacctgtttggcctgagcgtcatccagaacaatgaacatgtgtacatggagctgagccagaagctgtacaagtactgccccaaggagtggaagaaggaggccagcaagggcatcgaccagtttggaccacccatgatcatccacttccgggtgcagtactacgtggagaatggccgcctcatcagtgacagagctgcccgctactactactactggcacctgaggaagcaggtgctgcacagccagtgtgtgctgcgggaggaggcctacttcctgctggccgcctttgccctgcaggccgacctgggcaacttcaagaggaacaagcactacggcaagtactttgagcctgaggcctacttccccagctgggtggtgtccaagaggggcaaggactacatcctgaagcacatccccaacatgcacaaggaccagtttgccctgacagccagcgaggcccacctgaagtacatcaaggaggccgtgcggctggatgatgtggccgtgcactactaccgcctgtacaaggacaagcgggagattgaggccagcctgaccctgggcctgaccatgaggggcatccagatcttccagaacctggatgaggagaagcagctgctgtatgacttcccctggaccaacgtgggcaagctggtgtttgtgggcaagaagtttgagatcctgcctgatggcctgcccagcgccaggaagctgatctactacacaggctgccccatgaggagccgccacctgctgcagctgctgagcaacagccaccggctgtacatgaacctgcagcctgtgctgcggcacatcaggaagctggaggagaatgaggagaagaagcagtaccgggagagctacatcagtgacaacctggacctggacatggaccagctggagaagaggagccgggccagcggcagcagcgctggctccatgaagcacaagaggctgagccgccacagcacagccagccacagcagcagccacaccagcggcattgaagctgacaccaagccccgggacaccggcccagaagattcctacagcagcagcgccatccacaggaagctgaagacctgcagctccatgaccagccacggcagcagccacaccagcggcgtggagagcggcggcaaggaccggctggaggaggacctgcaggatgatgaaattgagatgctggtggatgacccccgggacctggagcagatgaatgaggagagcctggaggtgtccccagacatgtgcatctacatcacagaggacatgctgatgagcaggaagctgaatggccacagcggcctcatcgtgaaggagatcggcagcagcaccagcagcagcagcgagaccgtggtgaagctgcggggccagagcacagacagcctgccccagaccatctgcaggaagcccaagaccagcacagacagacacagcctgagcctggatgacatccggctgtaccagaaggacttcctgagaattgctggcctgtgccaggacacagcccagagctacaccttcggctgcggccacgagctggatgaggagggcctgtactgcaacagctgcctggcccagcagtgcatcaacatccaggatgccttccctgtgaagaggaccagcaagtacttcagcctggacctgacccatgatgaggtgcctgagtttgtggtgtag

SEQ ID NO: 34310 - DNA, 1845 bp, Artificial Sequence; identical to SEQ ID NO: 34309
  Description of Artificial Sequence: Synthetic coding sequence

SEQ ID NO: 34311 - DNA, 795 bp, Artificial Sequence
  Description of Artificial Sequence: Synthetic coding sequence
atggaccagctggagaagaggagccgggccagcggcagcagcgctggctccatgaagcacaagaggctgagccgccacagcacagccagccacagcagcagccacaccagcggcattgaagctgacaccaagccccgggacaccggcccagaagattcctacagcagcagcgccatccacaggaagctgaagacctgcagctccatgaccagccacggcagcagccacaccagcggcgtggagagcggcggcaaggaccggctggaggaggacctgcaggatgatgaaattgagatgctggtggatgacccccgggacctggagcagatgaatgaggagagcctggaggtgtccccagacatgtgcatctacatcacagaggacatgctgatgagcaggaagctgaatggccacagcggcctcatcgtgaaggagatcggcagcagcaccagcagcagcagcgagaccgtggtgaagctgcggggccagagcacagacagcctgccccagaccatctgcaggaagcccaagaccagcacagacagacacagcctgagcctggatgacatccggctgtaccagaaggacttcctgagaattgctggcctgtgccaggacacagcccagagctacaccttcggctgcggccacgagctggatgaggagggcctgtactgcaacagctgcctggcccagcagtgcatcaacatccaggatgccttccctgtgaagaggaccagcaagtacttcagcctggacctgacccatgatgaggtgcctgagtttgtggtgtag

SEQ ID NO: 34312 - DNA, 186 bp, Artificial Sequence
  Description of Artificial Sequence: Synthetic coding sequence
atgaacaagctgaacttccacaacaacagagtgatgcaggacagaagatctgtgtgcatcttcctgcccaatgatgagagcctgaacatcatcatcaacgtgaagatcctgtgccaccagctgctggtgcaggtgtgtgacctgctgcggctgaaggactgccacctgtttggcctgtctgtgtag

SEQ ID NO: 34313 - DNA, 3138 bp, Artificial Sequence
  Description of Artificial Sequence: Synthetic coding sequence
atgggagaaattgagcagaggcccaccccaggcagccggctgggcgcccctgagaacagcggcatcagcaccctggagcggggccagaagcccccacccacccccagcggcaagctggtgtccatcaagatccagatgctggatgacacccaggaggcctttgaggtgccccagagggcccctgggaaggtgctgctggatgctgtgtgcaaccacctgaacctggtggagggggactacttcggcctggagttcccagaccacaagaagatcaccgtgtggctggacctgctgaagcccatcgtgaagcagatccggcggcccaagcacgtggtggtgaagtttgtggtgaagttcttccccccagaccacacccagctgcaggaggagctgacccgctacctgtttgccctgcaggtgaagcaggacctggcccagggccgcctgacctgcaatgacaccagcgctgccctgctgatcagccacatcgtgcagagcgagatcggggactttgatgaggccctggaccgggagcacctggccaagaacaagtacatcccccagcaggatgccctggaggacaagatcgtggagttccaccacaaccacatcggccagaccccagctgagagtgacttccagctgctggagatcgcccggcggctggagatgtatggcatccggctgcacccagccaaggaccgggagggcaccaagatcaacctggccgtggccaacacaggcatcctggtgttccagggcttcaccaagatcaatgccttcaactgggccaaggtgaggaagctgtccttcaagaggaagcgcttcctgatcaagctgcggccagatgccaacagcgcctaccaggacaccctggagttcctgatggccagccgggacttctgcaagagcttctggaagatctgtgtggagcaccacgccttcttccggctgtttgaggagcccaagcccaagcccaagcctgtgctcttcagccggggcagcagcttccgcttcagcggccgcacccagaagcaggtgctggactatgtgaaggagggcggccacaagaaggtgcagtttgagaggaagcacagcaagatccacagcatccgcagcctggccagccagcccacagagctgaacagcgaggtgctggagcagagccagcagagcaccagcctgacctttggagagggcgctgagagccctgggggccagagctgccggcggggcaaggagcccaaggtgtctgctggggagcccggcagccaccccagccctgcccccaggaggagccctgctggcaacaagcaggctgatggagctgccagcgcccccacagaggaggaggaggaggtggtgaaggacaggacccagcagagcaagccccagcccccccagcccagcacaggcagcctgaccggcagcccccacctgtctgagctgtctgtgaacagccagggcggcgtggccccagccaacgtgaccctgagccccaacctgagcccagacaccaagcaggccagccccctcatcagccccctgctgaatgaccaggcctgccccaggacagatgatgaagatgagggccgcaggaagcgcttccccacagacaaggcctacttcatcgccaaggaggtgtccaccacagagaggacctacctgaaggacctggaggtgatcacctcctggttccagagcacagtgtccaaagaagatgccatgcctgaggccctgaagagcctcatcttccccaactttgagcccctgcacaagttccacaccaacttcctgaaggagattgagcagaggctggccctgtgggagggccgcagcaatgcccagatccgggactaccagagaattggagatgtgatgctgaagaacatccagggcatgaagcacctggccgcccacctgtggaagcacagcgaggccctggaggccctggagaatggcatcaagagcagccggcggctggagaacttctgccgggactttgagctgcagaaggtgtgctacctgcccctgaacaccttcctgctgcggcccctgcaccggctgatgcactacaagcaggtgctggagcggctgtgcaagcaccacccccccagccacgccgacttccgggactgcagagctgccctggccgagatcacagagatggtggcccagctgcacggcaccatgatcaagatggagaacttccagaagctgcacgagctgaagaaggacctgattggcatcgacaacctggtggtgcccggccgggagttcatccggctgggcagcctgagcaagctgagcggcaagggcctgcagcagaggatgttcttcctgttcaatgatgtgctgctgtacaccagccggggcctgacagccagcaaccagttcaaggtgcacggccagctgcccctgtatggcatgaccatcgaggagagtgaagatgagtggggcgtgccccactgcctgaccctgcggggccagaggcagagcatcatcgtggccgccagcagccgctctgagatggagaagtgggtggaggacatccagatggccatcgacctggccgagaagagcagcagccctgcccctgagttcctggccagcagccccccagacaacaagagcccagatgaggccacagctgctgaccaggagagtgaagatgacctgagcgccagcaggaccagcctggagcggcaggccccccaccggggcaacaccatggtgcacgtgtgctggcacaggaacacctctgtgtccatggtggacttcagcattgctgtggagaaccagctgagcggcaacctgctgaggaagttcaagaacagcaatggctggcagaagctgtgggtggtgttcaccaacttctgcctcttcttctacaagagccaccaggacaaccaccccctggccagcctgcccctgctgggctacagcctgaccatccccagcgagagcgagaacatccagaaggactatgtgttcaagctgcacttcaagagccacgtgtactacttccgggcagagagcgagtacacctttgagcgctggatggaggtgatccgcagcgccaccagcagcgccagccggccccacgtgctgagccacaaggagagcctggtgtactag

SEQ ID NO: 34314 - DNA, 390 bp, Artificial Sequence
  Description of Artificial Sequence: Synthetic coding sequence
atgggagaaattgagcagaggcccaccccaggcagccggctgggcgcccctgagaacagcggcatcagcaccctggagcggggccagaagcccccacccacccccagcggcaagctggtgtccatcaagatccagatgctggatgacacccaggaggcctttgaggtgcccatggtgagcagcagcagcttcctgaaggccaccggcagctcctggacaggctgggtgctgcgctgcagcatgaagcccaagcaccacagccacctgattgagaagtttggagaagatcgcatcctgacccacctgaccggcagcatctcctacaccaactgggccggcagccgcagcctggccgtgacagtgacagaggagctgctgaacctcttctag

SEQ ID NO: 34315 - DNA, 1083 bp, Artificial Sequence
  Description of Artificial Sequence: Synthetic coding sequence
atggccagccgggacttctgcaagagcttctggaagatctgtgtggagcaccacgccttcttccggctgtttgaggagcccaagcccaagcccaagcctgtgctcttcagccggggcagcagcttccgcttcagcggccgcacccagaagcaggtgctggactatgtgaaggagggcggccacaagaaggtgcagtttgagaggaagcacagcaagatccacagcatccgcagcctggccagccagcccacagagctgaacagcgaggtgctggagcagagccagcagagcaccagcctgaccttcggggagggcgctgagagccctgggggccagagctgcagaagaggcaaggagcccaaggtgtctgctggggagcccggcagccaccccagccctgccccccggcgcagccctgctggcaacaagcaggctgatggagctgccagcgcccccacagaggaggaggaggaggtggtgaaggacaggacccagcagagcaagccccagcccccccagcccagcacaggcagcctgaccggcagcccccacctgtctgagctgtctgtgaacagccagggcggcgtggccccagccaacgtgaccctgagccccaacctgagcccagacaccaagcaggccagccccctcatcagccccctgctgaatgaccaggcctgccccaggacagatgatgaagatgagggccgcaggaagcgcttccccacagacaaggcctacttcatcgccaaggaggtgtccaccacagagaggacctacctgaaggacctggaggtgatcacctcctggttccagagcacagtgtccaaggaggatgccatgcctgaggccctgaagagcctcatcttccccaactttgagcccctgcacaagttccacaccaacttcctgaaggagattgagcagaggctggccctgtgggagggccgcagcaatgcccagatccgggactaccagagaattggagatgtgatgctgaagaacatccagggcatgaaggccggcgtgcagtggagggacctgggcagcctgcagcccccaccaccccgcttcaagccctag

SEQ ID NO: 34316 - DNA, 3231 bp, Artificial Sequence
  Description of Artificial Sequence: Synthetic coding sequence
atgggagaaattgagcagaggcccaccccaggcagccggctgggcgcccctgagaacagcggcatcagcaccctggagcggggccagaagcccccacccacccccagcggcaagctggtgtccatcaagatccagatgctggatgacacccaggaggcctttgaggtgccccagagggcccctgggaaggtgctgctggatgctgtgtgcaaccacctgaacctggtggagggggactacttcggcctggagttcccagaccacaagaagatcaccgtgtggctggacctgctgaagcccatcgtgaagcagatccggcggcccaagcacgtggtggtgaagtttgtggtgaagttcttccccccagaccacacccagctgcaggaggagctgacccgctacctgtttgccctgcaggtgaagcaggacctggcccagggccgcctgacctgcaatgacaccagcgctgccctgctgatcagccacatcgtgcagagcgagatcggggactttgatgaggccctggaccgggagcacctggccaagaacaagtacatcccccagcaggatgccctggaggacaagatcgtggagttccaccacaaccacatcggccagaccccagctgagagtgacttccagctgctggagatcgcccggcggctggagatgtatggcatccggctgcacccagccaaggaccgggagggcaccaagatcaacctggccgtggccaacacaggcatcctggtgttccagggcttcaccaagatcaatgccttcaactgggccaaggtgaggaagctgtccttcaagaggaagcgcttcctgatcaagctgcggccagatgccaacagcgcctaccaggacaccctggagttcctgatggccagccgggacttctgcaagagcttctggaagatctgtgtggagcaccacgccttcttccggctgtttgaggagcccaagcccaagcccaagcctgtgctcttcagccggggcagcagcttccgcttcagcggccgcacccagaagcaggtgctggactatgtgaaggagggcggccacaagaaggtgcagtttgagaggaagcacagcaagatccacagcatccgcagcctggccagccagcccacagagctgaacagcgaggtgctggagcagagccagcagagcaccagcctgacctttggagagggcgctgagagccctgggggccagagctgccggcggggcaaggagcccaaggtgtctgctggggagcccggcagccaccccagccctgcccccaggaggagccctgctggcaacaagcaggctgatggagctgccagcgcccccacagaggaggaggaggaggtggtgaaggacaggacccagcagagcaagccccagcccccccagcccagcacaggcagcctgaccggcagcccccacctgtctgagctgtctgtgaacagccagggcggcgtggccccagccaacgtgaccctgagccccaacctgagcccagacaccaagcaggccagccccctcatcagccccctgctgaatgaccaggcctgccccaggacagatgatgaagatgagggccgcaggaagcgcttccccacagacaaggcctacttcatcgccaaggaggtgtccaccacagagaggacctacctgaaggacctggaggtgatcacctcctggttccagagcacagtgtccaaagaagatgccatgcctgaggccctgaagagcctcatcttccccaactttgagcccctgcacaagttccacaccaacttcctgaaggagattgagcagaggctggccctgtgggagggccgcagcaatgcccagatccgggactaccagagaattggagatgtgatgctgaagaacatccagggcatgaagcacctggccgcccacctgtggaagcacagcgaggccctggaggccctggagaatggcatcaagagcagccggcggctggagaacttctgccgggactttgagctgcagaaggtgtgctacctgcccctgaacaccttcctgctgcggcccctgcaccggctgatgcactacaagcaggtgctggagcggctgtgcaagcaccacccccccagccacgccgacttccgggactgcagagctgccctggccgagatcacagagatggtggcccagctgcacggcaccatgatcaagatggagaacttccagaagctgcacgagctgaagaaggacctgattggcatcgacaacctggtggtgcccggccggcccggcagcttcagcctcatccgcaccccccacctgggccaggcccggcgcatcccctgtgcccctgagcggcggcccctgctgctggtgaaggagttcatccggctgggcagcctgagcaagctgagcggcaagggcctgcagcagaggatgttcttcctgttcaatgatgtgctgctgtacaccagccggggcctgacagccagcaaccagttcaaggtgcacggccagctgcccctgtatggcatgaccatcgaggagagtgaagatgagtggggcgtgccccactgcctgaccctgcggggccagaggcagagcatcatcgtggccgccagcagccgctctgagatggagaagtgggtggaggacatccagatggccatcgacctggccgagaagagcagcagccctgcccctgagttcctggccagcagccccccagacaacaagagcccagatgaggccacagctgctgaccaggagagtgaagatgacctgagcgccagcaggaccagcctggagcggcaggccccccaccggggcaacaccatggtgcacgtgtgctggcacaggaacacctctgtgtccatggtggacttcagcattgctgtggagaaccagctgagcggcaacctgctgaggaagttcaagaacagcaatggctggcagaagctgtgggtggtgttcaccaacttctgcctcttcttctacaagagccaccaggacaaccaccccctggccagcctgcccctgctgggctacagcctgaccatccccagcgagagcgagaacatccagaaggactatgtgttcaagctgcacttcaagagccacgtgtactacttccgggcagagagcgagtacacctttgagcgctggatggaggtgatccgcagcgccaccagcagcgccagccggccccacgtgctgagccacaaggagagcctggtgtactag

SEQ ID NO: 34317 - DNA, 462 bp, Artificial Sequence
  Description of Artificial Sequence: Synthetic coding sequence
tgactgtgcaagcaccacccccccagccatgctgacttccgggactgccgggccgccctggccgagatcacagagatggtggcccagctgcacggcaccatgatcaagatggagaacttccagaagctgcacgagctgaagaaggacctgattggaattgacaacctggtggtgcccggccgggtgagcagcagcggcctgaccatgcactgtgccggcagcaggaaggaggccagcgagggcctgacctttgagccctttgaggagcggcccctgcagagcaagatgagcagcttccaccccccaggccggcagctggagaagcacaacagcgtggtgtcctctgagagcctgtgcagcgaggagatcaagcagagcagtgacctgatcttctgcttcttcagcctgcggggggacagcctgctgtacctgttcccctaccacatcccccagaagatctag

SEQ ID NO: 34318 - DNA, 555 bp, Artificial Sequence
  Description of Artificial Sequence: Synthetic coding sequence
tgaagcctgaccggcagcccccacctgtctgagctgtctgtgaacagccagggcggcgtggccccagccaacgtgaccctgagccccaacctgagcccagacaccaagcaggccagccccctcatcagccccctgctgaatgaccaggcctgccccaggacagatgatgaagatgagggccgcaggaagcgcttccccacagacaaggcctacttcatcgccaaggaggtgtccaccacagagaggacctacctgaaggacctggaggtgatcacctcctggttccagagcacagtgtccaaggaggatgccatgcctgaggccctgaagagcctcatcttccccaactttgagcccctgcacaagttccacaccaacttcctgaaggagattgagcagaggctggccctgtgggagggccgcagcaatgcccagatccgggactaccagagaattggagatgtgatgctgaagaacatccagggcatgaaggccggcgtgcagtggagggacctgggcagcctgcagcccccaccaccccgcttcaagccctag

SEQ ID NO: 34319 - DNA, 3165 bp, Artificial Sequence
  Description of Artificial Sequence: Synthetic coding sequence
atgggagaaattgagggcacctacagagtgctgcagacagctggcatgaggctgggcgcccagacccctgtgggcgtgtccaccctggagcccggccagaccctgctgcccaggatgcaggagaagcacctgcacctgcgggtgaagctgctggacaacaccatggagatctttgacatcgagcccaagtgtgatggccaggtgctgctgacccaggtgtggaagaggctgaacctggtggagtgtgactacttcggcatggagttccagaacacccagagctactggatctggctggagcccatgaagcccatcatccggcagatccggcggcccaagaatgtggtgctgcggctggccgtgaagttcttccccccagaccccggccagctgcaggaggagtacacccgctacctgtttgccctgcagctgaagagggacctgctggaggagcggctgacctgtgccgacaccacagctgccctgctgaccagccacctgctgcagagcgagatcggggactatgatgagaccctggaccgggagcacctgaaggtgaatgagtacctgcccggccagcagcactgcctggagaagatcctggagttccaccagaagcacgtgggccagaccccagctgagagtgacttccaggtgctggagatcgccaggaagctggagatgtatggcatccgcttccacatggccagtgaccgggagggcaccaagatccagctggccgtgagccacatgggcgtgctggtgttccagggcaccaccaagatcaacaccttcaactggagcaaggtgaggaagctgtccttcaagaggaagcgcttcctgatcaagctgcaccctgaggtgcacggcccctaccaggacaccctggagttcctgctgggcagcagagatgagtgcaagaacttctggaagatctgtgtggagtaccacaccttcttccggctgctggaccagcccaagcccaaggccaaggctgtgttcttcagccggggcagcagcttccgctacagcggccgcacccagaagcagctggtggactacttcaaggacagcggcatgaagaggatcccctatgaaagaagacacagcaagacccacacctctgtgcgggccctgacagctgacctgcccaagcagagcatctccttccctgagggcctgcggaccccagccagccccagcagcgccaatgccttctacagcctgagccccagcaccctggtgcccagcggcctgcctgagttcaaggacagcagcagcagcctgacagacccccaggtgtcctatgtgaagagccctgctgctgagcggcgcagcggggctgtggccggcggccctgacaccccatctgcccagcccctgggccccccagccctgcagcccggccctggcctgagcaccaagagcccccagcccagccccagcagcaggaagagccccctgagcctgagccctgccttccaggtgcccctgggccctgctgagcagggcagcagccccctgctgagccctgtgctgagtgatgctgggggcgccggcatggactgtgaggagcccaggcacaagagggtgcctgcagatgaggcctacttcatcgtgaaggagatcctggccacagagaggacctacctgaaggacctggaggtgatcaccgtgtggttccgctctgctgtggtgaaggaggatgccatgcctgccaccctgatgaccctgctcttcagcaacatcgaccccatctatgagttccaccggggcttcctgcgggaggtggagcagaggctggccctgtgggagggccccagcaaggcccacaccaagggcagccaccagagaattggagacatcctgctgaggaacatgaggcagctgaaggagttcaccagctacttccagagacatgatgaggtgctgacagagctggagaaggccaccaagcgctgcaagaagctggaggccgtgtacaaggagtttgagctgcagaaggtgtgctacctgcccctgaacaccttcctgctgaagcccatccagaggctgctgcactaccgcctgctgctgcggcggctgtgtggccactacagccctggccaccacgactatgctgactgccatgatgccctgaaggccatcacagaggtgaccaccaccctgcagcacatcctgatccggctggagaacctgcagaagctgacagagctgcagagggacctggtgggcattgaaaatctcatcgcccctggccgggagttcatccgggagggctgcctgcacaagctgaccaagaagggcctgcagcagaggatgttcttcctgttcagtgacatgctgctgtacaccagcaaaggagtggccggcaccagccacttccgcatccggggcctgctgcccctgcagggcatgctggtggaggagagtgacaatgagtggagcgtgccccactgcttcaccatctatgctgcccagaagaccatcgtggtggccgccagcacccggctggagaaggagaagtggatgctggacctgaacagcgccatccaggccgccaagagcggcggggacacagccccagccctgcccggccgcacagtgtgcaccaggcctcccaggagccccaatgaggtgtccctggagcaggagagtgaagatgatgcccggggcgtgcgcagcagcctggagggccacggccagcaccgggccaacaccaccatgcacgtgtgctggtacagaaacacctctgtgtccagagctgaccacagcgctgctgtggagaaccagctgagcggctacctgctgaggaagttcaagaacagccacggctggcagaagctgtgggtggtgttcaccaacttctgcctcttcttctacaagacccaccaggatgactaccccctggccagcctgcccctgctgggctacagcgtgtccatcccccgggaggctgatggcatccacaaggactatgtgttcaagctgcagttcaagagccacgtgtacttcttccgggcagagagcaagtacacctttgagcgctggatggaggtgatccagggcgccagcagcagcgctggccgggcccccagcatcgtgcaggacggcccccagcccagcagcggcctggagggcatggtgcggggcaaggaggagtag

SEQ ID NO: 34320 - DNA, 1944 bp, Artificial Sequence
  Description of Artificial Sequence: Synthetic coding sequence
atgggagaaattgagggcacctacagagtgctgcagacagctggcatgaggctgggcgcccagacccctgtgggcgtgtccaccctggagcccggccagaccctgctgcccaggatgcaggagaagcacctgcacctgcgggtgaagctgctggacaacaccatggagatctttgacatcgagcccaagtgtgatggccaggtgctgctgacccaggtgtggaagaggctgaacctggtggagtgtgactacttcggcatggagttccagaacacccagagctactggatctggctggagcccatgaagcccatcatccggcagatccggcggcccaagaatgtggtgctgcggctggccgtgaagttcttccccccagaccccggccagctgcaggaggagtacacccgctacctgtttgccctgcagctgaagagggacctgctggaggagcggctgacctgtgccgacaccacagctgccctgctgaccagccacctgctgcagagcgagatcggggactatgatgagaccctggaccgggagcacctgaaggtgaatgagtacctgcccggccagcagcactgcctggagaagatcctggagttccaccagaagcacgtgggccagaccccagctgagagtgacttccaggtgctggagatcgccaggaagctggagatgtatggcatccgcttccacatggccagtgaccgggagggcaccaagatccagctggccgtgagccacatgggcgtgctggtgttccagggcaccaccaagatcaacaccttcaactggagcaaggtgaggaagctgtccttcaagaggaagcgcttcctgatcaagctgcaccctgaggtgcacggcccctaccaggacaccctggagttcctgctgggcagcagagatgagtgcaagaacttctggaagatctgtgtggagtaccacaccttcttccggctgctggaccagcccaagcccaaggccaaggctgtgttcttcagccggggcagcagcttccgctacagcggccgcacccagaagcagctggtggactacttcaaggacagcggcatgaagaggatcccctatgaaagaagacacagcaagacccacacctctgtgcgggccctgacagctgacctgcccaagcagagcatctccttccctgagggcctgcggaccccagccagccccagcagcgccaatgccttctacagcctgagccccagcaccctggtgcccagcggcctgcctgagttcaaggacagcagcagcagcctgacagacccccaggtgtcctatgtgaagagccctgctgctgagcggcgcagcggggctgtggccggcggccctgacaccccatctgcccagcccctgggccccccagccctgcagcccggccctggcctgagcaccaagagcccccagcccagccccagcagcaggaagagccccctgagcctgagccctgccttccaggtgcccctgggccctgctgagcagggcagcagccccctgctgagccctgtgctgagtgatgctgggggcgccggcatggactgtgaggagcccaggcacaagagggtgcctgcagatgaggcctacttcatcgtgaaggagatcctggccacagagaggacctacctgaaggacctggaggtgatcaccgtgtggttccgctctgctgtggtgaaggaggatgccatgcctgccaccctgatgaccctgctcttcagcaacatcgaccccatctatgagttccaccggggcttcctgcgggaggtggagcagaggctggccctgtgggagggccccagcaaggcccacaccaagggcagccaccagagaattggagacatcctgctgaggaacatgaggcagctgaaggtgttccagctgcacgagggccacgtggccggcgtgaccaagatggagtag

SEQ ID NO: 34321 - DNA, 171 bp, Artificial Sequence
  Description of Artificial Sequence: Synthetic coding sequence
tgaaaaagccacgtgtacttcttccgggcagagagcaagtacacctttgagcgctggatggaggtgatccagggcgccagcagcagcgctggccgggcccccagcatcgtgcaggacggcccccagcccagcagcggcctggagggcatggtgcggggcaaggaggagtag

SEQ ID NO: 34322 - DNA, 405 bp, Artificial Sequence
  Description of Artificial Sequence: Synthetic coding sequence
atgggagaaattgagggcacctacagagtgctgcagacagctggcatgaggctgggcgcccagacccctgtgggcgtgtccaccctggagcccggccagaccctgctgcccaggatgcaggagaagcacctgcacctgcgggtgaagctgctggacaacaccatggagatctttgacatcgagcccaagtgtgatggccaggtgctgctgacccaggtgtggaagaggctgaacctggtggagtgtgactacttcggcatggagttccagaacacccagagctactggatctggctggagcccatgaagcccatcatccggcagatccggcggcccaagaatgtggtgctgcggctggccgtgaagttcttccccccagaccccggccagctgcaggaggagtag

SEQ ID NO: 34323 - DNA, 282 bp, Artificial Sequence
  Description of Artificial Sequence: Synthetic coding sequence
atgggagaaattgagggcacctacagagtgctgcagacagctggcatgaggctgggcgcccagacccctgtgggcgtgtccaccctggagcccggccagaccctgctgcccaggatgcaggagaagcacctgcacctgcgggtgaagctgctggacaacaccatggagatctttgacatcgagcccaagtgtgatggccaggtgctgctgacccaggtgtggaagaggctgaacctggtggagtgtgactacttcggcatggagttccagaacacccagtag

SEQ ID NO: 34324 - DNA, 1917 bp, Artificial Sequence
  Description of Artificial Sequence: Synthetic coding sequence
atgggagaaattgagggcacctacagagtgctgcagacagctggcatgaggctgggcgcccagacccctgtgggcgtgtccaccctggagcccggccagaccctgctgcccaggatgcaggagaagcacctgcacctgcgggtgaagctgctggacaacaccatggagatctttgacatcgagcccaagtgtgatggccaggtgctgctgacccaggtgtggaagaggctgaacctggtggagtgtgactacttcggcatggagttccagaacacccagagctactggatctggctggagcccatgaagcccatcatccggcagatccggcggcccaagaatgtggtgctgcggctggccgtgaagttcttccccccagaccccggccagctgcaggaggagtacacccgctacctgtttgccctgcagctgaagagggacctgctggaggagcggctgacctgtgccgacaccacagctgccctgctgaccagccacctgctgcagagcgagatcggggactatgatgagaccctggaccgggagcacctgaaggtgaatgagtacctgcccggccagcagcactgcctggagaagatcctggagttccaccagaagcacgtgggccagaccccagctgagagtgacttccaggtgctggagatcgccaggaagctggagatgtatggcatccgcttccacatggccagtgaccgggagggcaccaagatccagctggccgtgagccacatgggcgtgctggtgttccagggcaccaccaagatcaacaccttcaactggagcaaggtgaggaagctgtccttcaagaggaagcgcttcctgatcaagctgcaccctgaggtgcacggcccctaccaggacaccctggagttcctgctgggcagcagagatgagtgcaagaacttctggaagatctgtgtggagtaccacaccttcttccggctgctggaccagcccaagcccaaggccaaggctgtgttcttcagccggggcagcagcttccgctacagcggccgcacccagaagcagctggtggactacttcaaggacagcggcatgaagaggatcccctatgaaagaagacacagcaagacccacacctctgtgcgggccctgacagctgacctgcccaagcagagcatctccttccctgagggcctgcggaccccagccagccccagcagcgccaatgccttctacagcctgagccccagcaccctggtgcccagcggcctgcctgagttcaaggacagcagcagcagcctgacagacccccaggtgtcctatgtgaagagccctgctgctgagcggcgcagcggggctgtggccggcggccctgacaccccatctgcccagcccctgggccccccagccctgcagcccggccctggcctgagcaccaagagcccccagcccagccccagcagcaggaagagccccctgagcctgagccctgccttccaggtgcccctgggccctgctgagcagggcagcagccccctgctgagccctgtgctgagtgatgctgggggcgccggcatggactgtgaggagcccaggcacaagagggtgcctgcagatgaggcctacttcatcgtgaaggagatcctggccacagagaggacctacctgaaggacctggaggtgatcaccgtgtggttccgctctgctgtggtgaaggaggatgccatgcctgccaccctgatgaccctgctcttcagcaacatcgaccccatctatgagttccaccggggcttcctgcgggaggtggagcagaggctggccctgtgggagggccccagcaaggcccacaccaagggcagccaccagagaattggagacatcctgctgaggaacatgaggcagctgaaggccgcccacgagttcaccacctag

SEQ ID NO: 34325 - DNA, 1155 bp, Artificial Sequence
  Description of Artificial Sequence: Synthetic coding sequence
atggccgcccagaatggaaacaccagcttcacccccaacttcaaccccccccaggaccacgccagcagcctgtccttcaacttctcctatggagactatgacctgcccatggatgaagatgaggacatgaccaagaccaggaccttctttgctgccaagatcgtcatcggcatcgccctggccggcatcatgctggtgtgtggcatcggcaactttgtgttcatcgccgccctgacccgctacaagaagctgaggaacctgaccaacctgctgattgccaacctggccatcagtgacttcctggtggccatcatctgctgcccctttgagatggactactacgtggtgcggcagctgtcctgggagcacggccacgtgctgtgtgcctctgtgaactacctgaggacagtgtccctgtatgtgtccaccaatgccctgctggccatcgccatcgaccgctacctggccatcgtgcaccccctgaagcccaggatgaactaccagacagccagcttcctgattgccctggtgtggatggtgtccatcctgattgccatccccagcgcctactttgccacagaaacagtgctcttcatcgtgaagagccaggagaagatcttctgtggccagatctggcctgtggaccagcagctgtactacaagagctacttcctgttcatcttcggcgtggagtttgtgggccctgtggtgaccatgaccctgtgctacgcccgcatcagccgggagctgtggttcaaggctgtgcccggcttccagacagagcagatcaggaagaggctgcgctgcaggaggaagacagtgctggtgctgatgtgcatcctgacagcctacgtgctgtgctgggcccccttctacggcttcaccatcgtgcgggacttcttccccaccgtgtttgtgaaggagaagcactacctgacagccttctacgtggtggagtgcatcgccatgagcaacagcatgatcaacacagtgtgctttgtgacagtgaagaacaacaccatgaagtacttcaagaagatgatgctgctgcactggaggcccagccagaggggcagcaagagcagcgctgacctggacctgcggaccaacggggtgcccaccacagaggaggtggactgcatccggctgaagtag

SEQ ID NO: 34326 - DNA, 1668 bp, Artificial Sequence
  Description of Artificial Sequence: Synthetic coding sequence
atgctgagcagcacagacttcacctttgcctcctgggagctggtggtgcgggtggaccaccccaatgaggagcagcagaaggatgtgaccctgcgggtgtctggggacctgcacgtgggcggcgtgatgctgaagctggtggagcagatcaacatcagccaggactggagcgactttgccctgtggtgggagcagaagcactgctggctgctgaagacccactggaccctggacaagtatggagtgcaggctgatgccaagctgctcttcaccccccagcacaagatgctgcggctgcggctgcccaacctgaagatggtgcggctgcgggtgtccttctctgctgtggtgttcaaggctgtgtctgacatctgcaagatcctgaacatcagaagaagtgaggagctgagcctgctgaagcccagcggggactacttcaagaagaagaagaagaaggacaagaacaacaaggagcccatcatcgaggacatcctgaacctggagagcagccccacagccagcggcagctctgtgtccccaggcctgtacagcaagaccatgacccccatctatgaccccatcaatggcaccccagccagcagcaccatgacctggttcagtgacagccccctgacagagcagaactgcagcatcctggccttcagccagcccccccagagccctgaggccctggccgacatgtaccagcccaggagcctggtggacaaggccaagctgaatgccggctggctggacagcagccgcagcctgatggagcagggcatccaggaggatgagcagctgctgctgcgcttcaagtactacagcttctttgacctgaaccccaagtatgatgctgtgcgcatcaaccagctgtatgagcaggcccgctgggccatcctgctggaggagattgactgcacagaggaggagatgctgatctttgctgccctgcagtaccacatcagcaagctgagcctgtctgctgagacccaggactttgctggggagagcgaggtggatgaaattgaagctgccctgagcaacctggaggtgaccctggagggcggcaaggctgacagcctgctggaggacatcacagacatccccaagctggccgacaacctgaagctgttccggcccaagaagctgctgcccaaggccttcaagcagtactggttcatcttcaaggacaccagcatcgcctacttcaagaacaaggagctggagcagggcgagcccctggagaagctgaacctgcggggctgtgaggtggtgcctgatgtgaatgtggccggcaggaagtttggcatcaagctgctgatccctgtggctgatggcatgaatgagatgtacctgcgctgtgaccacgagaaccagtatgcccagtggatggccgcctgcatgctggccagcaagggcaagaccatggctgacagcagctaccagcctgaggtgctgaacatcctgtccttcctgaggatgaagaacagaaacagcgccagccaggtggccagcagcctggagaacatggacatgaaccctgagtgctttgtgagcccccgctgtgccaagaggcacaagagcaagcagctggccgcccgcatcctggaggcccaccacctgcaggcccccttccacagctaccgcagcctgagccacctgtag

SEQ ID NO: 34327 - DNA, 441 bp, Artificial Sequence
  Description of Artificial Sequence: Synthetic coding sequence
atgctgagcagcacagacttcacctttgcctcctgggagctggtggtgcgggtggaccaccccaatgaggagcagcagaaggatgtgaccctgcgggtgtctggggacctgcacgtgggcggcgtgatgctgaagctggtggagcagatcaacatcagccaggactggagcgactttgccctgtggtgggagcagaagcactgctggctgctgaagacccactggaccctggacaagtatggagtgcaggctgatgccaagctgctcttcaccccccagcacaagatgctgcggctgcggctgcccaacctgaagatggtgcggctgcgggtgtccttctctgctgtggtgttcaaggctgtgtctgacatctgcaagatcctgaacatcagaagaagtgaggagctgagcctgctgaagcccagcggggactacttctag

SEQ ID NO: 34328 - DNA, 1263 bp, Artificial Sequence
  Description of Artificial Sequence: Synthetic coding sequence
atggagcagggcatccaggaggatgagcagctgctgctgcgcttcaagtactacagcttctttgacctgaaccccaagtatgatgctgtgcgcatcaaccagctgtatgagcaggcccgctgggccatcctgctggaggagattgactgcacagaggaggagatgctgatctttgctgccctgcagtaccacatcagcaagctgagcctgtctgctgagacccaggactttgctggggagagcgaggtggatgaaattgaggccgccctgagcaacctggaggtgaccctggagggcggcaaggctgacagcctgctggaggacatcacagacatccccaagctggccgacaacctgaagctgttccggcccaagaagctgctgcccaaggccttcaagcagtactggttcatcttcaaggacaccagcatcgcctacttcaagaacaaggagctggagcagggcgagcccctggagaagctgaacctgcggggctgtgaggtggtgcctgatgtgaatgtggccggcaggaagtttggcatcaagctgctgatccctgtggctgatggcatgaatgagatgtacctgcgctgtgaccacgagaaccagtatgcccagtggatggccgcctgcatgctggccagcaagggcaagaccatggctgacagcagctaccagcctgaggtgctgaacatcctgtccttcctgaggatgaagaacagaaattctgccagccaggtggccagcagcctggagaacatggacatgaacccagaatgttttgtgagcccccgctgtgccaagaggcacaagagcaagcagctggccgcccgcatcctggaggcccaccagaatgtggcccagatgcccctggtggaggccaagctgcgcttcatccaggcctggcagagcctgcctgagtttggcctgacctactacctggtgcgcttcaagggcagcaagaaggatgacatcctgggcgtgtcctacaacagactcatcaagattgatgctgccaccggcatccctgtgaccacctggaggttcaccaacatcaagcagtggaatgtgaactgggagacccggcaggtggtgattgaatttgaccagaatgtgttcaccgccttcacctgcctgtctgctgactgcaagatcgtgcatgagtacatcggcggctacatcttcctgagcaccaggagcaaggaccagaatgagaccctggatgaagatctcttccacaagctgaccggcggccaggactag

SEQ ID NO: 34329 - DNA, 552 bp, Artificial Sequence
  Description of Artificial Sequence: Synthetic coding sequence
atggccgcctccatggcccggggcggcgtgtctgcccgggtgctgctgcaggccgcccggggcacctggtggaacagacctgggggcaccagcggcagcggggagggcgtggccctgggcaccaccaggaagttccaggccaccggcagcaggcctgctggggaggaggatgctgggggccctgagaggcctggagatgtggtgaatgtggtgtttgtggacaggagcggccagagaattcctgtgtctggccgggtgggggacaacgtgctgcacctggcccagagacatggagtggacctggagggcgcctgtgaggccagcctggcctgcagcacctgccacgtgtatgtgtctgaggaccacctggacctgctgcccccacctgaggagagagaagatgacatgctggacatggcccccctgctgcaggagaacagccggctgggctgccagatcgtgctgaccccagagctggagggcgctgagttcaccctgcccaagatcaccaggaacttctacgtggatggccacgtgcccaagccccactag

SEQ ID NO: 34330 - DNA, 438 bp, Artificial Sequence
  Description of Artificial Sequence: Synthetic coding sequence
atgcacgtgatggccgcctccatggcccggggcggcgtgtctgcccgggtgctgctgcaggccgcccggggcacctggtggaacagacctgggggcaccagcggcagcggggagggcgtggccctgggcaccaccaggaagttccaggccaccggcagcaggcctgctggggaggaggatgctgggggccctgagaggcctggagatgtggtgaatgtggtgtttgtggacagaagtggccagagaattcctgtgtctggccgggtgggggacaacgtgctgcacctggcccagagacatggagtggacctggagggcgcctgtgaggccagcctggcctgcagcacctgccacgtgtatgtgtctgaggaccacctggacctgctgcccccacctgaggagaggaggacccggggctgggccgcccggctgtgctag

SEQ ID NO: 34331 - DNA, 552 bp, Artificial Sequence
  Description of Artificial Sequence: Synthetic coding sequence
atggccggcggcccccccaacaccaaggccgagatggagatgagcctggccgaggagctgaaccacggccggcagggcgagaaccaggagcacctggtgattgctgagatgatggagctgggcagccgcagcagaggagccagccagaagaagcagaagctggagcagaaggctgctggcagcgccagcgccaagagggtgtggaacatgacagccacccggcccaagaagatgggcagccagctgcccaagcccaggatgctgcgggagagcggccatggagatgcccacctgcaggagtatgccggcaacttccagggcatccgcttccactatgacaggaaccctggaacagatgctgtggcccagaccagcctggaggagttcaacgtgctggagatggaggtgatgaggcggcagctgtatgctgtgaacagaaggctgcgggccctggaggagcagggcgccacctggaggcaccgggagaccctcatcatcgctgtgctggtgtctgccagcatcgccaacctgtggctgtggatgaaccagtag

SEQ ID NO: 34332 - DNA, 1527 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgggcagcggcatcatggagctgacagacacagagctgatcctgtacaccaggaagagggacagcgtgaagtggcactacctgtgcctgcggcgctatggctatgacagcaacctcttctcctttgagagcggccgccgctgccagacaggccagggcatctttgccttcaagtgtgcccgggcagaggagctgttcaacatgctgcaggagatcatgcagaacaacagcatcaacgtggtggaggagcctgtggtggagaggaacaaccaccagacagagctggaggtgcccaggacccccaggacccccaccaccccaggctttgctgcccagaacctgcccaacggctacccccgctaccccagctttggagatgccagcagccaccccagcagccgccaccccagcgtgggcagcgcccggctgcccagcgtgggggaggagagcacccaccccctgctggtggccgaggagcaggtgcacacctacgtgaacaccaccggggtgcaggaggagaggaagaacagaacatctgtgcacgtgcccctggaggcccgggtgtccaatgctgagagcagcacccccaaggaggagcccagcagcattgaggaccgggacccccagatcctgctggagcctgagggcgtgaagtttgtgctgggccccacccctgtgcagaagcagctgatggagaaggagaagctggagcagctgggccgggaccaggtgtctggcagcggggccaacaacacagagtgggacaccggctatgacagtgatgaaagaagagatgcccccagcgtgaacaagctggtgtatgagaacatcaatggcctgagcatccccagcgccagcggcgtgagaagaggccgcctgaccagcaccagcaccagtgacacccagaacatcaacaacagcgcccagaggagaacagccctgctgaactatgagaacctgcccagcctgccccctgtgtgggaggccaggaagctgagcagagatgaagatgacaacctgggccccaagacccccagcctgaatggctaccacaacaacctggaccccatgcacaactacgtgaacacagaaaatgtgacagtgcctgccagcgcccacaagattgagtacagcagaagaagagactgcacccccaccgtcttcaactttgacatcagaagacccagcctggagcaccggcagctgaactacatccaggtggacctggagggcggcagtgacagcgacaacccccagacccccaagacccccaccacccccctgccccagacccccaccaggagaacagagctgtatgctgtgattgacatcgagaggacagctgccatgagcaacctgcagaaggccctgcccagagatgatggcaccagcaggaagaccaggcacaacagcacagacctgcccatgtag

SEQ ID NO: 34333 - DNA, 1527 bp, Artificial Sequence; identical to SEQ ID NO: 34332
  Description of Artificial Sequence: Synthetic coding sequence

SEQ ID NO: 34334 - DNA, 111 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgggcagcggctag

SEQ ID NO: 34335 - DNA, 123 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgggcagcggcatcatggagctgtag

SEQ ID NO: 34336 - DNA, 102 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgtag

SEQ ID NO: 34337 - DNA, 1527 bp, Artificial Sequence; identical to SEQ ID NO: 34332
  Description of Artificial Sequence: Synthetic coding sequence

SEQ ID NO: 34338 - DNA, 33 bp, Artificial Sequence
  Description of Artificial Sequence: Synthetic coding sequence
atgggcagctgctgcagctgcccagacaagtag

SEQ ID NO: 34339 - DNA, 39 bp, Artificial Sequence
  Description of Artificial Sequence: Synthetic coding sequence
atgggcagctgctgcagctgcccagacaaggacacctag

SEQ ID NO: 34340 - DNA, 1527 bp, Artificial Sequence; identical to SEQ ID NO: 34332
  Description of Artificial Sequence: Synthetic coding sequence

SEQ ID NO: 34341 - DNA, 276 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgggcagcggcatcatggagctgacagacacagagctgatcctgtacaccaggaagagggacagcgtgaagtggcactacctgtgcctgcggcgctatggctatgacagcaacctcttctcctttgagagcggccgccgctgccagacaggccagggcatctttgccttcaagtgctag

SEQ ID NO: 34342 - DNA, 552 bp, Artificial Sequence
  Description of Artificial Sequence: Synthetic coding sequence
atgggcagctgctgcagctgcccagacaaggacacagtgcctgacaaccacaggaacaagttcaaggtgatcaacgtggatgatgatggaaatgagctgggcagcggcatcatggagctgacagacacagagctgatcctgtacaccaggaagagggacagcgtgaagtggcactacctgtgcctgcggcgctatggctatgacagcaacctcttctcctttgagagcggccgccgctgccagacaggccagggcatctttgccttcaagtgtgcccgggcagaggagctgttcaacatgctgcaggagatcatgcagaacaacagcatcaacgtggtggaggagcctgtggtggagaggaacaaccaccagacagagctggaggtgcccaggacccccaggacccccaccaccccaggctttgctgcccagaacctgcccaacggctacccccgctaccccagctttggagatgccagcagccaccccagcagccgccaccccagcgtgggcagcgcccggctgcccagcgtgggggaggagagcacctag

SEQ ID NO: 34343 - DNA, 1479 bp, Artificial Sequence
  Description of Artificial Sequence: Synthetic coding sequence
atgggcagctgctgcagctgcctgaacagagacagcgtgcctgacaaccaccccaccaagttcaaggtgaccaacgtggatgatgagggcgtggagctgggcagcggcgtgatggagctgacccagagcgagctggtgctgcacctgcacagaagagaggccgtgcgctggccctacctgtgcctgcggcgctatggctatgacagcaacctcttctcctttgagagcggccgccgctgccagacaggccagggcatctttgccttcaagtgcagcagagctgaggagatcttcaacctgctgcaggacctgatgcagtgcaacagcatcaacgtgatggaggagcccgtcatcatcaccaggaacagccaccctgctgagctggacctgccccgggccccccagcccccaaatgccctgggctacacagtgagcagcttcagcaatggctgccctggagagggcccccgcttcagcgccccccggcggctgagcaccagcagcctgcggcaccccagcctgggggaggagagcacccacgccctgattgccccagatgagcagagccacacctacgtgaacaccccagcctctgaagatgaccacagaagaggccgccactgcctgcagcccctgcctgagggccaggcccccttcctgccccaggcccggggccctgaccagagggacccccaggtgttcctgcagcccggccaggtgaagtttgtgctgggccccaccccagcccggcggcacatggtgaagtgccagggcctgtgccccagcctgcatgaccccccccaccacaacaacaacaatgaggcccccagcgagtgcccagcccagcccaagtgcacctatgaaaatgtgactggaggcctgtggaggggggccggctggaggctgagccctgaggagcccggctggaatggcctggcccacagaagagctgccctgctgcactatgagaacctgccccccctgccccctgtgtgggagagccaggcccagcagctgggcggggaggccggagatgatggagacagcagagatggcctgacccccagcagcaatggcttcccagatggagaagaagatgagacccccctgcagaagcccaccagcacccgggccgccatccgcagccacggcagcttccctgtgcccctgaccaggagaagaggcagccccagggtcttcaactttgacttcagaagacctggccctgagcccccccggcagctgaactacatccaggtggagctgaagggctggggcggggaccggcccaagggcccccagaaccccagcagcccccaggcccccatgcccaccacccacccagcccggagcagtgacagctatgctgtgattgacctgaagaagacagtggccatgagcaacctgcagagggccctgcccagagatgatggaacagccaggaagaccaggcacaacagcacagacctgcccctgtag

SEQ ID NO: 34344 - DNA, 1479 bp, Artificial Sequence; identical to SEQ ID NO: 34343
  Description of Artificial Sequence: Synthetic coding sequence

SEQ ID NO: 34345 - DNA, 111 bp, Artificial Sequence
  Description of Artificial Sequence: Synthetic coding sequence
atgggcagctgctgcagctgcctgaacagagacagcgtgcctgacaaccaccccaccaagttcaaggtgaccaacgtggatgatgagggcgtggagctgggcagcggctag

SEQ ID NO: 34346 - DNA, 444 bp, Artificial Sequence
  Description of Artificial Sequence: Synthetic coding sequence
atggagaccccaagaagagcccggagccctgtgagcccccagtttcctggccaggccggctgcagcgacaccatgggcagctgctgcagctgcctgaacagagacagcgtgcctgacaaccaccccaccaagttcaaggtgaccaacgtggatgatgagggcgtggagctgggcagcggcgtgatggagctgacccagagcgagctggtgctgcacctgcacagaagagaggccgtgcgctggccctacctgtgcctgcggcgctatggctatgacagcaacctcttctcctttgagagcggccgccgctgccagacaggccagggcatctttgccttcaagtgcagcagagctgaggagatcttcaacctgctgcaggacctgatgcagtgcaacagcatcaacgtgatggaggagcccgtcatcatcaccaggaacagctag

SEQ ID NO: 34347 - DNA, 3405 bp, Artificial Sequence
  Description of Artificial Sequence: Synthetic coding sequence
atgatgagccccaatggatctgtgccccccatctacgtgcccccaggctacgccccccaggtgattgaagataatggagtgcggcgggtggtggtggtgccccaggcccctgagttccaccctggcagccacacagtgctgcacaggagcccccacccccccctgcccggcttcatccctgtgcccaccatgatgcctcctccacccaggcacatgtacagccctgtgactggagctggggacatgaccacccagtacatgccccagtaccagagcagccaggtgtatggagatgtggatgcccacagcacccacggccgcagcaacttcagagatgagaggagcagcaagacctatgagcggctgcagaagaagctgaaggaccggcagggcacccagaaggacaagatgagcagcccccccagcagcccccagaagtgccccagccccatcaatgagcacaacggcctcatcaagggccagattgctgggggcatcaacacaggcagcgccaagatcaagtctggaaaaggaaaaggaggcacccaggtggacacagaaattgaggagaaggatgaggagaccaaggcctttgaggccctgctgagcaacatcgtgaagcctgtggccagtgacatccaggccaggacagtggtgctgacctggagcccccccagcagcctcatcaacggggagacagatgagagctctgtgcctgagctgtatggctatgaggtgctgatcagcagcacaggcaaggatggcaagtacaagtctgtgtatgtgggggaggagaccaacatcaccctgaatgacctgaagccagccatggactaccacgccaaggtgcaggccgagtacaacagcatcaagggcaccccatctgaggccgagatcttcaccaccctgagctgtgagccagacatccccaaccccccaagaattgccaacagaaccaagaacagcctgaccctgcagtggaaggcccccagcgacaatggcagcaagatccagaactttgtgctggagtgggatgagggcaaaggaaatggagagttctgccagtgctacatgggcagccagaagcagttcaagatcaccaagctgagccctgccatgggctgcaagttccggctgagcgccagaaatgactatggcaccagcggcttcagcgaggaggtgctgtactacaccagcggctgtgcccccagcatgcctgccagccctgtgctgaccaaggccggcatcacctggctgagcctgcagtggagcaagcccagcggcacccccagtgatgagggcatctcctacatcctggagatggaggaggagaccagcggctacggcttcaagcccaagtatgatggagaggacctggcctacacagtgaagaacctgcggcgcagcaccaagtacaagttcaaggtgattgcctacaacagcgagggcaagagcaaccccagcgaggtggtggagttcaccacctgcccagacaagccaggcatccctgtgaagcccagcgtgaagggcaagatccacagccacagcttcaagatcacctgggacccccccaaggacaatggaggagccaccatcaacaagtatgtggtggagatggccgagggcagcaatggaaacaagtgggagatgatctacagcggggccacccgggagcacctgtgtgaccggctgaaccctggctgcttctaccgcctgcgggtgtactgcatcagtgatggcggccagagcgctgtgtctgagagcctgctggtgcagaccccagctgtgcccccaggcccctgcctgcccccccggctgcagggccggcccaaggccaaggagatccagctgcgctggggcccccccctggtggatggcggcagccccatcagctgctacagcgtggagatgagccccatcgagaaggatgagccccgggaggtgtaccagggcagcgaggtggagtgcaccgtgagcagcctgctgcccgggaagacctacagcttccggctgcgggccgccaacaagatgggcttcggccccttcagcgagaagtgtgacatcaccacagcccctggccccccagaccagtgcaagccaccccaggtgacctgccgcagcgccacctgtgcccaggtgaactgggaggtgcccctgagcaatggaacagatgtgacagagtaccgcctggagtggggcggcgtggagggctccatgcagatctgctactgcggccctggcctgtcctatgagatcaagggcctgagccctgccaccacctactactgccgggtgcaggccctgtctgtggtgggcgccggccccttcagcgaggtggtggcctgtgtgaccccaccttctgtgcccggcatcgtgacctgcctgcaggagatcagtgatgatgaaattgagaacccccactacagccccagcacctgcctggccatctcctgggagaagccctgtgaccacggcagcgagatcctggcctacagcattgactttggagacaagcagagcctgactgtgggcaaggtgaccagctacatcatcaacaacctgcagcctgacaccacctaccgcatccgcatccaggccctgaacagcctgggcgccggccccttcagccacatgatcaagctgaagaccaagcccctgcccccagaccccccccggctggagtgtgtggccttcagccaccagaacctgaagctgaagtggggcgagggcacccccaagaccctgagcacagacagcatccagtaccacctgcagatggaggacaagaatggccgctttgtgtccctgtaccggggcccctgccacacctacaaggtgcagaggctgaatgaaagcaccagctacaagttctgcatccaggcctgcaatgaagctggggagggccccctgagccaggagtacatcttcaccacccccaagtctgtgcctgctgccctgaaggcccccaagattgagaaggtgaatgaccacatctgtgagatcacctgggagtgcctgcagcccatgaagggggaccctgtgatctacagcctgcaggtgatgctgggcaaggacagcgagttcaagcagatctacaagggccctgacagcagcttccgctacagcagcctgcagctgaactgtgagtaccgcttccgggtgtgtgccatccggcagtgccaggacagcctgggccaccaggacctggtgggcccctacagcaccaccgtgctcttcatcagccagaggacagagcccccagccagcaccaacagagacacagtggagagcaccaggacccggcgggccctgagtgatgagcagtgtgccgctgtgatcctggtgctgtttgccttcttcagcatcctgattgccttcatcatccagtactttgtgatcaagtag

SEQ ID NO: 34348 - DNA, 3429 bp, Artificial Sequence
  Description of Artificial Sequence: Synthetic coding sequence
atgagcggccctgcccaggtgcccatgatgagccccaatggatctgtgccccccatctacgtgcccccaggctacgccccccaggtgattgaagataatggagtgcggcgggtggtggtggtgccccaggcccctgagttccaccctggcagccacacagtgctgcacaggagcccccacccccccctgcccggcttcatccctgtgcccaccatgatgcctcctccacccaggcacatgtacagccctgtgactggagctggggacatgaccacccagtacatgccccagtaccagagcagccaggtgtatggagatgtggatgcccacagcacccacggccgcagcaacttcagagatgagaggagcagcaagacctatgagcggctgcagaagaagctgaaggaccggcagggcacccagaaggacaagatgagcagcccccccagcagcccccagaagtgccccagccccatcaatgagcacaacggcctcatcaagggccagattgctgggggcatcaacacaggcagcgccaagatcaagtctggaaaaggaaaaggaggcacccaggtggacacagaaattgaggagaaggatgaggagaccaaggcctttgaggccctgctgagcaacatcgtgaagcctgtggccagtgacatccaggccaggacagtggtgctgacctggagcccccccagcagcctcatcaacggggagacagatgagagctctgtgcctgagctgtatggctatgaggtgctgatcagcagcacaggcaaggatggcaagtacaagtctgtgtatgtgggggaggagaccaacatcaccctgaatgacctgaagccagccatggactaccacgccaaggtgcaggccgagtacaacagcatcaagggcaccccatctgaggccgagatcttcaccaccctgagctgtgagccagacatccccaaccccccaagaattgccaacagaaccaagaacagcctgaccctgcagtggaaggcccccagcgacaatggcagcaagatccagaactttgtgctggagtgggatgagggcaaaggaaatggagagttctgccagtgctacatgggcagccagaagcagttcaagatcaccaagctgagccctgccatgggctgcaagttccggctgagcgccagaaatgactatggcaccagcggcttcagcgaggaggtgctgtactacaccagcggctgtgcccccagcatgcctgccagccctgtgctgaccaaggccggcatcacctggctgagcctgcagtggagcaagcccagcggcacccccagtgatgagggcatctcctacatcctggagatggaggaggagaccagcggctacggcttcaagcccaagtatgatggagaggacctggcctacacagtgaagaacctgcggcgcagcaccaagtacaagttcaaggtgattgcctacaacagcgagggcaagagcaaccccagcgaggtggtggagttcaccacctgcccagacaagccaggcatccctgtgaagcccagcgtgaagggcaagatccacagccacagcttcaagatcacctgggacccccccaaggacaatggaggagccaccatcaacaagtatgtggtggagatggccgagggcagcaatggaaacaagtgggagatgatctacagcggggccacccgggagcacctgtgtgaccggctgaaccctggctgcttctaccgcctgcgggtgtactgcatcagtgatggcggccagagcgctgtgtctgagagcctgctggtgcagaccccagctgtgcccccaggcccctgcctgcccccccggctgcagggccggcccaaggccaaggagatccagctgcgctggggcccccccctggtggatggcggcagccccatcagctgctacagcgtggagatgagccccatcgagaaggatgagccccgggaggtgtaccagggcagcgaggtggagtgcaccgtgagcagcctgctgcccgggaagacctacagcttccggctgcgggccgccaacaagatgggcttcggccccttcagcgagaagtgtgacatcaccacagcccctggccccccagaccagtgcaagccaccccaggtgacctgccgcagcgccacctgtgcccaggtgaactgggaggtgcccctgagcaatggaacagatgtgacagagtaccgcctggagtggggcggcgtggagggctccatgcagatctgctactgcggccctggcctgtcctatgagatcaagggcctgagccctgccaccacctactactgccgggtgcaggccctgtctgtggtgggcgccggccccttcagcgaggtggtggcctgtgtgaccccaccttctgtgcccggcatcgtgacctgcctgcaggagatcagtgatgatgaaattgagaacccccactacagccccagcacctgcctggccatctcctgggagaagccctgtgaccacggcagcgagatcctggcctacagcattgactttggagacaagcagagcctgactgtgggcaaggtgaccagctacatcatcaacaacctgcagcctgacaccacctaccgcatccgcatccaggccctgaacagcctgggcgccggccccttcagccacatgatcaagctgaagaccaagcccctgcccccagaccccccccggctggagtgtgtggccttcagccaccagaacctgaagctgaagtggggcgagggcacccccaagaccctgagcacagacagcatccagtaccacctgcagatggaggacaagaatggccgctttgtgtccctgtaccggggcccctgccacacctacaaggtgcagaggctgaatgaaagcaccagctacaagttctgcatccaggcctgcaatgaagctggggagggccccctgagccaggagtacatcttcaccacccccaagtctgtgcctgctgccctgaaggcccccaagattgagaaggtgaatgaccacatctgtgagatcacctgggagtgcctgcagcccatgaagggggaccctgtgatctacagcctgcaggtgatgctgggcaaggacagcgagttcaagcagatctacaagggccctgacagcagcttccgctacagcagcctgcagctgaactgtgagtaccgcttccgggtgtgtgccatccggcagtgccaggacagcctgggccaccaggacctggtgggcccctacagcaccaccgtgctcttcatcagccagaggacagagcccccagccagcaccaacagagacacagtggagagcaccaggacccggcgggccctgagtgatgagcagtgtgccgctgtgatcctggtgctgtttgccttcttcagcatcctgattgccttcatcatccagtactttgtgatcaagtag

SEQ ID NO: 34349 - DNA, 3597 bp, Artificial Sequence
  Description of Artificial Sequence: Synthetic coding sequence
atggccgagcacccccccctgctggacaccacccagatcctgagcagtgacatcagcctgctgagcgcccccatcgtgtctgcagatggcacccagcaggtgatcctggtgcaggtgaaccctggagaggccttcaccatccggcgggaggatggccagttccagtgcatcaccggccctgcccaggtgcccatgatgagccccaatggatctgtgccccccatctacgtgcccccaggctacgccccccaggtgattgaagataatggagtgcggcgggtggtggtggtgccccaggcccctgagttccaccctggcagccacacagtgctgcacaggagcccccacccccccctgcccggcttcatccctgtgcccaccatgatgcctcctccacccaggcacatgtacagccctgtgactggagctggggacatgaccacccagtacatgccccagtaccagagcagccaggtgtatggagatgtggatgcccacagcacccacggccgcagcaacttcagagatgagaggagcagcaagacctatgagcggctgcagaagaagctgaaggaccggcagggcacccagaaggacaagatgagcagcccccccagcagcccccagaagtgccccagccccatcaatgagcacaacggcctcatcaagggccagattgctgggggcatcaacacaggcagcgccaagatcaagtctggaaaaggaaaaggaggcacccaggtggacacagaaattgaggagaaggatgaggagaccaaggcctttgaggccctgctgagcaacatcgtgaagcctgtggccagtgacatccaggccaggacagtggtgctgacctggagcccccccagcagcctcatcaacggggagacagatgagagctctgtgcctgagctgtatggctatgaggtgctgatcagcagcacaggcaaggatggcaagtacaagtctgtgtatgtgggggaggagaccaacatcaccctgaatgacctgaagccagccatggactaccacgccaaggtgcaggccgagtacaacagcatcaagggcaccccatctgaggccgagatcttcaccaccctgagctgtgagccagacatccccaaccccccaagaattgccaacagaaccaagaacagcctgaccctgcagtggaaggcccccagcgacaatggcagcaagatccagaactttgtgctggagtgggatgagggcaaaggaaatggagagttctgccagtgctacatgggcagccagaagcagttcaagatcaccaagctgagccctgccatgggctgcaagttccggctgagcgccagaaatgactatggcaccagcggcttcagcgaggaggtgctgtactacaccagcggctgtgcccccagcatgcctgccagccctgtgctgaccaaggccggcatcacctggctgagcctgcagtggagcaagcccagcggcacccccagtgatgagggcatctcctacatcctggagatggaggaggagaccagcggctacggcttcaagcccaagtatgatggagaggacctggcctacacagtgaagaacctgcggcgcagcaccaagtacaagttcaaggtgattgcctacaacagcgagggcaagagcaaccccagcgaggtggtggagttcaccacctgcccagacaagccaggcatccctgtgaagcccagcgtgaagggcaagatccacagccacagcttcaagatcacctgggacccccccaaggacaatggaggagccaccatcaacaagtatgtggtggagatggccgagggcagcaatggaaacaagtgggagatgatctacagcggggccacccgggagcacctgtgtgaccggctgaaccctggctgcttctaccgcctgcgggtgtactgcatcagtgatggcggccagagcgctgtgtctgagagcctgctggtgcagaccccagctgtgcccccaggcccctgcctgcccccccggctgcagggccggcccaaggccaaggagatccagctgcgctggggcccccccctggtggatggcggcagccccatcagctgctacagcgtggagatgagccccatcgagaaggatgagccccgggaggtgtaccagggcagcgaggtggagtgcaccgtgagcagcctgctgcccgggaagacctacagcttccggctgcgggccgccaacaagatgggcttcggccccttcagcgagaagtgtgacatcaccacagcccctggccccccagaccagtgcaagccaccccaggtgacctgccgcagcgccacctgtgcccaggtgaactgggaggtgcccctgagcaatggaacagatgtgacagagtaccgcctggagtggggcggcgtggagggctccatgcagatctgctactgcggccctggcctgtcctatgagatcaagggcctgagccctgccaccacctactactgccgggtgcaggccctgtctgtggtgggcgccggccccttcagcgaggtggtggcctgtgtgaccccaccttctgtgcccggcatcgtgacctgcctgcaggagatcagtgatgatgaaattgagaacccccactacagccccagcacctgcctggccatctcctgggagaagccctgtgaccacggcagcgagatcctggcctacagcattgactttggagacaagcagagcctgactgtgggcaaggtgaccagctacatcatcaacaacctgcagcctgacaccacctaccgcatccgcatccaggccctgaacagcctgggcgccggccccttcagccacatgatcaagctgaagaccaagcccctgcccccagaccccccccggctggagtgtgtggccttcagccaccagaacctgaagctgaagtggggcgagggcacccccaagaccctgagcacagacagcatccagtaccacctgcagatggaggacaagaatggccgctttgtgtccctgtaccggggcccctgccacacctacaaggtgcagaggctgaatgaaagcaccagctacaagttctgcatccaggcctgcaatgaagctggggagggccccctgagccaggagtacatcttcaccacccccaagtctgtgcctgctgccctgaaggcccccaagattgagaaggtgaatgaccacatctgtgagatcacctgggagtgcctgcagcccatgaagggggaccctgtgatctacagcctgcaggtgatgctgggcaaggacagcgagttcaagcagatctacaagggccctgacagcagcttccgctacagcagcctgcagctgaactgtgagtaccgcttccgggtgtgtgccatccggcagtgccaggacagcctgggccaccaggacctggtgggcccctacagcaccaccgtgctcttcatcagccagaggacagagcccccagccagcaccaacagagacacagtggagagcaccaggacccggcgggccctgagtgatgagcagtgtgccgctgtgatcctggtgctgtttgccttcttcagcatcctgattgccttcatcatccagtactttgtgatcaagtag

SEQ ID NO: 34350 - DNA, 3597 bp, Artificial Sequence; identical to SEQ ID NO: 34349
  Description of Artificial Sequence: Synthetic coding sequence

SEQ ID NO: 34351 - DNA, 2055 bp, Artificial Sequence
  Description of Artificial Sequence: Synthetic coding sequence
atggccgagcacccccccctgctggacaccacccagatcctgagcagtgacatcagcctgctgagcgcccccatcgtgtctgcagatggcacccagcaggtgatcctggtgcaggtgaaccctggagaggccttcaccatccggcgggaggatggccagttccagtgcatcaccggccctgcccaggtgcccatgatgagccccaatggatctgtgccccccatctacgtgcccccaggctacgccccccaggtgattgaagataatggagtgcggcgggtggtggtggtgccccaggcccctgagttccaccctggcagccacacagtgctgcacaggagcccccacccccccctgcccggcttcatccctgtgcccaccatgatgcctcctccacccaggcacatgtacagccctgtgactggagctggggacatgaccacccagtacatgccccagtaccagagcagccaggtgtatggagatgtggatgcccacagcacccacggccgcagcaacttcagagatgagaggagcagcaagacctatgagcggctgcagaagaagctgaaggaccggcagggcacccagaaggacaagatgagcagcccccccagcagcccccagaagtgccccagccccatcaatgagcacaacggcctcatcaagggccagattgctgggggcatcaacacaggcagcgccaagatcaagtctggaaaaggaaaaggaggcacccaggtggacacagaaattgaggagaaggatgaggagaccaaggcctttgaggccctgctgagcaacatcgtgaagcctgtggccagtgacatccaggccaggacagtggtgctgacctggagcccccccagcagcctcatcaacggggagacagatgagagctctgtgcctgagctgtatggctatgaggtgctgatcagcagcacaggcaaggatggcaagtacaagtctgtgtatgtgggggaggagaccaacatcaccctgaatgacctgaagccagccatggactaccacgccaaggtgcaggccgagtacaacagcatcaagggcaccccatctgaggccgagatcttcaccaccctgagctgtgagccagacatccccaaccccccaagaattgccaacagaaccaagaacagcctgaccctgcagtggaaggcccccagcgacaatggcagcaagatccagaactttgtgctggagtgggatgagggcaaaggaaatggagagttctgccagtgctacatgggcagccagaagcagttcaagatcaccaagctgagccctgccatgggctgcaagttccggctgagcgccagaaatgactatggcaccagcggcttcagcgaggaggtgctgtactacaccagcggctgtgcccccagcatgcctgccagccctgtgctgaccaaggccggcatcacctggctgagcctgcagtggagcaagcccagcggcacccccagtgatgagggcatctcctacatcctggagatggaggaggagaccagcggctacggcttcaagcccaagtatgatggagaggacctggcctacacagtgaagaacctgcggcgcagcaccaagtacaagttcaaggtgattgcctacaacagcgagggcaagagcaaccccagcgaggtggtggagttcaccacctgcccagacaagccaggcatccctgtgaagcccagcgtgaagggcaagatccacagccacagcttcaagatcacctgggacccccccaaggacaatggaggagccaccatcaacaagtatgtggtggagatggccgagggcagcaatggaaacaagtgggagatgatctacagcggggccacccgggagcacctgtgtgaccggctgaaccctggctgcttctaccgcctgcgggtgtactgcatcagtgatggcggccagagcgctgtgtctgagagcctgctggtgcagaccccagctgtgcccccaggcccctgcctgcccccccggctgcagggccggcccaaggccaaggagatccagaccccatctggatag

SEQ ID NO: 34352 - DNA, 675 bp, Artificial Sequence
  Description of Artificial Sequence: Synthetic coding sequence
atgaacatcgaggtgggcaacatctcctacacaggagccatcatctcctggagcagcagcgagccctgcctggaggactactaccacatcatgtaccggcccaactggaacagcatcttcagcggctacctgcgctacagcttccaccacgaggagaaggtgcccaggaccatcagctctgtggtgctggagcacctggcccccagcaccctgtacttcctgtgcatcagctgcaagaaggccgccttcccctaccgccactactgcaccatgttccacaccctggacaagagccccctggcccctggcagcagcctggtggacccccagatcagcctgtgggtgctgatggccatcctgctggcctgcttcaccgctgtgctggccttcatctgcctgcagttctggtgtgtgcgctgccacgagccccgctggagctacagagctggccacatggaggaggccaacggcctggtgcgctggccagaggaggccccagacctgggccagcgggaggaggacctgcagggcctgcccctggtggagatgcccaggaagaacagcagagatggagctgagctggaccctgaggccaaccaggatgccccagatgctggggccctgcagagaggaggaggagaccccccagccatcctgccccactgtggggagtag

SEQ ID NO: 34353 - DNA, 543 bp, Artificial Sequence
  Description of Artificial Sequence: Synthetic coding sequence
atgaacatcgaggtgggcaacatctcctacacaggagccatcatctcctggagcagcagcgagccctgcctggaggactactaccacatcatgtaccggcccaactggaacagcatcttcagcggctacctgcgctacagcttccaccacgaggagaaggtgcccaggaccatcagctctgtggtgctggagcacctggcccccagcaccctgtacttcctgtgcatcagctgcaagaaggccgccttcccctaccgccactactgcaccatgttccacaccctggacaagagccccctggcccctggcagcagcctggtggacccccagatcagcctgtgggtgctgatggccatcctgctggcctgcttcaccgctgtgctggccttcatctgcctgcagttctggtgtgtgcgctgccacgagccccgctggagctacagagctggccacatggaggaggccaacggcctggtgcgctggccagaggaggccccagacctgggccagcgggaggaggacctgcagggcctgcccctgtag

SEQ ID NO: 34354 - DNA, 10401 bp, Artificial Sequence
  Description of Artificial Sequence: Synthetic coding sequence
atggagctgtacctgggcgcctgcagcaagccagccaaggtggccgtgaccaagacagtggcctctgtgctggccgctgacacccagcagtgcagagatggagtgcacaagacccactttgctggggtgggccctgcccagctgctggacctgcccctgggcgtgaagctgcccgtcatccctggcagcaatgctgtgttctacaccaccaactttggagagaagctgttccggcccagctatggcttcaacctgacagacccctactgccgcctgctggagaaccagtacaagagcctgcatgacccccacctgaaggcctactacaagaggaaggacatcctgaagaggctgaagaagggcggctacatcaccagcaacaacaaggtggtgtgcaccctgcgggagctgaacaagtaccggcagtacctgaccagcctgaagctggactttgaaagaaactacatcaaggagcagaggatcctggccaagcagctgcacaacatccctgagaacaaccagatcccccagcactgtgatgtggcccaggtgcagaactggctgctgaaggagggcacagagagcatcaaggaccaggagcggctgatgaggcaccgctacctggacatgatcagcaggaagctggagcagctggagaggacagctgaggagcagaggctcttcctgatggaccgggaggagcggcggcagcgggagcacaccaggaggaagctgaccctgcggaggaagattgaggaggagtggaagaccaaggagatgctgctgctgaccaggatggccgaggatgtgaagcgggaggagcgcatcgaggagcagcagcacaggaaccgggaggagagtgacaggaagaagcaggacctgctggagaagaagatggcctaccacctgcagaagatgcaggacaccggcttcaacggggaggacatcggcaagaacaccttcaagtaccggggccaggacggcacccacgccagccccaagaacaagaagaagaccagcgaggacatcatgctggtgtacccagctggggaccagaacacctacaaggagacccacggccacacagccaatgctgcccaccagaggcagaacagcagcaacaacttcaccaagaagaacagcgcctctgtggtgtaccaggctgatgtgcaggacaatggcatcaaccagaagagagatggcatggtgtccaagaacagcagcatctttgatgaccggggcggcatcaacatcagcggccagggcagcatcatcagcgcccaggtgagccccaccaggaacttcagccgggtgtcccaggccttcctggaccccagcaaggaggagaaggagaccaatgctgactgggatggccggcccaccaagaggagcagctacctgtgtgagagcggcccccaggcccacgccacagatcctggcatcttcagcagccctgtgtacaccaacatgcagcagaacctgctgcagaactgcctgcaggagaaggtgaccagcgaggagctgaacatcatcatccagaatgtgatgacctgggtggtggccaccgtgaccagcatcctgtacccagccatcaccaagtatgagaagaggctgcagaacaacacctaccctgtgtctgatgacagcatcctgagcagtgacagcagcagcttctgcagcacctgcagcgaggacttcacctaccgcagctacaccagcgccaccaccaagaccttccaggccgagccctgtgcctttgtggtggacacctctgtgagaagacccaccacccccatcaagcccccaccagcccacgtggagaagacagtggtgggcaagacctgccacatcaagggccagagcatcatcagcaagcacaagtacaacaagaccaacctgctgtacagctaccccaagctgcggagctgcaagagtgacagccacctgctggccagctttgaaacaggcaccaagaagagcaaggatgccaccacagaaacagacagcctgggcagcagcctgcactgtgacaagacagccaaggccatggatgagatgaagaacctgaagaatgtgtttgtgaacttcaagtgctacctgaagggggagacagaggtgatcctggagagcatcctgcgggagatcatgtctgacctgacccaggccatccccagcctgagctctgtgacagctgaggtgtttgtggagcagtgtgagcgggagaaggagatcctgctgagcaatgcccacatccccagcgtggccagcgagatcgtggagaacatgctggagaagctggagagcgctgtggagaagaagtgtgtggagatgttcagccaggacctgtctgtggacatcaagcccagcctggccgccagtgatgagctgctgaccagcagcaatggcaagcccctgaagaacagcatgccccacaccctggaccccatgtgtgacattgctgaggacatggtgcacgccatcctggagaagctgatgaccctggtgtccttcaagcagaatgagttcctgcacctgaaggacaccaacaagctgagctgccagcagcacaagacagaccccatctgcatgttcctgcagagagctgggaagaacaagagcagcctggagagtgatgaggccagcctgattgtgaatgaggaggtgcagaacctgatcagcaacatcttcagccagagcagcctggtggcctacatcgaggaggccatcaatgccatcctgggctacatccagacagagctgaacaatgaaagaatcatcgccagcgaggagaccgtggtgctgctgcagctgctggaggacatcctcttccagctgcaccaggagcctgtgaatgaaagcttccagaagagccggcagccccgcatcagcagccccagcgacaccaaggagaagtaccgcctgaccggcacccggctgagcaacagccccaggagcggccggcccttcccccccatcaacgtgcccggcatggtgctgtacagtgatgatgaaaatgaggagattgacaacatcgtgaagaatgtgctggacagcaccttcaaggatgagaaggtgaagagccaggagcagatccccaaccactggttcaccaagggcaacacctgctttgagtgcaagaggaacatcaagccacccaccaagccaggcagccgcagcaaggccgccttccatgactgggagctgaagacagagccccccagcaccaaccacgaggacatcctgaagaagaagctgagcagcaacaaggacatcagcaccttcagccaggaccagaagcaccagatcgagaaggcctctgaaaatattgtgaccagcatcctgaaggagatgctgaaggacatcagctctgtgcccttcggccacctggacagcaagacaggcagcgaggcctctgtgctggtgtctgagaagccccagggcctgagccaccaggagtggattgaccagatgttttctgtgtctgagatcagcacagtggcccaggagatcacagattctgtgctgaacatcctgcacaaggccagcaactacatcagcaacaccaccaagagcagcatcagcagctctgtgcaccagatcagcctgcacaacagcgacacagagcacatcgtgaaggaggcccccaacaagtaccccctgaagacctggtttgacagcgagaagaagatgaagtacctgagcctgtttgatgtggaccctgagaagccaccctggctgaagagcggcaagtctgagcccaagcctgtggatgacatcaatgacaagatcatccgcaccatcttcaagaggctgaagagcttcatctgccccaagctgcacatgggcttcaagagcagcctgcggagccagctgagcaagtacacagccaagatcgtgaacatcgtgctgtgtgccatccagaatgagctggagctgcacaaggagaacctgaacctgcgggagattgaccacaccaagagcctgacagacaagggcttctttgccaacacagacaagaagctggagagcctggtgaccagcattgatgatgacatcctggccagccccctgctgacctgcatctatgacatgctgctgagcagtgaaaatgcccaccagaggagcatcagcctgagcagcaggaagcccaagagcgccacagattctgtggatgtgcagagcatcctgcccaaccggcaggacaagaagagcttccacaagtacctggccaccccctgcacccaccacagcgtgaatggaggcaaccacatcaaggaaaatgccaagctgcaggtgctggagcgcatcggggagaccctgcacgagatgctgagcaagctgctgggcacccacctgcacagccagctgagctgcagccagcagagccgggagatgaccaacaagaaccagaagatggccgccgccctgcagagcaacatccagctgatcagcaaggccatcctggactacatcctggccaagctgtgtggggtggacatggacaccagctttgccagctgtggcctgaaggccatcagcgagagcctggacatcgacaaccccagctttgccagcatcatcgagaagatggccaagagcaccaagatcatcagcagcatcgtgtccagaagagtgcaggaggacaacaaggaggagaccaagagcaaggccaagcctgtggcccctgtgagcagcaagacccccagcaccaaggagatgcaccccaacaagctgaaggctgtggccagtgacatcctgaacatggtgtttgccaagctggagggctttgccaacggccacctggagatcctgggcgccatcaatgatggcaacaagaagagcaacaagattggctgggagtatgagagcaccaacatcagccgggacacccatgaggccagcttcctgagcgccctgtacatgcacgccaagaaggtgagcagcgccatcctgaaggtgatccagacagagctgaatgtgaccagcagtgacctgaagacctctgtggagaaccccccacctgagacccagatcctgaagtatgtggtgaagctgatcctggatgctgtgtccagtgacatgtttaatgagatggagagcgagggcggcggcatcgagacctaccgctaccggcccacctacggcagcctgcccggcggcgctgagagtgacagcttcctggaggatgatgcctacacagccaagaagatcattgatgagaggagcccccagcgggaggaggtgaagaccaggagcctgaagcagtgggccctggagaagaccctgaacaagattgaggtgaagctgaaggagccccacatcagccccatcgcccccatcatccggaacatcctgaatgagatcttccagagcaccctcatcaaccagctgaatgtgctgagcctgagccacagcaacttcaacggcatgccccacaacgtggatgagcccaccccccagacctctgtgcagttcatggacaagatgatggaccccctgctgtctgaggccgacatcaccatcgtgacagacaacatcgtgaggacagtgttccacaagctgtacagcgctgccatgacagaaagaaatgtgcgggagaaccgctacaagaccatcaccttcagcgccaacgtgagcagccatgagcacacctacaagggcaagagctctgtgacagccctggatgagaacccctgcaccttccagagccgcttctctgtggccgacaaggagaccaaggtgaacctggccgaggacatcgtgcaggccatcctgaccaacctggagacctttgccaccagcaaggtgaagagcctcttctacagccaggtgaacttcaccgtgcctgtggccctgcccatccagcaggaccacagcaccctgagcaaggccctgagcgccaaggacagctacagtgatgagcagttcagctgctgcagcgtggaccacaccaagagcggcaagaccaacctgtgccagctgagcctgagcaagctgaacacctacgccctgcaggtggcccggaggaacctgcagggcatcaagcaggagctggacaaggagcgggagaaccccttcctgacccatgacatcggcatcagcgagagcatcgccagccagatcgtgaatgccctgctggacatcatcagcaggaagggcaaatgtgacaagaacagcagtgacaaggagattgacctggaccagcagaagggcgtgattgagaagctgctgaatgagaccaagtacaggaaggtgctgcagctgcagatccaggacaccatcgagggcatcctgtgtgacatctatgagaagaccctcttccagaacaacctgagctttgccacccccaccctgaagtgcagcattgctgacaagcacagtgaagaaaattctgagatgttcatggagggcgccaacaagatcatccccaagctgtctgtgcccaagagtgatgtgatcctgatcagcaatgacatcgtgaacatcgtgctgcacaacctgagcagcgctgccaccctggtgatcaatgccaagaaccccaccagcgcccggctgcccctgaccttctgtgacaccttccccaagattgactgccagcagcccctgaagggcagcaagacagagaggaagacagagcgcttctcctacagcaggaaccagaagagcgcctatgcagatgacaaccagatcaccgtggtggagaaggaggacacccagaagagcgccacagacagctgtgaggagaatgccaacttcatcaccaagaccatcttcaagaggctggagagctttgccacagaaagaattgacagcctcatcaccctggccttccagagcaaggagaagagctttgtgattcctgagctggagaactgcaagcagaatgacagcatcttctatgacagcagccaggtggagagtgatgtgaatgtgctgaagatcagcgccacagagaccatcctgagccaggagctgacagacttcacctttgtgggcagaagagagaagctgggcagcaccatccacctgagccaggcccggctgaagacctatgcagatgtgattgccagcgccatcctgaagctgatcaagaatgacctggacctggagatccagaagatctacccctaccagaacaacatcctcttccaggagaacatcatcgtgtctgagatcgtggacagcatgctgaagatgctggatgacaagaggtctgtgaaggagatctgcttcaacagcaaagaaaacagcaacttcagccagctggccctgagcaatgagatcctgctgggccacaaggagaaggagaggagcaccaagcagagcctcttcaccaagtaccccctggagcagaaccagatgatcctggagaacaagaggcagatcatcgtgctggaggagatcttcatgagaaatggagagagcaagaacaaggagaagggggagctgctgattgctgtggaggagctgctgaacaagctgtaccagagggtgcgggaggtgacaggccacctgccccccctgaatgaaacagccaacttcatcagcaacagcaagatcaagaccagtgacaccacccagaagaacagcttccagagccacatcaacagcgtggccaatgacatcgtggagagcgtgctgggcaagatgtacctggtggtggtgaccagcctgtatgagaacaacaagagcaggacagaggtggagatcagtgaccacaatgacagcctgctgatgaagcccctgcgcttccgggagaccaagcaggccggcaagatcagcaacagccccaggtatgccatcagccaggcctacagctatgtggacagccagaacatctctgtgatggagaacaccctgctgccctacctgcccctgcaggtgaagaaggacctgatccagatggtgctgaacaagatcaccaactttgtgtccctgcccctgaaggtgagccccaaggacaaccccaagccctgcttcaaggcccacctgaagaccaggagcaagatcaccaccctgcccaagttcaccaagaagacccacctgggcctgtctgctgccaaggccaagagcaagaccaagctgggccctggagagaagaccctgaaggacagccgcagcaagacagccatcggcctgagccacatcatgtctgctggagatgccaagaacctgctggacaccaagctgcccaccagcgagctgaagatctatgccaaggacatcatcatcaacatcctggagaccatcgtgaaggagtttgggaaggtgaagcagaccaaggccctgcccagcgaccagatcatcgctgctgggaagatcgtgaacacagtgctgcaggagctgtatgtgaccaacaactgcaacctggcctaccccatgaagagcagccacctgcggctgagccagggcaacatcggcaccggcagcctgcccaagcagcaggcctgcttctacctggagaatgtgagcagccagctggagcacatcttcccccgggagggcatcttcaagaagctgtttgacaagtggcagacagagagcaatgacaaggaaaatgagaagtgcaagctgctgatgattgctgaaaatgtgctgacagagatcagcatcaaggccaaggagctggagtacagcctgagcctgctgaacctgccccccctggagaactgtgagagccgcttctacaaccacttcaagggggccagcaccagggctgaggacaccaaggcccagatcaacatgtttggccgggagatcgtggagatgctgctggagaagctgcagctgtgcttcctgagccagatccccaccccagattctgaggagaccctgagcaacagcaaggagcacatcacagccaagagcaaatatggcttccccaacaagcacagcctgagcagcctgcccatctacaacaccaagaccaaggaccagatctctgtgggcagcagcaaccagatcgtgcaggagatcgtggagaccgtgctgaacatgctggagagctttgtggacctgcagttcaagcacatcagcaaatatgagttcagcgagatcgtgaagatgcccatcgagaacctgagcagcatccagcagaagctgctgaacaagaagatgctgcccaagctgcagcccctgaagatgttcagtgacaagtctgagagcaacaccatcaacttcaaggagaacatccagaacatcctgctgcgggtgcacagcttccacagccagctgctgacctatgctgtgaacatcatcagtgacatgctggccgtcatcaagaacaagctggacaatgagatcagccagatggagcccagcagcatcagcatcctgaaggagaacatcgtggccagcgagatcatcggcaccctgatggaccagtgcacctacttcaatgaaagcctcatccagaacctgagccgggagagcctcttccagggcgcagaaaatgcctacacagtgaaccaggtggagctggccaccaacatgaagatgttcaccagcaagctgaaggagggcagcctgggcatcaaccccagccaggtgtccaagacaggctttgtgttctgcagtgatgaggacatgaaggagaagtacagagtgtccagtgacctgcccacctctgtgcgcagctctgtggaggacacagtgaagaacagcgagcccaccaagaggccagattctgagaccatgcccagctgcagcaccaggaacaaggtgcaggaccaccggccccgggagagcaactttggcagctttgaccagaccatgaagggcaacagctacctgcctgagggcagcttcctgcagaagctgctgaggaaggccagtgacagcacagaagctgccctgaagcaggtgctgtccttcatcgagatgggcaagggggagaacctgcgggtcttccactatgagaacctgaagcctgtggtggagcccaaccagatccagaccaccatcagccccctgaagatctgcctggccgcagaaaatattgtgaacacagtgctgagcagctgtggcttccccagccagccccacaccaatgaaaatcgggagatcatgaagcccttcttcatcagcaagcagagcagcctgtctgaggtgtctgggggccagaaggacaatgagaagagcctgctgaggatgcaggacaagaagatcaactacatccctgaggaggagaatgaaaacctggaggccagccgggaggacagcagcttcctgcagaagctgaagaagaaggagtaccccaagattgaaacagtgaaggaggtggaggccttcacctttgctgaccacgagatgggcagcaatgaggtgcacctgattgcccggcacgtgaccacctctgtggtgacctacctgaagaactttgagaccactggaaaatgttag

SEQ ID NO: 34355 - DNA, 20991 bp, Artificial Sequence
  Description of Artificial Sequence: Synthetic coding sequence
atgaagttccagctgtggagcagccagatccggcccctgggccccatcttccctgccctgcgggccctgtatgccctggcccgggccgccccccaggaggccacagccctgctgggccccctgcccctggaggcctggaatgctgggggcggcgctgaggtggtgggcctgtggcccttcctggtgcgcagcggccagagggacaatggagtgctggagaaggagagcggggccggggaggagggcgctgagggcgctgtgcctgccatggagctgtacctgggcgcctgcagcaagccagccaaggtggccgtgaccaagacagtggcctctgtgctggccgctgacacccagcagtgcagagatggagtgcacaagacccactttgctggggtgggccctgcccagctgctggacctgcccctgggcgtgaagctgcctgtgattcctggcagcaatgctgtgttctacaccaccaactttggagagaagctgttccggcccagctatggcttcaacctgacagacccctactgccgcctgctggagaaccagtacaagagcctgcatgacccccacctgaaggcctactacaagaggaaggacatcctgaagaggctgaagaagggcggctacatcaccagcaacaacaaggtggtgtgcaccctgcgggagctgaacaagtaccggcagtacctgaccagcctgaagctggactttgagaggaactacatcaaggagcagaggatcctggccaagcagctgcacaacatccctgagaacaaccagatcccccagcactgtgatgtggcccaggtgcagaactggctgctgaaggagggcacagagagcatcaaggaccaggagcggctgatgaggcaccgctacctggacatgatcagcaggaagctggagcagctggagaggacagctgaggagcagaggctcttcctgatggaccgggaggagcggcggcagcgggagcacaccaggaggaagctgaccctgcggaggaagattgaggaggagtggaagaccaaggagatgctgctgctgaccaggatggctgaagatgtgaagcgggaggagagaattgaggagcagcagcacaggaaccgggaggagagtgacaggaagaagcaggacctgctggagaagaagatggcctaccacctgcagaagatgcaggacaccggcttcaatggagaagatattggcaagaacaccttcaagtaccggggccaggacggcacccacgccagccccaagaacaagaagaagaccagcgaggacatcatgctggtgtacccagctggggaccagaacacctacaaggagacccacggccacacagccaatgctgcccaccagaggcagaacagcagcaacaacttcaccaagaagaacagcgcctctgtggtgtaccaggctgatgtgcaggacaatggcatcaaccagaagagagatggcatggtgtccaagaacagcagcatctttgatgacagaggaggcatcaacatcagcggccagggcagcatcatcagcgcccaggtgagccccaccaggaacttcagccgggtgtcccaggccttcctggaccccagcaaggaggagaaggagaccaatgctgactgggatggccggcccaccaagaggagcagctacctgtgtgagagcggcccccaggcccacgccacagaccccggcatcttcagcagccctgtgtacaccaacatgcagcagaacctgctgcagaactgcctgcaggagaaggtgaccagcgaggagctgaacatcatcatccagaatgtgatgacctgggtggtggccaccgtgaccagcatcctgtacccagccatcaccaagtatgagaagaggctgcagaacaacacctaccctgtgtctgatgacagcatcctgagcagtgacagcagcagcttctgcagcacctgcagcgaggacttcacctaccgcagctacaccagcgccaccaccaagaccttccaggccgagccctgtgcctttgtggtggacacctctgtgcggcggcccaccacccccatcaagcccccaccagcccacgtggagaagacagtggtgggcaagacctgccacatcaagggccagagcatcatcagcaagcacaagtacaacaagaccaacctgctgtacagctaccccaagctgcggagctgcaagagtgacagccacctgctggccagctttgagaccggcaccaagaagagcaaggatgccaccacagaaacagacagcctgggcagcagcctgcactgtgacaagacagccaaggccatggatgagatgaagaacctgaagaatgtgtttgtgaacttcaagtgctacctgaagggggagacagaggtgatcctggagagcatcctgcgggagatcatgtctgacctgacccaggccatccccagcctgagctctgtgacagctgaggtgtttgtggagcagtgtgagcgggagaaggagatcctgctgagcaatgcccacatccccagcgtggccagcgagatcgtggagaacatgctggagaagctggagagcgctgtggagaagaagtgtgtggagatgttcagccaggacctgtctgtggacatcaagcccagcctggccgccagtgatgagctgctgaccagcagcaatggcaagcccctgaagaacagcatgccccacaccctggaccccatgtgtgacattgctgaggacatggtgcacgccatcctggagaagctgatgaccctggtgtccttcaagcagaatgagttcctgcacctgaaggacaccaacaagctgagctgccagcagcacaagacagaccccatctgcatgttcctgcagagagctgggaagaacaagagcagcctggagagtgatgaggccagcctcatcgtgaatgaggaggtgcagaacctgatcagcaacatcttcagccagagcagcctggtggcctacatcgaggaggccatcaatgccatcctgggctacatccagacagagctgaacaatgaaagaatcatcgccagcgaggagaccgtggtgctgctgcagctgctggaggacatcctcttccagctgcaccaggagcctgtgaatgaaagcttccagaagagccggcagccccgcatcagcagccccagcgacaccaaggagaagtaccgcctgaccggcacccggctgagcaacagccccaggagcggccggcccttcccccccatcaacgtgcccggcatggtgctgtacagtgatgatgaaaatgaggagattgacaacatcgtgaagaatgtgctggacagcaccttcaaggatgagaaggtgaagagccaggagcagatccccaaccactggttcaccaagggcaacacctgctttgagtgcaagaggaacatcaagccacccaccaagccaggcagccgcagcaaggccgccttccatgactgggagctgaagacagagccccccagcaccaaccacgaggacatcctgaagaagaagctgagcagcaacaaggacatcagcaccttcagccaggaccagaagcaccagatcgagaaggccagcgagaacatcgtgaccagcatcctgaaggagatgctgaaggacatcagctctgtgcccttcggccacctggacagcaagacaggcagcgaggcctctgtgctggtgtctgagaagccccagggcctgagccaccaggagtggattgaccagatgttttctgtgtctgagatcagcacagtggcccaggagatcacagacagcgtgctgaacatcctgcacaaggccagcaactacatcagcaacaccaccaagagcagcatcagcagctctgtgcaccagatcagcctgcacaacagcgacacagagcacatcgtgaaggaggcccccaacaagtaccccctgaagacctggtttgattctgagaagaagatgaagtacctgagcctgtttgatgtggaccctgagaagccaccctggctgaagagcggcaagtctgagcccaagcctgtggatgacatcaatgacaagatcatccgcaccatcttcaagaggctgaagagcttcatctgccccaagctgcacatgggcttcaagagcagcctgcggagccagctgagcaagtacacagccaagatcgtgaacatcgtgctgtgtgccatccagaatgagctggagctgcacaaggagaacctgaacctgcgggagattgaccacaccaagagcctgacagacaagggcttctttgccaacacagacaagaagctggagagcctggtgaccagcattgatgatgacatcctggccagccccctgctgacctgcatctatgacatgctgctgagcagtgaaaatgcccaccagaggagcatcagcctgagcagcaggaagcccaagagcgccacagacagcgtggatgtgcagagcatcctgcccaaccggcaggacaagaagagcttccacaagtacctggccaccccctgcacccaccacagcgtgaatggaggcaaccacatcaaggaaaatgccaagctgcaggtgctggagagaattggagagaccctgcacgagatgctgagcaagctgctgggcacccacctgcacagccagctgagctgcagccagcagagccgggagatgaccaacaagaaccagaagatggctgctgccctgcagagcaacatccagctgatcagcaaggccatcctggactacatcctggccaagctgtgtggggtggacatggacaccagctttgccagctgtggcctgaaggccatcagcgagagcctggacatcgacaaccccagctttgccagcatcatcgagaagatggccaagagcaccaagatcatcagcagcatcgtgtcccggcgggtgcaggaggacaacaaggaggagaccaagagcaaggccaagcctgtggcccctgtgagcagcaagacccccagcaccaaggagatgcaccccaacaagctgaaggctgtggccagtgacatcctgaacatggtgtttgccaagctggagggctttgccaacggccacctggagatcctgggcgccatcaatgatggcaacaagaagagcaacaagattggctgggagtatgagagcaccaacatcagccgggacacccatgaggccagcttcctgagcgccctgtacatgcacgccaagaaggtgtcctctgccatcctgaaggtgatccagacagagctgaatgtgaccagcagtgacctgaagacctctgtggagaaccccccacctgagacccagatcctgaagtatgtggtgaagctgatcctggatgctgtgtccagtgacatgtttaatgagatggagagcgagggcggcggcatcgagacctaccgctaccggcccacctacggcagcctgcctggaggagctgagagtgacagcttcctggaggatgatgcctacacagccaagaagatcattgatgagaggagcccccagcgggaggaggtgaagaccaggagcctgaagcagtgggccctggagaagaccctgaacaagattgaggtgaagctgaaggagccccacatcagccccatcgcccccatcatccggaacatcctgaatgagatcttccagagcaccctcatcaaccagctgaatgtgctgagcctgagccacagcaacttcaacggcatgccccacaacgtggatgagcccaccccccagacctctgtgcagttcatggacaagatgatggaccccctgctgtctgaggccgacatcaccatcgtgacagacaacatcgtgaggacagtgttccacaagctgtacagcgctgccatgacagaaagaaatgtgagagaaaatcgctacaagaccatcaccttcagcgccaacgtgagcagccatgagcacacctacaagggcaagagctctgtgacagccctggatgagaacccctgcaccttccagagccgcttctctgtggccgacaaggagaccaaggtgaacctggctgaagatattgtgcaggccatcctgaccaacctggagacctttgccaccagcaaggtgaagagcctcttctacagccaggtgaacttcaccgtgcctgtggccctgcccatccagcaggaccacagcaccctgagcaaggccctgagcgccaaggacagctacagtgatgagcagttcagctgctgcagcgtggaccacaccaagagcggcaagaccaacctgtgccagctgagcctgagcaagctgaacacctacgccctgcaggtggcccggaggaacctgcagggcatcaagcaggagctggacaaggagcgggagaaccccttcctgacccatgacatcggcatcagcgagagcatcgccagccagatcgtgaatgccctgctggacatcatcagcaggaaaggaaaatgtgacaagaacagcagtgacaaggagattgacctggaccagcagaagggcgtcatcgagaagctgctgaatgagaccaagtacaggaaggtgctgcagctgcagatccaggacaccatcgagggcatcctgtgtgacatctatgagaagaccctcttccagaacaacctgagctttgccacccccaccctgaagtgcagcattgctgacaagcacagcgaggagaacagcgagatgttcatggagggcgccaacaagatcatccccaagctgtctgtgcccaagagtgatgtgatcctgatcagcaatgacatcgtgaacatcgtgctgcacaacctgagcagcgctgccaccctggtgatcaatgccaagaaccccaccagcgcccggctgcccctgaccttctgtgacaccttccccaagattgactgccagcagcccctgaagggcagcaagacagagaggaagacagagcgcttctcctacagcaggaaccagaagagcgcctatgcagatgacaaccagatcaccgtggtggagaaggaggacacccagaagagcgccacagacagctgtgaagaaaatgccaacttcatcaccaagaccatcttcaagaggctggagagctttgccacagaaagaattgacagcctcatcaccctggccttccagagcaaggagaagagctttgtgattcctgagctggagaactgcaagcagaatgacagcatcttctatgacagcagccaggtggagagtgatgtgaatgtgctgaagatcagcgccacagagaccatcctgagccaggagctgacagacttcacctttgtgggccggcgggagaagctgggcagcaccatccacctgagccaggcccggctgaagacctatgcagatgtgattgccagcgccatcctgaagctgatcaagaatgacctggacctggagatccagaagatctacccctaccagaacaacatcctcttccaggagaacatcatcgtgtctgaaattgtggacagcatgctgaagatgctggatgacaagaggtctgtgaaggagatctgcttcaacagcaaggagaacagcaacttcagccagctggccctgagcaatgagatcctgctgggccacaaggagaaggagaggagcaccaagcagagcctcttcaccaagtaccccctggagcagaaccagatgatcctggagaacaagaggcagatcatcgtgctggaggagatcttcatgagaaatggagagagcaagaacaaggagaagggggagctgctgattgctgtggaggagctgctgaacaagctgtaccagagggtgcgggaggtgacaggccacctgccccccctgaatgaaacagccaacttcatcagcaacagcaagatcaagaccagtgacaccacccagaagaacagcttccagagccacatcaacagcgtggccaatgacatcgtggagagcgtgctgggcaagatgtacctggtggtggtgaccagcctgtatgagaacaacaagagcaggacagaggtggagatcagtgaccacaatgacagcctgctgatgaagcccctgcgcttccgggagaccaagcaggccggcaagatcagcaacagccccaggtatgccatcagccaggcctacagctatgtggacagccagaacatctctgtgatggagaacaccctgctgccctacctgcccctgcaggtgaagaaggacctgatccagatggtgctgaacaagatcaccaactttgtgtccctgcccctgaaggtgagccccaaggacaaccccaagccctgcttcaaggcccacctgaagaccaggagcaagatcaccaccctgcccaagttcaccaagaagacccacctgggcctgtctgctgccaaggccaagagcaagaccaagctgggccctggagagaagaccctgaaggacagccgcagcaagacagccatcggcctgagccacatcatgtctgctggagatgccaagaacctgctggacaccaagctgcccaccagcgagctgaagatctatgccaaggacatcatcatcaacatcctggagaccatcgtgaaggagtttgggaaggtgaagcagaccaaggccctgcccagcgaccagatcatcgccgccggcaagatcgtgaacacagtgctgcaggagctgtatgtgaccaacaactgcaacctggcctaccccatgaagagcagccacctgcggctgagccagggcaacattggaacaggcagcctgcccaagcagcaggcctgcttctacctggagaatgtgagcagccagctggagcacatcttcccccgggagggcatcttcaagaagctgtttgacaagtggcagacagagagcaatgacaaggaaaatgagaagtgcaagctgctgatgattgctgaaaatgtgctgacagagatcagcatcaaggccaaggagctggagtacagcctgagcctgctgaacctgccccccctggagaactgtgagagccgcttctacaaccacttcaagggggccagcaccagggctgaggacaccaaggcccagatcaacatgtttggccgggagatcgtggagatgctgctggagaagctgcagctgtgcttcctgagccagatccccaccccagacagcgaggagaccctgagcaacagcaaggagcacatcacagccaagagcaaatatggcttccccaacaagcacagcctgagcagcctgcccatctacaacaccaagaccaaggaccagatctctgtgggcagcagcaaccagatcgtgcaggagatcgtggagaccgtgctgaacatgctggagagctttgtggacctgcagttcaagcacatcagcaaatatgagttcagcgagatcgtgaagatgcccatcgagaacctgagcagcatccagcagaagctgctgaacaagaagatgctgcccaagctgcagcccctgaagatgttcagtgacaagtctgagagcaacaccatcaacttcaaggagaacatccagaacatcctgctgcgggtgcacagcttccacagccagctgctgacctatgctgtgaacatcatcagtgacatgctggccgtcatcaagaacaagctggacaatgagatcagccagatggagcccagcagcatcagcatcctgaaggaaaatattgtggccagcgagatcatcggcaccctgatggaccagtgcacctacttcaatgaaagcctcatccagaacctgagccgggagagcctcttccagggcgcagaaaatgcctacacagtgaaccaggtggagctggccaccaacatgaagatgttcaccagcaagctgaaggagggcagcctgggcatcaaccccagccaggtgtccaagacaggctttgtgttctgcagtgatgaggacatgaaggagaagtacagagtgtccagtgacctgcccacctctgtgcgcagctctgtggaggacacagtgaagaacagcgagcccaccaagaggccagacagcgagaccatgcccagctgcagcaccaggaacaaggtgcaggaccaccggccccgggagagcaactttggcagctttgaccagaccatgaagggcaacagctacctgcctgagggcagcttcctgcagaagctgctgaggaaggccagtgacagcacagaggccgccctgaagcaggtgctgtccttcatcgagatgggcaaaggagagaacctgcgggtcttccactatgagaacctgaagcctgtggtggagcccaaccagatccagaccaccatcagccccctgaagatctgcctggccgctgagaacatcgtgaacacagtgctgagcagctgtggcttccccagccagccccacaccaatgaaaatcgggagatcatgaagcccttcttcatcagcaagcagagcagcctgtctgaggtgtctgggggccagaaggacaatgagaagagcctgctgaggatgcaggacaagaagatcaactacatccctgaggaggagaatgaaaacctggaggccagccgggaggacagcagcttcctgcagaagctgaagaagaaggagtaccccaagattgagaccgtgaaggaggtggaggccttcacctttgctgaccacgagatgggcagcaatgaggtgcacctgattgcccggcacgtgaccacctctgtggtgacctacctgaagaactttgagaccaccgtcttcagcgaggagaagatgtctgtgtccacctggagcaggaagaagtatgagagcaagcagttcctgaggaacatctatgatgacagcagcatctaccagtgctgtgagcacctgacagagagcgtgctgtaccacctgaccagcagcatcagtgatggcaccaagaagggccgggagaaggagaaggcctgggagatccaggaggccaccttcagcaagatcatcagcatccacagccaggtgtttgagagccgcagcatcagcatcggggagctggccctgtgcatcagcgagatcatcatcaagatcctcttcaacaacaagatcatccaggccgacatcgcccagaagatggtggccatccccaccaagtacacctactgccccggcatcgtgtctgggggctttgatgacctcttccaggacctgctggtgggcgtcatccacgtgctgagcaaggagattgaggtggactaccactttgagagcaatgtgaggaacaagagcttctccatgcacaggaacaacagcgtgcccctgtgcaacaagatcaaccggcaggccagcccccgggactggcagttcagcacccagcagatcggccagctgttccagaagaacaagctgagctacctggcctgcaagctgaacagcctggtgggcaacctgaagaccagcgagagcaaggaggtggtgaacaaggtgttcaacatcgtgtctgacctcttctccccagatgagtgcctggacaccggcatggacagcggcaagatccagaggacctacttctacagcagcaacaatgagcagcccaacagcatcctgaccaacaacctgcagctgagcagcaagagcgtcttcctgctgaatgtggtgtgtgagaagctgatccgcatcctgctggaggagtgcaccagcacagccttcccagacaagggctctgtgtctgaggagaccagcgctgaggagtgccagctgctgaagatgctgcagagcgtggaggatggcaagagtgactacagaaaaggaggcatggactgtgaatgtctgcaggtggactacatgtctgacctgctggagaatgtggccgagattgaccaggacctgctgaccagtgacagcatgctgaccatcatcagccacagcctggtgaagagcctgatggacaagctgagccacagcatccagcaggcccctgagagcctgccctttgccaacaagcacctgaactaccgcacccgggagatccagagcagcttcatcaaggccaggaagtctgagctgattgagctgggccagagcaagagcagcctggagctgcggagctatgacagcaacagcctgactgtgtccctgaacaaccccagcgtggtgagcagcaagatccaggcccccttcaacaagcactgtgctgtgaagagcagctctgtgagcccctttgagcggcagaggaccaaggagatggacaaggtggccatccacaacaagctgcaccaggagggcatctatgccggcgtgtacagcgccaccttcctggagggcatcatcagcgagctgttcttcaacctgtccatgagcctgtggggcaagaacaagaacatcaccgtgtcctggctgaatgagatgaacaccctgtttgtgaacaacgtggtgaatgagttcaacaatgcccaggtgacagtgctgagaaatgctgaggagcggctgtgcttcccccctgtgcacacagaaacagtgtccaagatcgtggacagcgtgtactatgatgtgctgcagcagtatgagctgaaggtggcctgtggcaacaaccctgtgtatgacaatgccagcattgctgagcagatcaccaacggcatcctgctggagatcctggactacaagctgcccagctgcttcaaggagcacctgatcccccacagctactaccccctgaagccagagatcatcctgcagaagctgcagagcaacctgacagagttcaccagcctgcccaggagcagcagtgactacagcaccatgctgagccacagcttcctggaggatgtgatccggcggctgctgagccagctgatccccccacccatcacctgcagcagcctgggcaagaagtacctgatgagcagtgacttcaatgagatgagcacctgcatcatcaacaaggtgatgtctgccatcagcaagcacaagatctggttcaccatctatgacaaccagtacctgtacacaggcaagaacctgcagaagatggtggacagcgtgtactgcaacatcctgcagatgtctgacagcctggtgtccatccagaagagcatcgtgagccgcagccccatcatgattgaccagatcgccagcttcatcatccaggagatcatcgagaaccacctgcagcccttcctgtctggagaggtgctgtgccaccccaggacccccctggaccctgtgtccaccatcgtgacccaggtgctgtctgaggtgattgagagccaccggccccagaagcagagccccctggacatccacctggacagctttgtgcgggagatcgtggcccggctgctgagcaagatcttcagccccaagcacaacacagaaattgagctgaagaacatgacccagagaattgtgaacagcatcaacagacacttcaacaaggccaagatccacatcctgtatgatgacaaggagcaggccttcttctccttcaacacagacatcgtggatgagctggccacctctgtgtacagaaatgccctgaagcagcacggcctggacctggccgtggacaaggagagtgaagattctggcatctttgtggagaacatcaccaacctgattgtggccgccatcagtgactacctgctgcaccccctcttcagcggggacttcagcgccagcacctacagcaacagcgtggccgagaacatcgtgcaggacatcctgagcaacatcagcaagagcacagagcccagccagagcgtgcccctgtacaacaccctgctgccctacaccttcctggaggacatgatccgggtgctgctgagcaagctgttcagcagcgccagcagcctggtgctgaacagagacacccagaaggacatcagccgggtgaacttcaatgacatcgccagcaacctggtgtctgacatccgcatgaaggtgtcccagcacgagatccgcttcagcaaggaggaggaggagaccaagttcatctacagtgaagatgacatccagcacctggtggacagcgtgtttgccaacgtggtgcagaccagcggcagccaggagagcgctgtgcagaacatcaccagcagcaatgacatcctgattgacagaattgctggcttcatcatcaagcacatctgccagaagcacctgcagccctttgtgtctgggaagagcctgagcagcagtgacacctactttgatgatgagcggcggcagctgttctacacctctgtgtacagcagcaccttcctggaggatgtgatctctggagtgctgaggaagatcttccaccgggtggtgggcatcgtgcagaccaagagcatccgggacagtgaagatgagctgtttgagaaggccgaggagctgatccacctgatcactggagagttcagcaaggcccaggtgtccatcatcgacaacacagaggagcggctgtgcctgccccctgtggagagagatgtggtgaagaccatcgtggacatggtgtacagcaaggtgctgcaggagtatgagatggaggtggtgcccaacaaggacttcctgaatgacaccaagaccctggccgcccgcatcaccaacatcatcctggccgagatctttgacttccagatccacccagacctgattgccaacctgcccttcaagagccacagcaagctgagcgccaacgtgctgatccagagggtgcagtatgacatcagcaagagccgcttccagaggcaggccagcaccatgtacaccaccatgctgagccacagccacctggagaagatcgtgacccagctgaccagccagatcagccccctgaacaccagcgctgagcagagcgacaccaccaagagtgacctgagcaacacagtcatcaagctgatcaatgagatcatgagcatcatcagcaagcatgagatctgcatcatcaagtatggcaacaagaagcagagcatgatcagcgccaaggacatccagagcatggtggacagcatctatgctgacctgagccacagcaacatctaccagagcatcaccaaggacaagaagagcatcagtgacatccctgtgtccaagatcgccagcttcatcatcaaggagatcttcaaccaccacatccagagcttcctgtctgaggacaagaccctgctgctggccgctgtggaccagacctacaagctgaaggccatcgaccccaagcagcgggagctgtccttcatcgtgaacagctctgtgttcctggaggaggtgatcagcgagctgctgtgcaagatcctgtatgccttcagccacaacatgctggtgacagaaaatccagacagagtgaagctgaagctgaccagaattgtgaccaccctggtgaacagcatcgtgctggagttcaccaccagcgagatcctggtggccgacaactttgacaagaacctgtgcttcagcgagcgctacaaggagatggtgcagaagatcgtgaacagcgtgtatggcaaggtgctggaccagtacaagagcctcatccagatccacagggtcatccagagcgacaccatctgcttcggcaggaagatctactacctgctgctggaggagatctatgactaccaggtgcagagcctggtgtctggagagctggagagcagcagctacagctacccccaggccgacaacatcatcagaaatgtgctgaacatcatcaccaaggacagccacgccctgcccccctacatcaccgtgctgccccacagcctgctggaggacatggtgtaccgcctgctgggccacgtgttccccagcacccacacagaaaatgagctgaaggagaagaagttccccccagatgatgaatttgtggaggccgccagcaagctgacagatgagatcatcaaggagatcagcgagcacgagatccggctgtccatggctgaagataatgctgagagcatgcagctggagcccatcgagaacctggtggacagcatctgcaacaacatcctgaagaccagcgagttccaggccgaggtgcagaaggatgctgacaagaagggctgcagcttcctgagcaagctggccggcttcatcatgaaggagatcatgtaccaccacctgcagcccttcctgcacggggaggagagcagcttcagtgacctgagtgactatgaccacgtgtctgagctggccaagagcggcaaggagaagacccagcccagcctgtacagcgccaccttcctggaggacatcatcatcgacctggtgcacaagttctgcagcctgctgatcatcacagaggacagcaagaagaatgagatggccgagctggacatcatgggcctggccctgaagctggccaacagcctcatccgggagttcaagaagagtgacatcaaggtgctgcccaatgctgagaagatgttctccttcccccccatcgacaaggagaccgtggacaagatcagcaactttgtgtatgagcagttcatcgagaagtgcaccagccatgacatccagaagggagatgagagcaacatcgccatcggcatgattgctgccctgacccagaaggccatcagcgccttccgcatccagcccctcttcagcggggactggagcagcaccttcttctccttcctgaacccagacaacatcacccagagggtgcagcacctgccccagaacaccttcacccagatcagccgctgtgccaaggagaaccagctgagcctgcctgaccagagctacaaggacaccagcagcaccccagactgcaagaacatgatgagcaccctggagatcaacagaggcaccatgaacaggaagaagagcttcaagaccaaggacacctctgtgaagaagggggacatccagaaccctgtgctgagcagcatcaatgccatcatgaagagcggcatgatcaacctgaccagcggcctggccactggagtgaccaacaagaaggaggtggatgagaacaaggtgggcatctgcacccagaagcacagtgaaaatgtgtccaaggtgaccagcaccaccaccgtgaagagcaaggacacccaggagcccaacctgtctgagaccttcaacaacaatgaaattgagaagaagaggaacctgatccccacagacaagaagggcaaggatgatgagatctacacccacttcagcctcatcattgatgacacagaatatgagaaggaggtgctgggcagtgacagcgagatcggctacaagaagaagattgacaatgcccgggagagcagcttcaagaaggatgacaagctgttccagctgagcagcctgaagagcaagaggaacctgggcaccaccacagacaccctggagatccgcatccgcaccagcagcaatgaaggccggcgggacagccccacccagacctgcagagatgaggagcaccacagcgactatgaacatgtgcagaatgtgattgagaacatctttgaagatgtgctggagctgagcagcagccctgagcccgcctactacagcaagctgtcctatgaccagagccccccaggggacaacgtgctgaatgtcatccaggagatcagccgggacagcgcccagagcgtgaccaccaagaaggtgagcagcagcaccaacaagaacatcagcgccaaggagaaggaggaggaggagcgggagaaggagaaggtgcgggaggagatcaagtctgagcccagcaagccagatgacccccagaaccagcgggagagcaagccaggcatcttccctgccaagttcctggaggatgtgatcacagagatggtgaagcagctgatcttcagcagcatccctgagacccagatccaggaccgctgccagaatgtgtctgacaagcagaaccaggccaagctgtatgacacagccatgaagctgatcaacagcctgctgaaggagttcagtgatgcccagatcaaggtgttccggccagacaagggcaaccagtttcctgggggcaaggtgtcctctgtgcccaaggtgcccccacgctacaaggagcccaccacagatgaggcccccagcagcatcaagatcaagtctgctgacaagatgccacccatgcacaagatgatgaggaagcccagcagtgacaagatccccagcattgacaagaccctggtgaacaaggtggtgcacagctctgtgtgcaacatcctgaatgactatggcagccaggacagcatctggaagaacatcaacagcaatggagagaacctggcccggcggctgaccagcgctgtgatcaatgagatcttccagaggcaggtgaacctgatcttctgtgatgaggtgtctgtgtctgcctgcctgcccctggagagcaaggatgtggtgaagaaggtgcagaagctggcccagacagccagcaaggagtgccagaccagcagcccctacaccatcatcctgccccacaagttcctggagaatgtcatcagcgccctcttcagcaagatcttcagcaccatcagcagcaccaagaccaaggagcctgaggacaacctgagcacagagctgaacttcctgcagatgaagctggtgtctgctgtggccacagagatcagccaggacaagtacatgaccatccagtatgtggagaccctgcagagtgatgatgatgagatcatccagctggtggtgcagagcgtgtacaacaacctgctgccccagtttggcagccaggagatcatccagaactgtgtgaccagcggctgcaagatcctgtctgagaacatcgtggacctggtgctgcgggaggtggccagcaaccagctgcagagctacttctgtggggagctgaccccccaccagtgtgtggaggtggagaacatcgtggagaagatcctgaaggatgtgttccagaccacagatgtgcccctgcccaagcccagccacgccgacaagctgagctacaacatcatcgaggagattgctgtgaagttcctgagcaagctgctgagcatcttccccaaggtgcacaaggagaggaccaagagcctggagacagacatgcagaagatcaccagcaaggtgctgaacagcgtgcaggagttcatcagcaagagcaagatcaagctggtgccccccaccaaggagagccccaccgtgcctgtggccgacaatgccaccattgaaaatattgtgaacagcatctacacctctgtgctgaagcacagcggcagctacaccagcgtcttcaaggacctgatgggcaagagcaatgtgctgagtgacaccatcggcttcctgatggtgaatgccatcagcaacagcgagttccagccccaggtggaggaggaggtgagcaacagcgagctggtgctggaggccgtgaagatcatggagaaggtgatcaagatcattgatgagctgaagagcaaggagaagagcagcagcaggaagggcctgaccctggatgccaagctgctggaggaggtgctggccctcttcctggccaagctgatccggctgcccagcagcagcagcaaggatgagaagaacctgagcaagacagagctgaacaagatcgccagccagctgagcaagctggtgacagctgagatcagccgcagcagcatcagcctcatcgccagtgaccctgaggagcactgcctgaaccctgagaacacagagcgcatctaccaggtggtggacagcgtgtacagcaacatcctgcagcagagcggcaccaacaaggagttctactatgacatcaaggacaccaacacagccttccccaagaaggtggccagcctcatcattgatggagtgtcctccttccccctggacaccatcaacagcaccatcagcaatgctgacctgtctggagagctggatgtgaacagaattgtgcagaaggcccaggagcacgccttcaacgtcatccctgagctggagcaggagaagctggaccagaacctgtctgaggaggagagccccatcaagatcgtgccccacgtgggcaagaagcctgtgaagattgaccccaagatcatcagcgagcacctggccgtcatcagcatcaagacccagcccctggagaagctgaagcaggagtgcctgaagaggacaggccacagcattgctgagctgcggcgggccagcatcagcggcaggaactacagcctgggcagcccagacctggagaagaggaagacagagaggaggaccagcctggacaagacaggccgcctggatgtgaagcccctggaggccgtggccaggaacagcttccagaacatcaggaagccagacatcaccaaggtggagctgctgaaggatgtgcagagcaagaatgacctgattgtgcggctggtggcccatgacatcgaccaggtgtacctggagaactacatcaaggaggagcgggacagtgatgaagatgaggtggtgctgacccagacctttgccaaggaggagggcatcaaggtgtttgaggaccaggtgaaggaggtgaagaagcccatccagagcaagctgagccccaagagcaccctgagcaccagcagcctgaagaagttcctgagcctgagcaagtgctgccagaccacagccagcgccaacatcgagagcacagaggccatcagcaaccaggtgattgagagcaaggagacccacgtgaagagagctgtggccgagctggacatggccacccccaagaccatgcctgagacagccagcagctcctgggaggagaagccccagtgcaagaaggaggagaagaacctggtgacagagcccacccactacttcatccaccgcatcatgagcagcagcagctacaaccaggaggacctgatcagcagcactggagaggccgaggactgccacagcgaccccagcgccaagatcctggaggagagcagccaggagcagaagccagagcacggcaacagcgtgaagttcatcaccatctttgagaggagcaaggatgtgctgggcagcgccaaccccagcaaggaggtgatcagcgagacccccaagccagatgtgtccaagcagggcagcaagatgctgaccaagatgagcagcaccctgagcaaggtgttcagccagtgcaacaccaacatcagccgcagcagcagccctgcccaccaggatgagcactag

SEQ ID NO: 34356 - DNA, 20724 bp, Artificial Sequence
  Description of Artificial Sequence: Synthetic coding sequence
atggagctgtacctgggcgcctgcagcaagccagccaaggtggccgtgaccaagacagtggcctctgtgctggccgctgacacccagcagtgcagagatggagtgcacaagacccactttgctggggtgggccctgcccagctgctggacctgcccctgggcgtgaagctgcccgtcatccctggcagcaatgctgtgttctacaccaccaactttggagagaagctgttccggcccagctatggcttcaacctgacagacccctactgccgcctgctggagaaccagtacaagagcctgcatgacccccacctgaaggcctactacaagaggaaggacatcctgaagaggctgaagaagggcggctacatcaccagcaacaacaaggtggtgtgcaccctgcgggagctgaacaagtaccggcagtacctgaccagcctgaagctggactttgaaagaaactacatcaaggagcagaggatcctggccaagcagctgcacaacatccctgagaacaaccagatcccccagcactgtgatgtggcccaggtgcagaactggctgctgaaggagggcacagagagcatcaaggaccaggagcggctgatgaggcaccgctacctggacatgatcagcaggaagctggagcagctggagaggacagctgaggagcagaggctcttcctgatggaccgggaggagcggcggcagcgggagcacaccaggaggaagctgaccctgcggaggaagattgaggaggagtggaagaccaaggagatgctgctgctgaccaggatggccgaggatgtgaagcgggaggagcgcatcgaggagcagcagcacaggaaccgggaggagagtgacaggaagaagcaggacctgctggagaagaagatggcctaccacctgcagaagatgcaggacaccggcttcaacggggaggacatcggcaagaacaccttcaagtaccggggccaggacggcacccacgccagccccaagaacaagaagaagaccagcgaggacatcatgctggtgtacccagctggggaccagaacacctacaaggagacccacggccacacagccaatgctgcccaccagaggcagaacagcagcaacaacttcaccaagaagaacagcgcctctgtggtgtaccaggctgatgtgcaggacaatggcatcaaccagaagagagatggcatggtgtccaagaacagcagcatctttgatgaccggggcggcatcaacatcagcggccagggcagcatcatcagcgcccaggtgagccccaccaggaacttcagccgggtgtcccaggccttcctggaccccagcaaggaggagaaggagaccaatgctgactgggatggccggcccaccaagaggagcagctacctgtgtgagagcggcccccaggcccacgccacagatcctggcatcttcagcagccctgtgtacaccaacatgcagcagaacctgctgcagaactgcctgcaggagaaggtgaccagcgaggagctgaacatcatcatccagaatgtgatgacctgggtggtggccaccgtgaccagcatcctgtacccagccatcaccaagtatgagaagaggctgcagaacaacacctaccctgtgtctgatgacagcatcctgagcagtgacagcagcagcttctgcagcacctgcagcgaggacttcacctaccgcagctacaccagcgccaccaccaagaccttccaggccgagccctgtgcctttgtggtggacacctctgtgagaagacccaccacccccatcaagcccccaccagcccacgtggagaagacagtggtgggcaagacctgccacatcaagggccagagcatcatcagcaagcacaagtacaacaagaccaacctgctgtacagctaccccaagctgcggagctgcaagagtgacagccacctgctggccagctttgaaacaggcaccaagaagagcaaggatgccaccacagaaacagacagcctgggcagcagcctgcactgtgacaagacagccaaggccatggatgagatgaagaacctgaagaatgtgtttgtgaacttcaagtgctacctgaagggggagacagaggtgatcctggagagcatcctgcgggagatcatgtctgacctgacccaggccatccccagcctgagctctgtgacagctgaggtgtttgtggagcagtgtgagcgggagaaggagatcctgctgagcaatgcccacatccccagcgtggccagcgagatcgtggagaacatgctggagaagctggagagcgctgtggagaagaagtgtgtggagatgttcagccaggacctgtctgtggacatcaagcccagcctggccgccagtgatgagctgctgaccagcagcaatggcaagcccctgaagaacagcatgccccacaccctggaccccatgtgtgacattgctgaggacatggtgcacgccatcctggagaagctgatgaccctggtgtccttcaagcagaatgagttcctgcacctgaaggacaccaacaagctgagctgccagcagcacaagacagaccccatctgcatgttcctgcagagagctgggaagaacaagagcagcctggagagtgatgaggccagcctgattgtgaatgaggaggtgcagaacctgatcagcaacatcttcagccagagcagcctggtggcctacatcgaggaggccatcaatgccatcctgggctacatccagacagagctgaacaatgaaagaatcatcgccagcgaggagaccgtggtgctgctgcagctgctggaggacatcctcttccagctgcaccaggagcctgtgaatgaaagcttccagaagagccggcagccccgcatcagcagccccagcgacaccaaggagaagtaccgcctgaccggcacccggctgagcaacagccccaggagcggccggcccttcccccccatcaacgtgcccggcatggtgctgtacagtgatgatgaaaatgaggagattgacaacatcgtgaagaatgtgctggacagcaccttcaaggatgagaaggtgaagagccaggagcagatccccaaccactggttcaccaagggcaacacctgctttgagtgcaagaggaacatcaagccacccaccaagccaggcagccgcagcaaggccgccttccatgactgggagctgaagacagagccccccagcaccaaccacgaggacatcctgaagaagaagctgagcagcaacaaggacatcagcaccttcagccaggaccagaagcaccagatcgagaaggcctctgaaaatattgtgaccagcatcctgaaggagatgctgaaggacatcagctctgtgcccttcggccacctggacagcaagacaggcagcgaggcctctgtgctggtgtctgagaagccccagggcctgagccaccaggagtggattgaccagatgttttctgtgtctgagatcagcacagtggcccaggagatcacagattctgtgctgaacatcctgcacaaggccagcaactacatcagcaacaccaccaagagcagcatcagcagctctgtgcaccagatcagcctgcacaacagcgacacagagcacatcgtgaaggaggcccccaacaagtaccccctgaagacctggtttgacagcgagaagaagatgaagtacctgagcctgtttgatgtggaccctgagaagccaccctggctgaagagcggcaagtctgagcccaagcctgtggatgacatcaatgacaagatcatccgcaccatcttcaagaggctgaagagcttcatctgccccaagctgcacatgggcttcaagagcagcctgcggagccagctgagcaagtacacagccaagatcgtgaacatcgtgctgtgtgccatccagaatgagctggagctgcacaaggagaacctgaacctgcgggagattgaccacaccaagagcctgacagacaagggcttctttgccaacacagacaagaagctggagagcctggtgaccagcattgatgatgacatcctggccagccccctgctgacctgcatctatgacatgctgctgagcagtgaaaatgcccaccagaggagcatcagcctgagcagcaggaagcccaagagcgccacagattctgtggatgtgcagagcatcctgcccaaccggcaggacaagaagagcttccacaagtacctggccaccccctgcacccaccacagcgtgaatggaggcaaccacatcaaggaaaatgccaagctgcaggtgctggagcgcatcggggagaccctgcacgagatgctgagcaagctgctgggcacccacctgcacagccagctgagctgcagccagcagagccgggagatgaccaacaagaaccagaagatggccgccgccctgcagagcaacatccagctgatcagcaaggccatcctggactacatcctggccaagctgtgtggggtggacatggacaccagctttgccagctgtggcctgaaggccatcagcgagagcctggacatcgacaaccccagctttgccagcatcatcgagaagatggccaagagcaccaagatcatcagcagcatcgtgtccagaagagtgcaggaggacaacaaggaggagaccaagagcaaggccaagcctgtggcccctgtgagcagcaagacccccagcaccaaggagatgcaccccaacaagctgaaggctgtggccagtgacatcctgaacatggtgtttgccaagctggagggctttgccaacggccacctggagatcctgggcgccatcaatgatggcaacaagaagagcaacaagattggctgggagtatgagagcaccaacatcagccgggacacccatgaggccagcttcctgagcgccctgtacatgcacgccaagaaggtgagcagcgccatcctgaaggtgatccagacagagctgaatgtgaccagcagtgacctgaagacctctgtggagaaccccccacctgagacccagatcctgaagtatgtggtgaagctgatcctggatgctgtgtccagtgacatgtttaatgagatggagagcgagggcggcggcatcgagacctaccgctaccggcccacctacggcagcctgcccggcggcgctgagagtgacagcttcctggaggatgatgcctacacagccaagaagatcattgatgagaggagcccccagcgggaggaggtgaagaccaggagcctgaagcagtgggccctggagaagaccctgaacaagattgaggtgaagctgaaggagccccacatcagccccatcgcccccatcatccggaacatcctgaatgagatcttccagagcaccctcatcaaccagctgaatgtgctgagcctgagccacagcaacttcaacggcatgccccacaacgtggatgagcccaccccccagacctctgtgcagttcatggacaagatgatggaccccctgctgtctgaggccgacatcaccatcgtgacagacaacatcgtgaggacagtgttccacaagctgtacagcgctgccatgacagaaagaaatgtgcgggagaaccgctacaagaccatcaccttcagcgccaacgtgagcagccatgagcacacctacaagggcaagagctctgtgacagccctggatgagaacccctgcaccttccagagccgcttctctgtggccgacaaggagaccaaggtgaacctggccgaggacatcgtgcaggccatcctgaccaacctggagacctttgccaccagcaaggtgaagagcctcttctacagccaggtgaacttcaccgtgcctgtggccctgcccatccagcaggaccacagcaccctgagcaaggccctgagcgccaaggacagctacagtgatgagcagttcagctgctgcagcgtggaccacaccaagagcggcaagaccaacctgtgccagctgagcctgagcaagctgaacacctacgccctgcaggtggcccggaggaacctgcagggcatcaagcaggagctggacaaggagcgggagaaccccttcctgacccatgacatcggcatcagcgagagcatcgccagccagatcgtgaatgccctgctggacatcatcagcaggaagggcaaatgtgacaagaacagcagtgacaaggagattgacctggaccagcagaagggcgtgattgagaagctgctgaatgagaccaagtacaggaaggtgctgcagctgcagatccaggacaccatcgagggcatcctgtgtgacatctatgagaagaccctcttccagaacaacctgagctttgccacccccaccctgaagtgcagcattgctgacaagcacagtgaagaaaattctgagatgttcatggagggcgccaacaagatcatccccaagctgtctgtgcccaagagtgatgtgatcctgatcagcaatgacatcgtgaacatcgtgctgcacaacctgagcagcgctgccaccctggtgatcaatgccaagaaccccaccagcgcccggctgcccctgaccttctgtgacaccttccccaagattgactgccagcagcccctgaagggcagcaagacagagaggaagacagagcgcttctcctacagcaggaaccagaagagcgcctatgcagatgacaaccagatcaccgtggtggagaaggaggacacccagaagagcgccacagacagctgtgaggagaatgccaacttcatcaccaagaccatcttcaagaggctggagagctttgccacagaaagaattgacagcctcatcaccctggccttccagagcaaggagaagagctttgtgattcctgagctggagaactgcaagcagaatgacagcatcttctatgacagcagccaggtggagagtgatgtgaatgtgctgaagatcagcgccacagagaccatcctgagccaggagctgacagacttcacctttgtgggcagaagagagaagctgggcagcaccatccacctgagccaggcccggctgaagacctatgcagatgtgattgccagcgccatcctgaagctgatcaagaatgacctggacctggagatccagaagatctacccctaccagaacaacatcctcttccaggagaacatcatcgtgtctgagatcgtggacagcatgctgaagatgctggatgacaagaggtctgtgaaggagatctgcttcaacagcaaagaaaacagcaacttcagccagctggccctgagcaatgagatcctgctgggccacaaggagaaggagaggagcaccaagcagagcctcttcaccaagtaccccctggagcagaaccagatgatcctggagaacaagaggcagatcatcgtgctggaggagatcttcatgagaaatggagagagcaagaacaaggagaagggggagctgctgattgctgtggaggagctgctgaacaagctgtaccagagggtgcgggaggtgacaggccacctgccccccctgaatgaaacagccaacttcatcagcaacagcaagatcaagaccagtgacaccacccagaagaacagcttccagagccacatcaacagcgtggccaatgacatcgtggagagcgtgctgggcaagatgtacctggtggtggtgaccagcctgtatgagaacaacaagagcaggacagaggtggagatcagtgaccacaatgacagcctgctgatgaagcccctgcgcttccgggagaccaagcaggccggcaagatcagcaacagccccaggtatgccatcagccaggcctacagctatgtggacagccagaacatctctgtgatggagaacaccctgctgccctacctgcccctgcaggtgaagaaggacctgatccagatggtgctgaacaagatcaccaactttgtgtccctgcccctgaaggtgagccccaaggacaaccccaagccctgcttcaaggcccacctgaagaccaggagcaagatcaccaccctgcccaagttcaccaagaagacccacctgggcctgtctgctgccaaggccaagagcaagaccaagctgggccctggagagaagaccctgaaggacagccgcagcaagacagccatcggcctgagccacatcatgtctgctggagatgccaagaacctgctggacaccaagctgcccaccagcgagctgaagatctatgccaaggacatcatcatcaacatcctggagaccatcgtgaaggagtttgggaaggtgaagcagaccaaggccctgcccagcgaccagatcatcgctgctgggaagatcgtgaacacagtgctgcaggagctgtatgtgaccaacaactgcaacctggcctaccccatgaagagcagccacctgcggctgagccagggcaacatcggcaccggcagcctgcccaagcagcaggcctgcttctacctggagaatgtgagcagccagctggagcacatcttcccccgggagggcatcttcaagaagctgtttgacaagtggcagacagagagcaatgacaaggaaaatgagaagtgcaagctgctgatgattgctgaaaatgtgctgacagagatcagcatcaaggccaaggagctggagtacagcctgagcctgctgaacctgccccccctggagaactgtgagagccgcttctacaaccacttcaagggggccagcaccagggctgaggacaccaaggcccagatcaacatgtttggccgggagatcgtggagatgctgctggagaagctgcagctgtgcttcctgagccagatccccaccccagattctgaggagaccctgagcaacagcaaggagcacatcacagccaagagcaaatatggcttccccaacaagcacagcctgagcagcctgcccatctacaacaccaagaccaaggaccagatctctgtgggcagcagcaaccagatcgtgcaggagatcgtggagaccgtgctgaacatgctggagagctttgtggacctgcagttcaagcacatcagcaaatatgagttcagcgagatcgtgaagatgcccatcgagaacctgagcagcatccagcagaagctgctgaacaagaagatgctgcccaagctgcagcccctgaagatgttcagtgacaagtctgagagcaacaccatcaacttcaaggagaacatccagaacatcctgctgcgggtgcacagcttccacagccagctgctgacctatgctgtgaacatcatcagtgacatgctggccgtcatcaagaacaagctggacaatgagatcagccagatggagcccagcagcatcagcatcctgaaggagaacatcgtggccagcgagatcatcggcaccctgatggaccagtgcacctacttcaatgaaagcctcatccagaacctgagccgggagagcctcttccagggcgcagaaaatgcctacacagtgaaccaggtggagctggccaccaacatgaagatgttcaccagcaagctgaaggagggcagcctgggcatcaaccccagccaggtgtccaagacaggctttgtgttctgcagtgatgaggacatgaaggagaagtacagagtgtccagtgacctgcccacctctgtgcgcagctctgtggaggacacagtgaagaacagcgagcccaccaagaggccagattctgagaccatgcccagctgcagcaccaggaacaaggtgcaggaccaccggccccgggagagcaactttggcagctttgaccagaccatgaagggcaacagctacctgcctgagggcagcttcctgcagaagctgctgaggaaggccagtgacagcacagaagctgccctgaagcaggtgctgtccttcatcgagatgggcaagggggagaacctgcgggtcttccactatgagaacctgaagcctgtggtggagcccaaccagatccagaccaccatcagccccctgaagatctgcctggccgcagaaaatattgtgaacacagtgctgagcagctgtggcttccccagccagccccacaccaatgaaaatcgggagatcatgaagcccttcttcatcagcaagcagagcagcctgtctgaggtgtctgggggccagaaggacaatgagaagagcctgctgaggatgcaggacaagaagatcaactacatccctgaggaggagaatgaaaacctggaggccagccgggaggacagcagcttcctgcagaagctgaagaagaaggagtaccccaagattgaaacagtgaaggaggtggaggccttcacctttgctgaccacgagatgggcagcaatgaggtgcacctgattgcccggcacgtgaccacctctgtggtgacctacctgaagaactttgagaccaccgtcttcagcgaggagaagatgtctgtgtccacctggagcaggaagaagtatgagagcaagcagttcctgaggaacatctatgatgacagcagcatctaccagtgctgtgagcacctgacagaatctgtgctgtaccacctgaccagcagcatcagtgatggcaccaagaagggccgggagaaggagaaggcctgggagatccaggaggccaccttcagcaagatcatcagcatccacagccaggtgtttgagagccgcagcatcagcattggagagctggccctgtgcatcagcgagatcatcatcaagatcctcttcaacaacaagatcatccaggccgacatcgcccagaagatggtggccatccccaccaagtacacctactgccccggcatcgtgtctgggggctttgatgacctcttccaggacctgctggtgggcgtcatccacgtgctgagcaaggagattgaggtggactaccactttgagagcaatgtgaggaacaagagcttctccatgcacaggaacaacagcgtgcccctgtgcaacaagatcaaccggcaggccagcccccgggactggcagttcagcacccagcagatcggccagctgttccagaagaacaagctgagctacctggcctgcaagctgaacagcctggtgggcaacctgaagaccagcgagagcaaggaggtggtgaacaaggtgttcaacatcgtgtctgacctcttctccccagatgaatgtctggacaccggcatggattctgggaagatccagaggacctacttctacagcagcaacaatgagcagcccaacagcatcctgaccaacaacctgcagctgagcagcaagtctgtgttcctgctgaatgtggtgtgtgagaagctgatccgcatcctgctggaggagtgcaccagcacagccttcccagacaagggctctgtgtctgaggagaccagcgctgaggagtgccagctgctgaagatgctgcagagcgtggaggatggcaagagtgactacaggaagggcggcatggactgtgagtgcctgcaggtggactacatgtctgacctgctggagaatgtggccgagattgaccaggacctgctgaccagtgacagcatgctgaccatcatcagccacagcctggtgaagagcctgatggacaagctgagccacagcatccagcaggcccctgagagcctgccctttgccaacaagcacctgaactaccgcacccgggagatccagagcagcttcatcaaggccaggaagtctgagctgattgagctgggccagagcaagagcagcctggagctgcggagctatgacagcaacagcctgactgtgtccctgaacaaccccagcgtggtgagcagcaagatccaggcccccttcaacaagcactgtgctgtgaagagcagctctgtgagcccctttgagcggcagaggaccaaggagatggacaaggtggccatccacaacaagctgcaccaggagggcatctatgctggggtgtacagcgccaccttcctggagggcatcatcagcgagctgttcttcaacctgtccatgagcctgtggggcaagaacaagaacatcaccgtgtcctggctgaatgagatgaacaccctgtttgtgaacaacgtggtgaatgagttcaacaatgcccaggtgacagtgctgagaaatgctgaggagcggctgtgcttcccccctgtgcacacagagaccgtgtccaagatcgtggacagcgtgtactatgatgtgctgcagcagtatgagctgaaggtggcctgtggcaacaaccctgtgtatgacaatgccagcattgctgagcagatcaccaacggcatcctgctggagatcctggactacaagctgcccagctgcttcaaggagcacctgatcccccacagctactaccccctgaagccagagatcatcctgcagaagctgcagagcaacctgacagagttcaccagcctgcccaggagcagcagtgactacagcaccatgctgagccacagcttcctggaggatgtgatccggcggctgctgagccagctgatccccccacccatcacctgcagcagcctgggcaagaagtacctgatgagcagtgacttcaatgagatgagcacctgcatcatcaacaaggtgatgtctgccatcagcaagcacaagatctggttcaccatctatgacaaccagtacctgtacaccgggaagaacctgcagaagatggtggacagcgtgtactgcaacatcctgcagatgtctgacagcctggtgtccatccagaagagcatcgtgagccgcagccccatcatgattgaccagatcgccagcttcatcatccaggagatcatcgagaaccacctgcagcccttcctgagcggggaggtgctgtgccaccccaggacccccctggaccctgtgtccaccatcgtgacccaggtgctgtctgaggtgattgagagccaccggccccagaagcagagccccctggacatccacctggacagctttgtgcgggagatcgtggcccggctgctgagcaagatcttcagccccaagcacaacacagaaattgagctgaagaacatgacccagagaattgtgaacagcatcaacagacacttcaacaaggccaagatccacatcctgtatgatgacaaggagcaggccttcttctccttcaacacagacatcgtggatgagctggccacctctgtgtacagaaatgccctgaagcagcacggcctggacctggccgtggacaaggagagcgaggacagcggcatctttgtggagaacatcaccaacctgattgtggccgccatcagtgactacctgctgcaccccctcttcagcggggacttcagcgccagcacctacagcaacagcgtggctgaaaatattgtgcaggacatcctgagcaacatcagcaagagcacagagcccagccagagcgtgcccctgtacaacaccctgctgccctacaccttcctggaggacatgatccgggtgctgctgagcaagctgttcagcagcgccagcagcctggtgctgaacagagacacccagaaggacatcagccgggtgaacttcaatgacatcgccagcaacctggtgtctgacatccgcatgaaggtgtcccagcacgagatccgcttcagcaaggaggaggaggagaccaagttcatctacagtgaagatgacatccagcacctggtggacagcgtgtttgccaacgtggtgcagaccagcggcagccaggagagcgctgtgcagaacatcaccagcagcaatgacatcctgattgacagaattgctggcttcatcatcaagcacatctgccagaagcacctgcagccctttgtgtctgggaagagcctgagcagcagtgacacctactttgatgatgaaagacggcagctgttctacacctctgtgtacagcagcaccttcctggaggatgtgatcagcggcgtgctgaggaagatcttccaccgggtggtgggcatcgtgcagaccaagagcatccgggacagtgaagatgagctgtttgagaaggccgaggagctgatccacctgatcaccggggagttcagcaaggcccaggtgtccatcatcgacaacacagaggagcggctgtgcctgccccctgtggagagagatgtggtgaagaccatcgtggacatggtgtacagcaaggtgctgcaggagtatgagatggaggtggtgcccaacaaggacttcctgaatgacaccaagaccctggccgcccgcatcaccaacatcatcctggccgagatctttgacttccagatccacccagacctgattgccaacctgcccttcaagagccacagcaagctgagcgccaacgtgctgatccagagggtgcagtatgacatcagcaagagccgcttccagaggcaggccagcaccatgtacaccaccatgctgagccacagccacctggagaagatcgtgacccagctgaccagccagatcagccccctgaacaccagcgctgagcagagcgacaccaccaagagtgacctgagcaacacagtcatcaagctgatcaatgagatcatgagcatcatcagcaagcatgagatctgcatcatcaagtatggcaacaagaagcagagcatgatcagcgccaaggacatccagagcatggtggacagcatctatgctgacctgagccacagcaacatctaccagagcatcaccaaggacaagaagagcatcagtgacatccctgtgtccaagatcgccagcttcatcatcaaggagatcttcaaccaccacatccagagcttcctgtctgaggacaagaccctgctgctggccgctgtggaccagacctacaagctgaaggccatcgaccccaagcagcgggagctgtccttcatcgtgaacagcagcgtcttcctggaggaggtgatcagcgagctgctgtgcaagatcctgtatgccttcagccacaacatgctggtgacagagaacccagacagagtgaagctgaagctgacccgcatcgtgaccaccctggtgaacagcatcgtgctggagttcaccaccagcgagatcctggtggccgacaactttgacaagaacctgtgcttcagcgagcgctacaaggagatggtgcagaagatcgtgaacagcgtgtatggcaaggtgctggaccagtacaagagcctcatccagatccacagggtcatccagagcgacaccatctgctttggaaggaagatctactacctgctgctggaggagatctatgactaccaggtgcagagcctggtgtctggagagctggagagcagcagctacagctacccccaggccgacaacatcatcagaaatgtgctgaacatcatcaccaaggacagccacgccctgcccccctacatcaccgtgctgccccacagcctgctggaggacatggtgtaccgcctgctgggccacgtgttccccagcacccacacagaaaatgagctgaaggagaagaagtttcctccagatgatgaatttgtggaggccgccagcaagctgacagatgagatcatcaaggagatcagcgagcacgagatccggctgtccatggccgaggacaatgctgagagcatgcagctggagcccatcgagaacctggtggacagcatctgcaacaacatcctgaagaccagcgagttccaggccgaggtgcagaaggatgctgacaagaagggctgcagcttcctgagcaagctggccggcttcatcatgaaggagatcatgtaccaccacctgcagcccttcctgcatggagaggagagcagcttcagtgacctgagtgactatgaccacgtgtctgagctggccaagagcggcaaggagaagacccagcccagcctgtacagcgccaccttcctggaggacatcatcatcgacctggtgcacaagttctgcagcctgctgatcatcacagaggacagcaagaagaatgagatggccgagctggacatcatgggcctggccctgaagctggccaacagcctcatccgggagttcaagaagagtgacatcaaggtgctgcccaatgctgagaagatgttctccttcccccccatcgacaaggagaccgtggacaagatcagcaactttgtgtatgagcagttcatcgagaagtgcaccagccatgacatccagaagggagatgagagcaacatcgccatcggcatgattgctgccctgacccagaaggccatcagcgccttccgcatccagcccctcttcagcggggactggagcagcaccttcttctccttcctgaacccagacaacatcacccagagggtgcagcacctgccccagaacaccttcacccagatcagccgctgtgccaaggagaaccagctgagcctgcctgaccagagctacaaggacaccagcagcaccccagactgcaagaacatgatgagcaccctggagatcaacagaggcaccatgaacaggaagaagagcttcaagaccaaggacacctctgtgaagaagggggacatccagaaccctgtgctgagcagcatcaatgccatcatgaagagcggcatgatcaacctgaccagcggcctggccaccggggtgaccaacaagaaggaggtggatgagaacaaggtgggcatctgcacccagaagcacagtgaaaatgtgtccaaggtgaccagcaccaccaccgtgaagagcaaggacacccaggagcccaacctgtctgagaccttcaacaacaatgaaattgagaagaagaggaacctgatccccacagacaagaagggcaaggatgatgagatctacacccacttcagcctcatcattgatgacacagaatatgagaaggaggtgctgggcagtgacagcgagatcggctacaagaagaagattgacaatgcccgggagagcagcttcaagaaggatgacaagctgttccagctgagcagcctgaagagcaagaggaacctgggcaccaccacagacaccctggagatccgcatccgcaccagcagcaatgaaggaagaagagacagccccacccagacctgcagagatgaggagcaccacagcgactatgagcacgtgcagaatgtgattgagaacatctttgaagatgtgctggagctgagcagcagccctgagcccgcctactacagcaagctgtcctatgaccagagccccccaggggacaacgtgctgaatgtcatccaggagatcagccgggacagcgcccagagcgtgaccaccaagaaggtgagcagcagcaccaacaagaacatcagcgccaaggagaaggaggaggaggagcgggagaaggagaaggtgcgggaggagatcaagtctgagcccagcaagccagatgacccccagaaccagcgggagagcaagccaggcatcttccctgccaagttcctggaggatgtgatcacagagatggtgaagcagctgatcttcagcagcatccctgagacccagatccaggaccgctgccagaatgtgtctgacaagcagaaccaggccaagctgtatgacacagccatgaagctgatcaacagcctgctgaaggagttcagtgatgcccagatcaaggtgttccggccagacaagggcaaccagtttcctgggggcaaggtgtcctctgtgcccaaggtgcccccacgctacaaggagcccaccacagatgaggcccccagcagcatcaagatcaagtctgctgacaagatgccacccatgcacaagatgatgaggaagcccagcagtgacaagatccccagcattgacaagaccctggtgaacaaggtggtgcacagctctgtgtgcaacatcctgaatgactatggcagccaggacagcatctggaagaacatcaacagcaatggagagaacctggcccggcggctgaccagcgctgtgatcaatgagatcttccagaggcaggtgaacctgatcttctgtgatgaggtgtctgtgtctgcctgcctgcccctggagagcaaggatgtggtgaagaaggtgcagaagctggcccagacagccagcaaagaatgccagaccagcagcccctacaccatcatcctgccccacaagttcctggagaatgtcatcagcgccctcttcagcaagatcttcagcaccatcagcagcaccaagaccaaggagcctgaggacaacctgagcacagagctgaacttcctgcagatgaagctggtgtctgctgtggccacagagatcagccaggacaagtacatgaccatccagtatgtggagaccctgcagagtgatgatgatgagatcatccagctggtggtgcagagcgtgtacaacaacctgctgccccagtttggcagccaggagatcatccagaactgtgtgaccagcggctgcaagatcctgtctgaaaatattgtggacctggtgctgcgggaggtggccagcaaccagctgcagagctacttctgtggggagctgaccccccaccagtgtgtggaggtggagaacatcgtggagaagatcctgaaggatgtgttccagaccacagatgtgcccctgcccaagcccagccatgctgacaagctgagctacaacatcatcgaggagattgctgtgaagttcctgagcaagctgctgagcatcttccccaaggtgcacaaggagaggaccaagagcctggagacagacatgcagaagatcaccagcaaggtgctgaacagcgtgcaggagttcatcagcaagagcaagatcaagctggtgccccccaccaaggagagccccaccgtgcctgtggccgacaatgccaccatcgagaacatcgtgaacagcatctacacctctgtgctgaagcacagcggcagctacacctctgtgttcaaggacctgatgggcaagagcaatgtgctgagtgacaccatcggcttcctgatggtgaatgccatcagcaacagcgagttccagccccaggtggaggaggaggtgagcaacagcgagctggtgctggaggccgtgaagatcatggagaaggtgatcaagatcattgatgagctgaagagcaaggagaagagcagcagcaggaagggcctgaccctggatgccaagctgctggaggaggtgctggccctcttcctggccaagctgatccggctgcccagcagcagcagcaaggatgagaagaacctgagcaagacagagctgaacaagatcgccagccagctgagcaagctggtgacagctgagatcagccgcagcagcatcagcctgattgccagtgaccctgaggagcactgcctgaacccagaaaatacagagcgcatctaccaggtggtggacagcgtgtacagcaacatcctgcagcagagcggcaccaacaaggagttctactatgacatcaaggacaccaacacagccttccccaagaaggtggccagcctcatcattgatggagtgagcagcttccccctggacaccatcaacagcaccatcagcaatgctgacctgagcggggagctggatgtgaaccgcatcgtgcagaaggcccaggagcacgccttcaacgtcatccctgagctggagcaggagaagctggaccagaacctgtctgaggaggagagccccatcaagatcgtgccccacgtgggcaagaagcctgtgaagattgaccccaagatcatcagcgagcacctggccgtcatcagcatcaagacccagcccctggagaagctgaagcaggagtgcctgaagaggacaggccacagcattgctgagctgcggcgggccagcatctctggaagaaactacagcctgggcagcccagacctggagaagaggaagacagaaagaaggaccagcctggacaagacaggccgcctggatgtgaagcccctggaggccgtggccagaaattccttccagaacatcaggaagccagacatcaccaaggtggagctgctgaaggatgtgcagagcaagaatgacctgattgtgcggctggtggcccatgacatcgaccaggtgtacctggagaactacatcaaggaggagcgggacagtgatgaagatgaggtggtgctgacccagacctttgccaaggaggagggcatcaaggtgtttgaggaccaggtgaaggaggtgaagaagcccatccagagcaagctgagccccaagagcaccctgagcaccagcagcctgaagaagttcctgagcctgagcaagtgctgccagaccacagccagcgccaacatcgagagcacagaggccatcagcaaccaggtgattgagagcaaggagacccacgtgaagagagctgtggccgagctggacatggccacccccaagaccatgcctgagacagccagcagctcctgggaggagaagccccagtgcaagaaggaggagaagaacctggtgacagagcccacccactacttcatccaccgcatcatgagcagcagcagctacaaccaggaggacctgatcagcagcactggagaggccgaggactgccacagcgaccccagcgccaagatcctggaggagagcagccaggagcagaagccagagcacggcaacagcgtgaagttcatcaccatctttgagaggagcaaggatgtgctgggcagcgccaaccccagcaaggaggtgatcagcgagacccccaagccagatgtgtccaagcagggcagcaagatgctgaccaagatgagcagcaccctgagcaaggtgttcagccagtgcaacaccaacatcagccgcagcagcagccctgcccaccaggatgagcactag

SEQ ID NO: 34357 - DNA, 411 bp, Artificial Sequence
  Description of Artificial Sequence: Synthetic coding sequence
aaggaccaggagcggctgatgaggcaccgctacctggacatgatcagcaggaagctggagcagctggagaggacagctgaggagcagaggctcttcctgatggaccgggaggagcggcggcagcgggagcacaccaggaggaagctgaccctgcggaggaagattgaggaggagtggaagaccaaggagatgctgctgctgaccaggatggccgaggatgtgaagcgggaggagcgcatcgaggagcagcagcacaggaaccgggaggagagtgacaggaagaagcaggacctgctggagaagaagatggcctaccacctgcagaagatgcaggacaccggcttcaacggggaggacatcggcaagaacaccttcaagtaccggggccaggacggcacccacggggagtag

SEQ ID NO: 34358 - DNA, 393 bp, Artificial Sequence
  Description of Artificial Sequence: Synthetic coding sequence
atgaggcaccgctacctggacatgatcagcaggaagctggagcagctggagaggacagctgaggagcagaggctcttcctgatggaccgggaggagcggcggcagcgggagcacaccaggaggaagctgaccctgcggaggaagattgaggaggagtggaagaccaaggagatgctgctgctgaccaggatggccgaggatgtgaagcgggaggagcgcatcgaggagcagcagcacaggaaccgggaggagagtgacaggaagaagcaggacctgctggagaagaagatggcctaccacctgcagaagatgcaggacaccggcttcaacggggaggacatcggcaagaacaccttcaagtaccggggccaggacggcacccacggggagtag

SEQ ID NO: 34359 - DNA, 1377 bp, Artificial Sequence
  Description of Artificial Sequence: Synthetic coding sequence
atgatgctgatccccatggcctctgtgatggctgtgacagagcccaagtgggtgtctgtgtggagccgcttcctgtgggtgaccctgctgtccatggtgctgggcagcctgctggccctgctgctgcccctgggcgctgtggaggagcagtgcctggccgtgctgaagggcctgtacctgctgcggagcaagccagaccgggcccagcacgccgccaccaagtgcaccagccccagcacagagctgagcatcaccagcagaggagccaccctgctggtggccaagaccaaggccagccctgctgggaagctggaggcccgggccgccctgaaccaggccctggagatgaagaggcagggcaagcgggagaaggcccagaagctgttcatgcacgccctgaagatggaccctgactttgtggatgccctgacagaatttggcatcttcagcgaggaggacaaggacatcatccaggccgactacctgtacacccgggccctgaccatcagcccctaccacgagaaggccctggtgaacagagacaggaccctgcccctggtggaggagattgaccagcgctacttcagcatcatcgacagcaaggtgaagaaggtgatgagcatccccaagggcaacagcgccctgcggcgggtgatggaggagacctactaccaccacatctaccacacagtggccatcgagggcaacaccctgaccctgtctgagatccgccacatcctggagaccaggtatgctgtgcctgggaagagcctggaggagcagaatgaggtgattggcatgcatgctgccatgaagtacatcaacaccaccctggtgagccgcatcggctctgtgaccatcagtgatgtgctggagatccacagaagagtgctgggctacgtggaccctgtggaggccggccgcttccgcaccacccaggtgctggtgggccaccacatccccccccacccccaggatgtggagaagcagatgcaggagtttgtgcagtggctgaacagcgaggaggccatgaacctgcaccctgtggagtttgctgccctggcccactacaagctggtgtacatccaccccttcattgatggaaatggaagaaccagccggctgctgatgaacctgatcctgatgcaggccggctacccacccatcaccatcaggaaggagcagaggagtgactactaccacgtgctggaggccgccaatgaaggagatgtgcggcccttcatccgcttcatcgccaagtgcacagagaccaccctggacaccctgctgtttgccaccacagagtacagcgtggccctgcctgaggcccagcccaaccacagcggcttcaaggagaccctgcctgtgaagccctag

SEQ ID NO: 34360 - DNA, 831 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggggacatctgtgccttctgccacaagacagtgagcccccgggagctggccgtggaggccatgaagaggcagtaccacgcccagtgcttcacctgcaggacctgccggcggcagctggccggccagagcttctaccagaaggatggccggcccctgtgtgagccctgctaccaggacaccctggagcgctgtgggaaatgtggggaggtggtgcgggaccacatcatccgggccctgggccaggccttccaccccagctgcttcacctgtgtgacctgtgcccgctgcattggagatgagagctttgccctgggcagccagaatgaggtgtactgcctggatgacttctacaggaagtttgcccctgtgtgcagcatctgtgagaaccccatcatccccagagatggcaaggatgccttcaagattgagtgcatgggcaggaacttccacgagaactgctaccgctgtgaggactgccgcatcctgctgtctgtggagcccacagaccagggctgctaccccctgaacaaccacctgttctgcaagccctgccacgtgaagaggtctgctgctggctgctgctag

SEQ ID NO: 34361 - DNA, 1122 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggcggctgccccccacctcctcctgtgctggatggagaagatgtgctgcctgacctggacctgctgcccccacctcctcctcctcctcctgtgctgctgcccagcgaggaggaggccccagcccccatgggcgccagcctgattgctgacctggagcagctgcacctgagccccccacctcctccaccccaggccccagctgagggccccagcgtgcagcccggccccctgcggcccatggaggaggagctgcccccacctcctgctgagcctgtggagaagggggccagcacagacatctgtgccttctgccacaagacagtgagcccccgggagctggccgtggaggccatgaagaggcagtaccacgcccagtgcttcacctgcaggacctgccggcggcagctggccggccagagcttctaccagaaggatggccggcccctgtgtgagccctgctaccaggacaccctggagcgctgtgggaaatgtggggaggtggtgcgggaccacatcatccgggccctgggccaggccttccaccccagctgcttcacctgtgtgacctgtgcccgctgcattggagatgagagctttgccctgggcagccagaatgaggtgtactgcctggatgacttctacaggaagtttgcccctgtgtgcagcatctgtgagaaccccatcatccccagagatggcaaggatgccttcaagattgagtgcatgggcaggaacttccacgagaactgctaccgctgtgaggactgccgcatcctgctgtctgtggagcccacagaccagggctgctaccccctgaacaaccacctgttctgcaagccctgccacgtgaagaggtctgctgctggctgctgctag

SEQ ID NO: 34362 - DNA, 1122 bp, Artificial Sequence; identical to SEQ ID NO: 34361
  Description of Artificial Sequence: Synthetic coding sequence

SEQ ID NO: 34363 - DNA, 831 bp, Artificial Sequence; identical to SEQ ID NO: 34360
  Description of Artificial Sequence: Synthetic coding sequence

SEQ ID NO: 34364 - DNA, 54 bp, Artificial Sequence
  Description of Artificial Sequence: Synthetic coding sequence
atggccagcaagccagagaagagggtggccagcagcgtcttcatcaccctgtag

SEQ ID NO: 34365 - DNA, 315 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggcggctgccccccacctcctcctgtgctggatggagaagatgtgctgcctgacctggacctgctgtag

SEQ ID NO: 34366 - DNA, 1125 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggcggctgccccccacctcctcctgtgctggatggagaagatgtgctgcctgacctggacctgctgcccccacctcctcctcctcctcctgtgctgctgcccagcgaggaggaggccccagcccccatgggcgccagcctgattgctgacctggagcagctgcacctgagccccccacctcctccaccccaggccccagctgagggccccagcgtgcagcccggccccctgcggcccatggaggaggagctgcccccacctcctgctgagcctgtggagaagggggccagcacagacatctgtgccttctgccacaagacagtgagcccccgggagctggccgtggaggccatgaagaggcagtaccacgcccagtgcttcacctgcaggacctgccggcggcagctggccggccagagcttctaccagaaggatggccggcccctgtgtgagccctgctaccaggacaccctggagcgctgtgggaaatgtggggaggtggtgcgggaccacatcatccgggccctgggccaggccttccaccccagctgcttcacctgtgtgacctgtgcccgctgcattggagatgagagctttgccctgggcagccagaatgaggtgtactgcctggatgacttctaccgctatgagaagggcctgtgcaccggctggggcgccggcaccggccgggaccccagccgggtgaaggagctgagcctgagccctggctgctgggcccgggtgtcctgcctgctggtgtactacaaggagtactacagagctggcctgggcgctgtggcccacgcctgcaaccccagcaccctgggcggccggggcggctggatcaccaggtctggggaccgggaccaccctggatag

SEQ ID NO: 34367 - DNA, 438 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggcggctgccccccacctcctcctgtgctggatggagaagatgtgctgcctgacctggacctgctgcccccacctcctcctcctcctcctgtgctgctgcccagcgaggaggaggccccagcccccatgggcgccagcctgattgctgacctggagcagctgcacctgagccccccacctcctccaccctag

SEQ ID NO: 34368 - DNA, 93 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgtag

SEQ ID NO: 34369 - DNA, 96 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgaggtag

SEQ ID NO: 34370 - DNA, 435 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgcagctgttcaacggggacatctgtgccttctgccacaagacagtgagcccccgggagctggccgtggaggccatgaagaggcagtaccacgcccagtgcttcacctgcaggacctgccggcggcagctggccggccagagcttctaccagaaggatggccggcccctgtgtgagccctgctaccaggacaccctggagtag

SEQ ID NO: 34371 - DNA, 105 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtag

SEQ ID NO: 34372 - DNA, 237 bp, Artificial Sequence
  Description of Artificial Sequence: Synthetic coding sequence
atggccagcaagccagagaagagggtggccagcagcgtcttcatcaccctggcccccccaagaagagatgtggccgtggccgaggaggtgcggcaggccgtgtgtgaggcccggcggggccggccctgggaggccccagcccccatgaagaccccagaggccggcctggccggccggcccagcccctggaccaccccaggccgggccgccgccaccgtgcctgctgcccccatgtag

SEQ ID NO: 34373 - DNA, 45 bp, Artificial Sequence
  Description of Artificial Sequence: Synthetic coding sequence
atggccagcaagccagagaagagggtggccagcagcgtcttctag

SEQ ID NO: 34374 - DNA, 300 bp, Artificial Sequence
  Description of Artificial Sequence: Synthetic coding sequence
atgtgtgtgggggagaagagaagagccatcatccccagccacctggcctacggcaagaggggcttccccccatctgtgcctgcagatgctgtggtgcagtatgatgtggagctgattgccctgatccgggccaactactggctgaagctggtgaagggcatcctgcccctggtgggcatggccatggtgcctgccctgctgggcctcatcggctaccacctgtacaggaaggccaaccggcccaaggtgtccaagaagaagctgaaggaggagaagaggaacaagagcaagaagaagtag

SEQ ID NO: 34375 - DNA, 441 bp, Artificial Sequence
  Description of Artificial Sequence: Synthetic coding sequence
atgaccctgcggcccagcctgctgcccctgcacctgctgctgctgctgctgctgtctgctgctgtgtgcagagctgaggccggcctggagacagagagccctgtgaggaccctgcaggtggagaccctggtggagcccccagagccctgtgccgagcctgctgccttcggggacaccctgcacatccactacacaggcagcctggtggatggccgcatcatcgacaccagcctgacccgggaccccctggtgattgagctgggccagaagcaggtgattcctggcctggagcagagcctgctggacatgtgtgtgggggagaagagaagagccatcatccccagccacctggcctacggcaagaggggcttccccccatctgtgcccggcaccaaggacaacctgatgaggcctcctggcatgaccagcagcagccagtag

SEQ ID NO: 34376 - DNA, 606 bp, Artificial Sequence
  Description of Artificial Sequence: Synthetic coding sequence
atgaccctgcggcccagcctgctgcccctgcacctgctgctgctgctgctgctgtctgctgctgtgtgcagagctgaggccggcctggagacagagagccctgtgaggaccctgcaggtggagaccctggtggagcccccagagccctgtgccgagcctgctgccttcggggacaccctgcacatccactacacaggcagcctggtggatggccgcatcatcgacaccagcctgacccgggaccccctggtgattgagctgggccagaagcaggtgattcctggcctggagcagagcctgctggacatgtgtgtgggggagaagagaagagccatcatccccagccacctggcctacggcaagaggggcttccccccatctgtgcctgcagatgctgtggtgcagtatgatgtggagctgattgccctgatccgggccaactactggctgaagctggtgaagggcatcctgcccctggtgggcatggccatggtgcctgccctgctgggcctcatcggctaccacctgtacaggaaggccaaccggcccaaggtgtccaagaagaagctgaaggaggagaagaggaacaagagcaagaagaagtag

SEQ ID NO: 34377 - DNA, 948 bp, Artificial Sequence
  Description of Artificial Sequence: Synthetic coding sequence
atgagagctggccagcagctggcctccatgctgcgctggacccgggcctggaggctgccccgggagggcctgggcccccacggccccagctttgcccgggtgcctgtggcccccagcagcagcagcggcggccggggcggcgctgagccccggcccctgcccctgagctaccgcctgctggatggagaggccgccctgcctgctgtggtgttcctgcacggcctgtttggcagcaagaccaacttcaacagcatcgccaagatcctggcccagcagacaggaagaagagtgctgactgtggatgccagaaatcatggagacagcccccacagcccagacatgtcctatgagatcatgagccaggacctgcaggacctgctgccccagctgggcctggtgccctgtgtggtggtgggccacagcatgggcggcaagacagccatgctgctggccctgcagaggcctgagctggtggagcggctgattgctgtggacatcagccctgtggagagcactggagtgagccactttgccacctacgtggccgccatgagggccatcaacattgctgatgagctgcccaggagccgggccaggaagctggctgatgagcagctgagcagcgtcatccaggacatggctgtgcggcagcacctgctgaccaacctggtggaggtggatggccgctttgtgtggagggtgaacctggatgccctgacccagcacctggacaagatcctggccttcccccagaggcaggagagctacctgggccccaccctcttcctgctgggcggcaacagccagtttgtgcaccccagccaccaccctgagatcatgaggctcttcccccgggcccagatgcagacagtgcccaatgccggccactggattcatgctgaccggccccaggacttcatcgccgccatccggggcttcctggtgtag

SEQ ID NO: 34378 - DNA, 1713 bp, Artificial Sequence
  Description of Artificial Sequence: Synthetic coding sequence
atggccttccggggctggaggcctcctcctccacccctgctgctgctgctgctgtgggtgacaggccaggccgcccctgtggccggcctgggcagtgatgctgagctgcagatcgagaggagatttgtgcctgatgagtgccccaggacagtgcgcagcggggactttgtgcgctaccactacgtgggcaccttcccagatggccagaagtttgacagcagctatgaccgggacagcaccttcaacgtgtttgtgggcaagggccagctgatcaccggcatggaccaggccctggtgggcatgtgtgtgaatgaaagaagatttgtgaagatcccccccaagctggcctatggaaatgaaggagtgtctggagtcatcccccccaacagcgtgctgcactttgatgtgctgctgatggacatctggaacagcgaggaccaggtgcagatccacacctacttcaagccacccagctgccccaggaccatccaggtgtctgactttgtgcgctaccactacaacggcaccttcctggatggcaccctgtttgacagcagccacaacaggatgaagacctatgacacctacgtgggcatcggctggctgatccctggcatggacaagggcctgctgggcatgtgtgtgggggagaagaggatcatcaccatcccccccttcctggcctatggagaagatggagatggcaaggacatccctggccaggccagcctggtgtttgatgtggccctgctggacctgcacaaccccaaggacagcatcagcattgagaacaaggtggtgcctgagaactgtgagcgcatcagccagagcggggacttcctgcgctaccactacaacggcaccctgctggatggcaccctgtttgacagcagctacagcaggaacagaacatttgacacctacatcggccagggctacgtgattcctggcatggatgagggcctgctgggcgtgtgcattggagagaagagaagaattgtggtgcccccccacctgggctatggagaggagggccggggcaacatccctggcagcgctgtgctggtgtttgacatccacgtgattgacttccacaaccccagcgacagcatcagcatcaccagccactacaagcccccagactgcagcgtgctgagcaagaagggggactacctgaagtaccactacaatgccagcctgctggatggcaccctgctggacagcacctggaacctgggcaagacctacaacatcgtgctgggcagcggccaggtggtgctgggcatggacatgggcctgcgggagatgtgtgtgggggagaagaggacagtcatcatccccccccacctgggctacggggaggccggcgtggatggagaggtgcccggcagcgctgtgctggtgtttgatattgagctgctggagctggtggccggcctgcctgagggctacatgttcatctggaatggagaggtgagccccaacctgtttgaggagattgacaaggatggaaatggagaggtgctgctggaggagttcagcgagtacatccacgcccaggtggccagcggcaagggcaagctggcccctggctttgatgctgagctgattgtgaagaacatgttcaccaaccaggacagaaatggagatggcaaggtgacagctgaggagttcaagctgaaggaccaggaggccaagcatgatgagctgtag

SEQ ID NO: 34379 - DNA, 1017 bp, Artificial Sequence
  Description of Artificial Sequence: Synthetic coding sequence
atggccggcaaggacatccctggccaggccagcctggtgtttgatgtggccctgctggacctgcacaaccccaaggacagcatcagcattgagaacaaggtggtgcctgagaactgtgagcgcatcagccagagcggggacttcctgcgctaccactacaacggcaccctgctggatggcaccctgtttgacagcagctacagcaggaacagaacatttgacacctacatcggccagggctacgtgattcctggcatggatgagggcctgctgggcgtgtgcattggagagaagagaagaattgtggtgcccccccacctgggctatggagaggagggccggggcaacatccctggcagcgctgtgctggtgtttgacatccacgtgattgacttccacaaccccagcgacagcatcagcatcaccagccactacaagcccccagactgcagcgtgctgagcaagaagggggactacctgaagtaccactacaatgccagcctgctggatggcaccctgctggacagcacctggaacctgggcaagacctacaacatcgtgctgggcagcggccaggtggtgctgggcatggacatgggcctgcgggagatgtgtgtgggggagaagaggacagtcatcatccccccccacctgggctacggggaggccggcgtggatggagaggtgcccggcagcgctgtgctggtgtttgatattgagctgctggagctggtggccggcctgcctgagggctacatgttcatctggaatggagaggtgagccccaacctgtttgaggagattgacaaggatggaaatggagaggtgctgctggaggagttcagcgagtacatccacgcccaggtggccagcggcaagggcaagctggcccctggctttgatgctgagctgattgtgaagaacatgttcaccaaccaggacagaaatggagatggcaaggtgacagctgaggagttcaagctgaaggaccaggaggccaagcatgatgagctgtag

SEQ ID NO: 34380 - DNA, 1872 bp, Artificial Sequence
  Description of Artificial Sequence: Synthetic coding sequence
atggccttccggggctggaggcctcctcctccacccctgctgctgctgctgctgtgggtgacaggccaggccgcccctgtggccggcctgggcagtgatgctgagctgcagatcgagaggagatttgtgcctgatgagtgccccaggacagtgcgcagcggggactttgtgcgctaccactacgtgggcaccttcccagatggccagaagtttgacagccgctactgggacacagctgaggacaaggctgacaagagcccctgcccccaggtgcgggtgggcgtgaacaccagccccagctgccgcctgaagcagaagggcgtgggcatctactggaaggacctgcagttcctggtgcgggtgcagaaccacggcctgtcctatgaccgggacagcaccttcaacgtgtttgtgggcaagggccagctgatcaccggcatggaccaggccctggtgggcatgtgtgtgaatgaaagaagatttgtgaagatcccccccaagctggcctatggaaatgaaggagtgtctggagtcatcccccccaacagcgtgctgcactttgatgtgctgctgatggacatctggaacagcgaggaccaggtgcagatccacacctacttcaagccacccagctgccccaggaccatccaggtgtctgactttgtgcgctaccactacaacggcaccttcctggatggcaccctgtttgacagcagccacaacaggatgaagacctatgacacctacgtgggcatcggctggctgatccctggcatggacaagggcctgctgggcatgtgtgtgggggagaagaggatcatcaccatcccccccttcctggcctacggggaggatggagatggcaaggacatccctggccaggccagcctggtgtttgatgtggccctgctggacctgcacaaccccaaggacagcatcagcattgagaacaaggtggtgcctgagaactgtgagcgcatcagccagagcggggacttcctgcgctaccactacaacggcaccctgctggatggcaccctgtttgacagcagctacagcaggaacagaacatttgacacctacatcggccagggctacgtgattcctggcatggatgagggcctgctgggcgtgtgcatcggggagaagaggcgcatcgtggtgcccccccacctgggctacggggaggagggccggggcaacatccctggcagcgctgtgctggtgtttgacatccacgtgattgacttccacaaccccagcgacagcatcagcatcaccagccactacaagcccccagactgcagcgtgctgagcaagaagggggactacctgaagtaccactacaatgccagcctgctggatggcaccctgctggacagcacctggaacctgggcaagacctacaacatcgtgctgggcagcggccaggtggtgctgggcatggacatgggcctgcgggagatgtgtgtgggggagaagaggacagtcatcatccccccccacctgggctatggagaggccggcgtggatggagaggtgcccggcagcgctgtgctggtgtttgacatcgagctgctggagctggtggccggcctgcctgagggctacatgttcatctggaatggagaggtgagccccaacctgtttgaggagattgacaaggatggaaatggagaggtgctgctggaggagttcagcgagtacatccacgcccaggtggccagcggcaagggcaagctggcccctggctttgatgctgagctgattgtgaagaacatgttcaccaaccaggacagaaatggagatggcaaggtgacagctgaggagttcaagctgaaggaccaggaggccaagcatgatgagctgtag

SEQ ID NO: 34381 - DNA, 1299 bp, Artificial Sequence
  Description of Artificial Sequence: Synthetic coding sequence
atggacatctggaacagcgaggaccaggtgcagatccacacctacttcaagccacccagctgccccaggaccatccaggtgtctgactttgtgcgctaccactacaacggcaccttcctggatggcaccctgtttgacagcagccacaacaggatgaagacctatgacacctacgtgggcatcggctggctgatccctggcatggacaagggcctgctgggcatgtgtgtgggggagaagaggatcatcaccatcccccccttcctggcctatggagaagatggagatggcaaggacatccctggccaggccagcctggtgtttgatgtggccctgctggacctgcacaaccccaaggacagcatcagcattgagaacaaggtggtgcctgagaactgtgagcgcatcagccagagcggggacttcctgcgctaccactacaacggcaccctgctggatggcaccctgtttgacagcagctacagcaggaacagaacatttgacacctacatcggccagggctacgtgattcctggcatggatgagggcctgctgggcgtgtgcattggagagaagagaagaattgtggtgcccccccacctgggctatggagaggagggccggggcaacatccctggcagcgctgtgctggtgtttgacatccacgtgattgacttccacaaccccagcgacagcatcagcatcaccagccactacaagcccccagactgcagcgtgctgagcaagaagggggactacctgaagtaccactacaatgccagcctgctggatggcaccctgctggacagcacctggaacctgggcaagacctacaacatcgtgctgggcagcggccaggtggtgctgggcatggacatgggcctgcgggagatgtgtgtgggggagaagaggacagtcatcatccccccccacctgggctacggggaggccggcgtggatggagaggtgcccggcagcgctgtgctggtgtttgatattgagctgctggagctggtggccggcctgcctgagggctacatgttcatctggaatggagaggtgagccccaacctgtttgaggagattgacaaggatggaaatggagaggtgctgctggaggagttcagcgagtacatccacgcccaggtggccagcggcaagggcaagctggcccctggctttgatgctgagctgattgtgaagaacatgttcaccaaccaggacagaaatggagatggcaaggtgacagctgaggagttcaagctgaaggaccaggaggccaagcatgatgagctgtag

SEQ ID NO: 34382 - DNA, 1989 bp, Artificial Sequence
  Description of Artificial Sequence: Synthetic coding sequence
atggagggcacccactgcaccctgcagctgcacaagcccatcacagagctgtgctacatctccttctgcctgcccaagggggaggtgcggggcttctcctacaagggcaccgtgaccctggacaggagcaacaagggcttccacaactgctaccaggtgcgggaggagagtgacatcatcagcctgagccaggagccagatgagcaccctggggacatcttcttcaagcagacccccaccaaggacatcctgacagagctgtacaagctgaccacagagcgggagcggctgctgaccaacctgctgagcagtgaccacatcctgggcatcaccatgggcaaccaggagggcaagctgcaggagctgtctgtgtccctggccccagaagatgactgcttccagagcgctggggactggcagggcgagctgcctgtgggccccctgaacaagaggagcacccacggcaacaagaagccccggcgcagcagtggaagaagagagagctttggagccctgccccagaagaggaccaagaggaagggccggggcggccgggagagcgcccccctgatgggcaaggacaagatctgcagcagccacagcctgcccctgagcaggacccggcccaacctgtgggtgctggaggagaagggcaacctgctgcccaatggagccctggcctgcagcctgcagaggcgggagagctgccccccagacatccccaagaccccagacacagacctgggcttcggcagctttgaaacagccttcaaggacaccggcctgggccgggaggtgctgcccccagactgcagcagcacagaggccggaggagatggcatccggcggccccccagcggcctggagcaccagcagacaggcctgtctgagagccaccaggaccctgagaagcaccctgaggccgagaaggatgagatggagaagccagccaagaggacctgcaagcagaagcctgtgtccaaggtggtggccaaggtgcaggacctgagcagccaggtgcagagggtggtgaagacccacagcaagggcaaggagaccatcgccatccggcctgctgcccacgccgagtttgtgcccaaggctgacctgctgaccctgcccggggctgaggccggggcccacggcagccggcggcagggcaaggagcggcagggcgacaggagcagccagagccctgctggggagacagccagcatcagctctgtgtctgccagcgctgagggcgctgtgaacaaggtgcccctgaaggtgattgaaagtgagaagctggatgaggcccctgagggcaagaggctgggcttccctgtgcacacctctgtgccccacaccaggcctgagaccaggaacaagaggcgggccggcctgcccctgggcggccacaagagcctcttcctggacctgccccacaaggtgggccctgacagcagccagcccaggggggacaagaagaagcccagccccccagccccagctgccctgggcaaggtgttcaacaacagcgccagccagagcagcacccacaagcagaccagccctgtgcccagccccctgagcccccggctgcccagcccccagcagcaccaccgcatcctgcggctgcctgccctgcccggggagcgggaggccgccctgaatgacagcccctgcaggaagagcagggtcttcagcggctgtgtgtctgctgacaccctggagccccccagcagcgccaaggtgacagagaccaagggggccagccctgccttcctgcgggccggccagccccggctggtgcctggagagaccctggagaagagcctgggccctgggaagaccacagctgagccccagcaccagagccccccagccttccactgggacctgcagcagcacttccaggagcctgtgatcagaacagtgtccatcagctgtgccagcaacctgatcaaggaggaggccggcaagggcaaggagagccgctctggatag

SEQ ID NO: 34383 - DNA, 3591 bp, Artificial Sequence
  Description of Artificial Sequence: Synthetic coding sequence
atggagaatgtggacaacagcctggatggcagtgatgtgtctgagcccgccaagccagaggccggcctggaggtggcccagagcatcctgagcaagttctccatgaagagcctgtttggcttcaccagcaagctggagagcgtgaaccctgaggaggaggatgctgtgctgaaggccttccacagcctggatgtgaaccccaccagccagcaggatgacagcagcaatggcctggacccccaggaggccggcagccgggtgtccccagacctgggcaatgatgagaagatcgcctctgtggagacagagagcgagggcagccagaggaaggaggccggcaccagcctgctggcccaggagctgctgcccctgagcaccctgaagggcaccaaggatgatgtgatctgtgtgcggggcaccctggtgcacaccaccagtgacagcgacagtgatgatggcggccaggagcctgaggagggcagcagcaccaacggccccaagagccccagcggcgtgctgtctgagcccagccaggagagcaaggagaaccctgggggcttcagagaaaatacagtgactggagagatgaatggagctgagctgtgtgccgaggacccccagaggatccccccagagatgagcagcaagctggaggccggaaatggaggcctgcagacagagcggcggcccagccaggaccaggtgggggaggagggcagccaggacctgcctgctgtgaccaaccagaacagctctgtgggcatcacagagagcgccagcagcaagaaggaggtgtctggagagaagagcttccagctgcctgccttcttcagcggcctgcgggtgctgaagaagggggccacagctgagggcggggagaccatcacagagatcaagcccaaggatggagacctggccctgctgaagctgacccagcctgtgcagaagagcctggtgcaggccggcctgcagacagtgaagtctgagaagaaggccacagaccccaaggccacccccaccctgctggagcagctgagcctgctgctgaacatcgacatgcccaagacagagcccaagggagctgaccctgagagcccccggcgggaggagatgggctgcaatgctgaccaggagagccagagcggccctggggtgccccagacccagggcggggaggtgaagcccaagagccctgagacagccctggaggccttcaaggccctcttcatccggccccccaggaagggcaccacagctgacaccagcgagctggaggccctgaagaggaagatgagacatgagaaggagagcctgcgggctgtgtttgagaggagcaacagcaagccagcagatggccccagcgacagcaagagcccagaccacagcctgacagagcaggatgacaggaccccaggccgcctgcaggccgtgtggcccccacccaagaccaaggacacagaggagaaggtgggcctgaagtacacagaagctgagtaccaggccgccatcctgcacctgaagcgggagcacaaggaggagattgagaacctgcaggcccagtttgagctgcgggccttccacatccggggggagcacgccatgatcacagcccggctggaggagaccatcgagaacctgaagcatgagctggagcaccgctggaggggcggctgtgaggagaggaaggatgtgtgcatcagcacagatgatgactgcccccccaagaccttcagaaatgtgtgtgtgcagacagaccgggagaccttcctgaagccctgtgagagcgagagcaagaccaccaggagcaaccagctggtgcccaagaagctgaacatcagcagcctgagccagctgagccccccaaatgaccacaaggacatccatgctgccctgcagcccatggagggcatggccagcaaccagcagaaggccctgcccccacctccagccagcatccccccacctccacccctgcccagcggcctgggcagcctgagccctgccccacccatgcctcctgtgtctgctggcccccccctgcccccacctcctcctcctcctccacccctgcccccacccagcagcgctggccccccacctcctcctcctcctccacccctgcccaacagccctgccccacccaaccctgggggccccccaccagcccctcctcctcctggcctggcccctcctcctcctcctggcctcttcttcggcctgggcagcagcagcagccagtgccccaggaagccagccatcgagcccagctgccccatgaagcccctgtactggacccgcatccagatcagtgacaggagccagaatgccacccccaccctgtgggacagcctggaggagccagacatccgggaccccagcgagtttgagtacctgttcagcaaggacaccacccagcagaagaagaagcccctgtctgagacctatgagaagaagaacaaggtgaagaagatcatcaagctgctggatggcaagaggagccagacagtgggcatcctgatcagcagcctgcacctggagatgaaggacatccagcaggccatcttcaacgtggatgacagcgtggtggacctggagaccctggccgccctgtatgagaacagagcccaggaggatgagctggtgaagatcaggaagtactatgagaccagcaaggaggaggagctgaagctgctggacaagccagagcagttcctgcacgagctggcccagatccccaactttgctgagcgggcccagtgcatcatcttccgctctgtgttcagcgagggcatcaccagcctgcacaggaaggtggagatcatcacccgggccagcaaggacctgctgcacgtgaagtctgtgaaggacatcctggccctgatcctggccttcggcaactacatgaatggaggcaacagaacccggggccaggctgatggctacagcctggagatcctgcccaagctgaaggatgtgaagagccgggacaatggcatcaacctggtggactatgtggtgaagtactacctgcgctactatgaccaggaggccggcacagagaagagcgtcttccccctgcctgagccccaggacttcttcctggccagccaggtgaagtttgaagatctcatcaaggacctgaggaagctgaagaggcagctggaggccagcgagaagcagatggtggtggtgtgcaaggagagccccaaggagtacctgcagcccttcaaggacaagctggaggagttcttccagaaggccaagaaggagcacaagatggaggagagccacctggagaatgcccagaagagctttgagaccaccgtgcgctacttcggcatgaagcccaagagcggggagaaggagatcacccccagctatgtgttcatggtgtggtatgagttctgcagcgacttcaagaccatctggaagcgggagagcaagaacatcagcaaggagcggctgaagatggcccaggagagcgtgtccaagctgaccagcgagaagaaggtggagaccaagaagatcaaccccacagccagcctgaaggagcggctgcggcagaaggaggcctctgtgaccaccaactag

SEQ ID NO: 34384 - DNA, 1512 bp, Artificial Sequence
  Description of Artificial Sequence: Synthetic coding sequence
atggagaatgtggacaacagcctggatggcagtgatgtgtctgagcccgccaagccagaggccggcctggaggtggcccagagcatcctgagcaagttctccatgaagagcctgtttggcttcaccagcaagctggagagcgtgaaccctgaggaggaggatgctgtgctgaaggccttccacagcctggatgtgaaccccaccagccagcaggatgacagcagcaatggcctggacccccaggaggccggcagccgggtgtccccagacctgggcaatgatgagaagatcgcctctgtggagacagagagcgagggcagccagaggaaggaggccggcaccagcctgctggcccaggagctgctgcccctgagcaccctgaagggcaccaaggatgatgtgatctgtgtgcggggcaccctggtgcacaccaccagtgacagcgacagtgatgatggcggccaggagcctgaggagggcagcagcaccaacggccccaagagccccagcggcgtgctgtctgagcccagccaggagagcaaggagaaccctgggggcttcagagaaaatacagtgactggagagatgaatggagctgagctgtgtgccgaggacccccagaggatccccccagagatgagcagcaagctggaggccggaaatggaggcctgcagacagagcggcggcccagccaggaccaggtgggggaggagggcagccaggacctgcctgctgtgaccaaccagaacagctctgtgggcatcacagagagcgccagcagcaagaaggaggtgtctggagagaagagcttccagctgcctgccttcttcagcggcctgcgggtgctgaagaagggggccacagctgagggcggggagaccatcacagagatcaagcccaaggatggagacctggccctgctgaagctgacccagcctgtgcagaagagcctggtgcaggccggcctgcagacagtgaagtctgagaagaaggccacagaccccaaggccacccccaccctgctggagcagctgagcctgctgctgaacatcgacatgcccaagacagagcccaagggagctgaccctgagagcccccggcgggaggagatgggctgcaatgctgaccaggagagccagagcggccctggggtgccccagacccagggcggggaggtgaagcccaagagccctgagacagccctggaggccttcaaggccctcttcatccggccccccaggaagggcaccacagctgacaccagcgagctggaggccctgaagaggaagatgagacatgagaaggagagcctgcgggctgtgtttgagaggagcaacagcaagccagcagatggccccagcgacagcaagagcccagaccacagcctgacagagcaggatgacaggaccccaggccgcctgcaggccgtgtggcccccacccaagaccaaggacacagaggagaaggtgggcctgaagtacacagaagctggaaatgtgaagggcagctag

SEQ ID NO: 34385 - DNA, 4260 bp, Artificial Sequence
  Description of Artificial Sequence: Synthetic coding sequence
atggagggcacccactgcaccctgcagctgcacaagcccatcacagagctgtgctacatctccttctgcctgcccaagggggaggtgcggggcttctcctacaagggcaccgtgaccctggacaggagcaacaagggcttccacaactgctaccaggtgcgggaggagagtgacatcatcagcctgagccaggagccagatgagcaccctggggacatcttcttcaagcagacccccaccaaggacatcctgacagagctgtacaagctgaccacagagcgggagcggctgctgaccaacctgctgagcagtgaccacatcctgggcatcaccatgggcaaccaggagggcaagctgcaggagctgtctgtgtccctggccccagaagatgactgcttccagagcgctggggactggcagggcgagctgcctgtgggccccctgaacaagaggagcacccacggcaacaagaagccccggcgcagcagtggaagaagagagagctttggagccctgccccagaagaggaccaagaggaagggccggggcggccgggagagcgcccccctgatgggcaaggacaagatctgcagcagccacagcctgcccctgagcaggacccggcccaacctgtgggtgctggaggagaagggcaacctgctgcccaatggagccctggcctgcagcctgcagaggcgggagagctgccccccagacatccccaagaccccagacacagacctgggcttcggcagctttgaaacagccttcaaggacaccggcctgggccgggaggtgctgcccccagactgcagcagcacagaggccggaggagatggcatccggcggccccccagcggcctggagcaccagcagacaggcctgtctgagagccaccaggaccctgagaagcaccctgaggccgagaaggatgagatggagaagccagccaagaggacctgcaagcagaagcctgtgtccaaggtggtggccaaggtgcaggacctgagcagccaggtgcagagggtggtgaagacccacagcaagggcaaggagaccatcgccatccggcctgctgcccacgccgagtttgtgcccaaggctgacctgctgaccctgcccggggctgaggccggggcccacggcagccggcggcagggcaaggagcggcagggcgacaggagcagccagagccctgctggggagacagccagcatcagctctgtgtctgccagcgctgagggcgctgtgaacaaggtgcccctgaaggtgattgaaagtgagaagctggatgaggcccctgagggcaagaggctgggcttccctgtgcacacctctgtgccccacaccaggcctgagaccaggaacaagaggcgggccggcctgcccctgggcggccacaagagcctcttcctggacctgccccacaaggtgggccctgacagcagccagcccaggggggacaagaagaagcccagccccccagccccagctgccctgggcaaggtgttcaacaacagcgccagccagagcagcacccacaagcagaccagccctgtgcccagccccctgagcccccggctgcccagcccccagcagcaccaccgcatcctgcggctgcctgccctgcccggggagcgggaggccgccctgaatgacagcccctgcaggaagagcagggtcttcagcggctgtgtgtctgctgacaccctggagccccccagcagcgccaaggtgacagagaccaagggggccagccctgccttcctgcgggccggccagccccggctggtgcctggagagaccctggagaagagcctgggccctgggaagaccacagctgagccccagcaccagagccccccaggcatcagcagcgagggcttcccctgggatggcttcaatgagcagacccccaaggacctgcccaacagagatggaggagcctgggtgctgggctaccgggccggccctgcctgccccttcctgctgcacgaggagcgggagaagagcaacagaagtgagctgtacctggacctgcacccagaccacagcctgacagagcaggatgacaggaccccaggccgcctgcaggccgtgtggcccccacccaagaccaaggacacagaggagaaggtgggcctgaagtacacagaggccgagtaccaggccgccatcctgcacctgaagcgggagcacaaggaggagattgagaacctgcaggcccagtttgagctgcgggccttccacatccggggggagcacgccatgatcacagcccggctggaggagaccatcgagaacctgaagcatgagctggagcaccgctggaggggcggctgtgaggagaggaaggatgtgtgcatcagcacagatgatgactgcccccccaagaccttcagaaatgtgtgtgtgcagacagaccgggagaccttcctgaagccctgtgagagcgagagcaagaccaccaggagcaaccagctggtgcccaagaagctgaacatcagcagcctgagccagctgagccccccaaatgaccacaaggacatccacgccgccctgcagcccatggagggcatggccagcaaccagcagaaggccctgcccccacctccagccagcatccccccacctccacccctgcccagcggcctgggcagcctgagccctgccccacccatgcctcctgtgtctgctggcccccccctgcccccacctcctcctcctcctccacccctgcccccacccagcagcgctggccccccacctcctcctcctcctccacccctgcccaacagccctgccccacccaaccctgggggccccccaccagcccctcctcctcctggcctggcccctcctcctcctcctggcctcttcttcggcctgggcagcagcagcagccagtgccccaggaagccagccatcgagcccagctgccccatgaagcccctgtactggacccgcatccagatcagtgacaggagccagaatgccacccccaccctgtgggacagcctggaggagccagacatccgggaccccagcgagtttgagtacctgttcagcaaggacaccacccagcagaagaagaagcccctgtctgagacctatgagaagaagaacaaggtgaagaagatcatcaagctgctggatggcaagaggagccagacagtgggcatcctgatcagcagcctgcacctggagatgaaggacatccagcaggccatcttcaacgtggatgattctgtggtggacctggagaccctggccgccctgtatgaaaatagagcccaggaggatgagctggtgaagatcaggaagtactatgagaccagcaaggaggaggagctgaagctgctggacaagccagagcagttcctgcacgagctggcccagatccccaactttgctgagcgggcccagtgcatcatcttccgcagcgtcttcagcgagggcatcaccagcctgcacaggaaggtggagatcatcacccgggccagcaaggacctgctgcacgtgaagtctgtgaaggacatcctggccctgatcctggcctttggaaactacatgaatggaggcaacagaacccggggccaggctgatggctacagcctggagatcctgcccaagctgaaggatgtgaagagccgggacaatggcatcaacctggtggactatgtggtgaagtactacctgcgctactatgaccaggaggccggcacagagaagtctgtgttccccctgcctgagccccaggacttcttcctggccagccaggtgaagtttgaggacctgatcaaggacctgaggaagctgaagaggcagctggaggccagcgagaagcagatggtggtggtgtgcaaggagagccccaaggagtacctgcagcccttcaaggacaagctggaggagttcttccagaaggccaagaaggagcacaagatggaggagagccacctggagaatgcccagaagagctttgagaccaccgtgcgctacttcggcatgaagcccaagtctggagagaaggagatcacccccagctatgtgttcatggtgtggtatgagttctgcagcgacttcaagaccatctggaagcgggagagcaagaacatcagcaaggagcggctgaagatggcccaggagagcgtgtccaagctgaccagcgagaagaaggtggagaccaagaagatcaaccccacagccagcctgaaggagcggctgcggcagaaggaggcctctgtgaccaccaactag

SEQ ID NO: 34386 - DNA, 768 bp, Artificial Sequence
  Description of Artificial Sequence: Synthetic coding sequence
atgagcagccacaggaggaaggccaagggcaggaacagaagaagccaccgggccatgagggtggcccacctggagctggccacctatgagctggccgccacagagagcaaccctgagagcagccaccctggctatgaagctgccatggctgaccggccccagcccggctggagggagagcctgaagatgagggtgtccaagcccttcggcatgctgatgctgagcatctggatcctgctgtttgtgtgctactacctgagctactacctgtgcagcggcagcagctactttgtgctggccaacggccacatcctgcccaacagtgaaaatgcccacggccagagcctggaggaggacagcgccctggaggccctgctgaacttcttcttccccaccacctgcaacctgcgggagaaccaggtggccaagccctgcaatgagctgcaggacctgtctgagagtgaatgtctgcggcacaagtgctgcttcagcagcagcggcaccaccagcttcaagtgctttgcccccttcagagatgtgcccaagcagatgatgcagatgtttggcctgggcgccatcagcctcatcctggtgtgcctgcccatctactgccgcagcctcttctggaggtctgagccagcagatgacctgcagaggcaggacaacagagtggtgacaggcctgaagaagcagaggaggaagaggaagaggaagtctgagatgctgcagaaggccgcccggggccgggaggagcacggagatgaatag

SEQ ID NO: 34387 - DNA, 903 bp, Artificial Sequence
  Description of Artificial Sequence: Synthetic coding sequence
atggacctgcccccccagctgagctttggcctgtatgtggccgcctttgccctgggcttccccctgaatgtgctggccatccggggggccacagcccacgcccggctgcggctgacccccagcctggtgtatgccctgaacctgggctgcagcgacctgctgctgactgtgtccctgcccctgaaggctgtggaggccctggccagcggggcctggcccctgcctgccagcctgtgccctgtgtttgctgtggcccacttcttccccctgtatgctgggggcggcttcctggccgccctgtctgctggccgctacctgggcgccgccttccccctgggctaccaggccttccggcggccctgctacagctggggcgtgtgtgccgccatctgggccctggtgctgtgccacctgggcctggtgtttggcctggaggcccctgggggctggctggaccacagcaacaccagcctgggcatcaacacccctgtgaatggcagccctgtgtgcctggaggcctgggaccctgccagcgctggccctgcccgcttcagcctgagcctgctgctcttcttcctgcccctggccatcacagccttctgctacgtgggctgcctgcgggccctggcccggagcggcctgacccacaggaggaagctgcgggccgcctgggtggccggcggggccctgctgaccctgctgctgtgtgtgggcccctacaatgccagcaatgtggccagcttcctgtaccccaacctgggcggctcctggaggaagctgggcctcatcaccggggcctggagcgtggtgctgaaccccctggtgacaggctacctgggccggggccctggcctgaagacagtgtgtgccgcccggacccagggcggcaagagccagaagtag

SEQ ID NO: 34388 - DNA, 993 bp, Artificial Sequence
  Description of Artificial Sequence: Synthetic coding sequence
atgctgcctgactggaagagcagcctcatcctgatggcctacatcatcatcttcctgaccggcctgcctgccaacctgctggccctgcgggcctttgtgggccgcatccggcagccccagcctgcccctgtgcacatcctgctgctgagcctgaccctggccgacctgctgctgctgctgctgctgcccttcaagatcattgaagctgccagcaacttccgctggtacctgcccaaggtggtgtgtgccctgaccagctttggcttctacagcagcatctactgcagcacctggctgctggccggcatcagcattgagcgctacctgggcgtggccttccctgtgcagtacaagctgagcagaagacccctgtatggagtgattgctgccctggtggcctgggtgatgagctttggccactgcaccatcgtcatcatcgtgcagtacctgaacaccacagagcaggtgcgctctggaaatgagatcacctgctatgagaacttcacagacaaccagctggatgtggtgctgcctgtgcggctggagctgtgcctggtgctcttcttcatccccatggctgtgaccatcttctgctactggaggtttgtgtggatcatgctgagccagcccctggtgggcgcccagaggagaagaagagctgtgggcctggccgtggtgaccctgctgaacttcctggtgtgcttcggcccctacaacgtgagccacctggtgggctaccaccagaggaagagcccctggtggaggagcattgctgtggtgttcagcagcctgaatgccagcctggaccccctgctcttctacttcagcagctctgtggtgagaagagccttcggccggggcctgcaggtgctgaggaaccagggcagcagcctgctgggcagaagaggcaaggacacagctgagggcaccaatgaagatagaggagtgggccagggcgagggcatgcccagcagtgacttcaccacagaatag

SEQ ID NO: 34389 - DNA, 1041 bp, Artificial Sequence
  Description of Artificial Sequence: Synthetic coding sequence
atggacaccggccctgaccagagctacttcagcggcaaccactggtttgtgttttctgtgtacctgctgaccttcctggtgggcctgcccctgaacctgctggccctggtggtgtttgtgggcaagctgcagaggaggcctgtggccgtggatgtgctgctgctgaacctgacagccagtgacctgctgctgctgctcttcctgcccttcaggatggtggaggccgccaacggcatgcactggcccctgcccttcatcctgtgccccctgagcggcttcatcttcttcaccaccatctacctgacagccctcttcctggccgctgtgtccattgagcgcttcctgtctgtggcccaccccctgtggtacaagacccggccccggctgggccaggccggcctggtgtctgtggcctgctggctgctggccagcgcccactgcagcgtggtgtatgtgattgagttcagcggggacatcagccacagccagggcaccaacggcacctgctacctggagttcaggaaggaccagctggccatcctgctgcctgtgcggctggagatggctgtggtgctgtttgtggtgcccctcatcatcaccagctactgctacagccggctggtgtggatcctgggccggggcggcagccaccggcggcagaggagagtggccggcctgctggccgccaccctgctgaacttcctggtgtgcttcggcccctacaacgtgagccacgtggtgggctacatctgtggggagagccctgcctggaggatctacgtgaccctgctgagcaccctgaacagctgtgtggacccctttgtgtactacttcagcagcagcggcttccaggccgacttccacgagctgctgcggcggctgtgtggcctgtggggccagtggcagcaggagagctccatggagctgaaggagcagaagggcggggaggagcagagagctgacaggcctgctgagaggaagaccagcgagcacagccagggctgcggcactggaggccaggtggcctgtgccgagagctag

SEQ ID NO: 34390 - DNA, 1758 bp, Artificial Sequence
  Description of Artificial Sequence: Synthetic coding sequence
atggcccggccagaccccagcgccccacccagcctgctgctgctgctgctggcccagctggtgggccgggctgctgctgccagcaaggcccctgtgtgccaggagatcaccgtgcccatgtgccggggcatcggctacaacctgacccacatgcccaaccagttcaaccacgacacccaggatgaagctggcctggaggtgcaccagttctggcccctggtggagatccagtgcagcccagacctgcgcttcttcctgtgcagcatgtacacccccatctgcctgcctgactaccacaagcccctgcccccctgccgctctgtgtgtgagcgggccaaggccggctgcagccccctgatgaggcagtatggctttgcctggccagagaggatgagctgtgaccggctgcctgtgctgggcagagatgctgaggtgctgtgcatggactacaacagaagtgaggccaccacagccccaccccggcccttccctgccaagcccaccctgcccggccccccaggggccccagccagcggaggagaatgtcctgctgggggcccctttgtgtgcaagtgccgggagccctttgtgcccatcctgaaggagagccaccccctgtacaacaaggtgaggacaggccaggtgcccaactgtgctgtgccctgctaccagcccagcttcagcgcagatgagaggacctttgccaccttctggattggcctgtggagcgtgctgtgcttcatcagcaccagcaccaccgtggccaccttcctgattgacatggagcgcttccgctacccagagcggcccatcatcttcctgagcgcctgctacctgtgtgtgtccctgggcttcctggtgcggctggtggtgggccacgcctctgtggcctgcagccgggagcacaaccacatccactatgagaccaccggccctgccctgtgcaccatcgtgttcctgctggtgtacttcttcggcatggccagcagcatctggtgggtgatcctgagcctgacctggttcctggccgccggcatgaagtggggcaatgaggccatcgccggctacgcccagtacttccacctggccgcctggctgatccccagcgtgaagagcatcacagccctggccctgagctctgtggatggagaccctgtggccggcatctgctacgtgggcaaccagaacctgaacagcctgcggggctttgtgctgggccccctggtgctgtacctgctggtgggcaccctcttcctgctggccggctttgtgtccctcttccgcatccgcagcgtcatcaagcagggcggcaccaagacagacaagctggagaagctgatgatccgcatcggcatcttcaccctgctgtacacagtgcctgccagcatcgtggtggcctgctacctgtatgagcagcactaccgggagagctgggaggccgccctgacctgtgcctgccccggccatgacaccggccagccccgggccaagccagagtactgggtgctgatgctgaagtacttcatgtgcctggtggtgggcatcaccagcggcgtgtggatctggagcggcaagacagtggagagctggaggcgcttcaccagccgctgctgctgccggccccggcggggccacaagtctggaggagccatggctgctggggactacccagaggccagcgctgccctgaccggccgcactggacctcctggccctgctgccacctaccacaagcaggtgtccctgagccacgtgtag

SEQ ID NO: 34391 - DNA, 2313 bp, Artificial Sequence
  Description of Artificial Sequence: Synthetic coding sequence
atgagcaaatgtaggaagacccctgtgcagcagctggccagccctgccagcttctccccagacatcctggccgacatctttgagctgtttgccaagaacttctcctatggcaagcccctgaacaatgagtggcagctgcctgaccccagcgagatcttcacctgtgaccacacagagctgaatgccttcctggacctgaagaacagcctgaatgaggtgaagaacctgctgagtgacaagaagctggatgagtggcatgagcacacagccttcaccaacaaggccggcaagatcatcagccacgtgaggaagtctgtgaatgctgagctgtgcacccaggcctggtgcaagttccacgagatcctgtgcagcttccccctcatcccccaggaggccttccagaatggcaagctgaacagcctgcacctgtgtgaggcccctggggccttcatcgccagcctgaaccactacctgaagagccaccgcttcccctgccactggagctgggtggccaacaccctgaacccctaccacgaggccaatgatgacctgatgatgatcatggatgaccggctgattgccaacaccctgcactggtggtacttcggccctgacaacacaggagacatcatgaccctgaagttcctgaccggcctgcagaacttcatcagctccatggccaccgtgcacctggtgacagcagatggcagctttgactgccagggcaaccctggagagcaggaggccctggtgagcagcctgcactactgtgaggtggtgacagccctgaccaccctgggcaatggaggcagctttgtgctgaagatgttcaccatgtttgagcactgcagcatcaacctgatgtacctgctgaactgctgctttgaccaggtgcacgtgttcaagccagccaccagcaaggccggcaacagcgaggtgtatgtggtgtgcctgcactacaagggccgggaggccatccaccccctgctgagcaagatgaccctgaactttggaacagagatgaagaggaaggccctcttcccccaccacgtgatcccagacagcttcctgaagagacatgaggagtgctgcgtgttcttccacaagtaccagctggagaccatcagcgagaacatccggctgtttgagtgcatgggcaaggccgagcaggagaagctgaacaacctgcgggactgtgccatccagtacttcatgcagaagttccagctgaagcacctgagcaggaacaactggctggtgaagaagagcagcatcggctgcagcaccaacaccaagtggtttggccagaggaacaagtacttcaagacctacaatgaaaggaagatgctggaggccctgtcctggaaggacaaggtggccaagggctacttcaacagctgggccgaggagcacggcgtgtaccaccctggccagagcagcatcctggagggcacagccagcaacctggagtgccacctgtggcacatcctggagggcaagaagctgcccaaggtgaagtgcagccccttctgcaatggagagatcctgaagaccctgaatgaggccatcgagaagagcctgggcggggccttcaacctggacagcaagttccggcccaagcagcagtacagctgcagctgccacgtgttttctgaggagctgatcttcagcgagctgtgcagcctgacagagtgcctgcaggatgagcaggtggtggtgcccagcaaccagatcaagtgcctgctggtgggcttcagcaccctgaggaacatcaagatgcacatccccctggaggtgcggctgctggagagcgctgagctgaccaccttcagctgcagcctgctgcatgatggagaccccacctaccagaggctcttcctggactgcctgctgcacagcctgcgggagctgcacactggagatgtgatgatcctgcctgtgctgagctgcttcacccgcttcatggccggcctcatctttgtgctgcacagctgcttccgcttcatcacctttgtgtgccccaccagcagtgaccccctgcggacctgtgctgtgctgctgtgtgtgggctaccaggacctgcccaaccctgtgttccgctacctgcagagcgtgaatgagctgctgagcaccctgctgaacagcgacagcccccagcaggtgctgcagtttgtgcccatggaggtgctgctgaagggggccctgctggacttcctgtgggacctgaatgctgccatcgccaagaggcacctgcacttcatcatccagcgggagcgggaggagatcatcaacagcctgcagctgcagaactag

SEQ ID NO: 34392 - DNA, 2313 bp, Artificial Sequence; identical to SEQ ID NO: 34391
  Description of Artificial Sequence: Synthetic coding sequence

SEQ ID NO: 34393 - DNA, 1440 bp, Artificial Sequence
  Description of Artificial Sequence: Synthetic coding sequence
atggtgcgcatccagaggaggaagctgctggccagctgcctgtgtgtgacagccaccgtcttcctgctggtgaccctgcaggtgatggtggagctgggcaagtttgagaggaaggagttcaagagcagcagcctgcaggacggccacaccaagatggaggaggcccccacccacctgaacagcttcctgaagaaggagggcctgaccttcaacaggaagaggaagtgggagctggacagctaccccatcatgctgtggtggagccccctgactggagagaccggccgcctgggccagtgtggggctgatgcctgcttcttcaccatcaacagaacctacctgcaccaccacatgaccaaggccttcctgttctatggaacagacttcaacatcgacagcctgcccctgcccaggaaggcccaccacgactgggccgtgttccacgaggagagccccaagaacaactacaagctgttccacaagcctgtgatcaccctcttcaactacacagccaccttcagccgccacagccacctgcccctgaccacccagtacctggagagcattgaggtgctgaagagcctgcgctacctggtgcccctgcagagcaagaacaagctgaggaagaggctggcccccctggtgtatgtgcagagcgactgtgaccccccaagtgaccgggacagctatgtgcgggagctgatgacctacatcgaggtggacagctatggagaatgtctgaggaacaaggacctgccccagcagctgaagaacccagcctccatggatgctgatggcttctaccgcatcatcgcccagtacaagttcatcctggcctttgaaaatgctgtgtgtgatgactacatcacagagaagttctggaggcccctgaagctgggcgtggtgcctgtgtactacggcagccccagcatcacagactggctgcccagcaacaagagcgccatcctggtgtctgagttcagccacccccgggagctggccagctacatccggcggctggacagtgatgaccggctgtatgaggcctacgtggagtggaagctgaagggggagatcagcaaccagaggctgctgacagccctgcgggagaggaagtggggcgtgcaggatgtgaaccaggacaactacattgatgcctttgagtgcatggtgtgcaccaaggtgtgggccaacatccggctgcaggagaagggcctgccccccaagcgctgggaggccgaggacacccacctgagctgcccagagcccaccgtgtttgccttcagccccctgcggaccccacccctgagcagcctgcgggagatgtggatcagcagctttgagcagagcaagaaggaggcccaggccctgcgctggctggtggacaggaaccagaacttcagcagccaggagttctggggcctggtgttcaaggactag

SEQ ID NO: 34394 - DNA, 1074 bp, Artificial Sequence
  Description of Artificial Sequence: Synthetic coding sequence
atgggcatcggccagctgccccactacgccctggtggtgcctgcagatggaggagactgggaggtgcggcccatgtggagccgctgcctcttcctgcaccaccagcctgacctgccccccagcagccatgaccagagcatccccctgctgtggagccaggaggagagcccccccctggctgaaaatgatggaacagacttcaacatcgacagcctgcccctgcccaggaaggcccaccacgactgggccgtgttccacgaggagagccccaagaacaactacaagctgttccacaagcctgtgatcaccctcttcaactacacagccaccttcagccgccacagccacctgcccctgaccacccagtacctggagagcattgaggtgctgaagagcctgcgctacctggtgcccctgcagagcaagaacaagctgaggaagaggctggcccccctggtgtatgtgcagagcgactgtgaccccccaagtgaccgggacagctatgtgcgggagctgatgacctacatcgaggtggacagctatggagaatgtctgaggaacaaggacctgccccagcagctgaagaacccagcctccatggatgctgatggcttctaccgcatcatcgcccagtacaagttcatcctggcctttgaaaatgctgtgtgtgatgactacatcacagagaagttctggaggcccctgaagctgggcgtggtgcctgtgtactacggcagccccagcatcacagactggctgcccagcaacaagagcgccatcctggtgtctgagttcagccacccccgggagctggccagctacatccggcggctggacagtgatgaccggctgtatgaggcctacgtggagtggaagctgaagggggagatcagcaaccagaggctgctgacagccctgcgggagaggaagtggggcgtgcaggatgtgaaccaggacaactacattgatgcctttgagtgcatggtgtgcaccaaggtgtgggccaacatccggctgcaggagaaggtgtccaagagcaaggtgggcatcgagcctgctggctggcccagctag

SEQ ID NO: 34395 - DNA, 1566 bp, Artificial Sequence
  Description of Artificial Sequence: Synthetic coding sequence
atggtgcgcatccagaggaggaagctgctggccagctgcctgtgtgtgacagccaccgtcttcctgctggtgaccctgcaggccctggacacagtggagaacctgatgaaggtgactggaccaccccagggcgtgacagacagcatgcagtgcttcaatgaccagaggcccctgagcaacaccaggagcagcgagcacatcaaggaggtgatggtggagctgggcaagtttgagaggaaggagttcaagagcagcagcctgcaggacggccacaccaagatggaggaggcccccacccacctgaacagcttcctgaagaaggagggcctgaccttcaacaggaagaggaagtgggagctggacagctaccccatcatgctgtggtggagccccctgactggagagaccggccgcctgggccagtgtggggctgatgcctgcttcttcaccatcaacagaacctacctgcaccaccacatgaccaaggccttcctgttctatggaacagacttcaacatcgacagcctgcccctgcccaggaaggcccaccacgactgggccgtgttccacgaggagagccccaagaacaactacaagctgttccacaagcctgtgatcaccctcttcaactacacagccaccttcagccgccacagccacctgcccctgaccacccagtacctggagagcattgaggtgctgaagagcctgcgctacctggtgcccctgcagagcaagaacaagctgaggaagaggctggcccccctggtgtatgtgcagagcgactgtgaccccccaagtgaccgggacagctatgtgcgggagctgatgacctacatcgaggtggacagctatggagaatgtctgaggaacaaggacctgccccagcagctgaagaacccagcctccatggatgctgatggcttctaccgcatcatcgcccagtacaagttcatcctggcctttgaaaatgctgtgtgtgatgactacatcacagagaagttctggaggcccctgaagctgggcgtggtgcctgtgtactacggcagccccagcatcacagactggctgcccagcaacaagagcgccatcctggtgtctgagttcagccacccccgggagctggccagctacatccggcggctggacagtgatgaccggctgtatgaggcctacgtggagtggaagctgaagggggagatcagcaaccagaggctgctgacagccctgcgggagaggaagtggggcgtgcaggatgtgaaccaggacaactacattgatgcctttgagtgcatggtgtgcaccaaggtgtgggccaacatccggctgcaggagaagggcctgccccccaagcgctgggaggccgaggacacccacctgagctgcccagagcccaccgtgtttgccttcagccccctgcggaccccacccctgagcagcctgcgggagatgtggatcagcagctttgagcagagcaagaaggaggcccaggccctgcgctggctggtggacaggaaccagaacttcagcagccaggagttctggggcctggtgttcaaggactag

SEQ ID NO: 34396 - DNA, 1479 bp, Artificial Sequence
  Description of Artificial Sequence: Synthetic coding sequence
atggctgctggccccatccgggtggtgctggtgctgctgggcgtgctgtctgtgtgtgccgccagcggccacggctctgtggccgagcgggaggccggcggggaggccgagtgggccgagccctgggatggagctgtgttccggcccccatctgccctgggcgctgtgggcgtgaccaggagcagcggcacccccaggcctggccgggaggaggccggggacctgcctgtgctgctgtggtggagccctggcctcttcccccacttccctggggacagcgagagaattgaatgtgcccggggggcctgtgtggccagcaggaacagaagagccctgcgggacagcaggacccgggccctgctcttctatggaacagacttccgggccagcgctgcccccctgccccggctggcccaccagagctgggccctgctgcacgaggagagccccctgaacaacttcctgctgagccacggccctggcatccgcctcttcaacctgaccagcaccttcagccgccacagcgactaccccctgagcctgcagtggctgcctggaacagcctacctgcggcggcctgtgcccccacccatggagagagctgagtggaggagaagaggctacgcccccctgctgtacctgcagagccactgtgatgtgcctgctgaccgggacagatatgtgcgggagctgatgaggcacatccctgtggacagctatggcaagtgcctgcagaaccgggagctgcccacagcccggctgcaggacacagccacagccaccacagaagatcctgagctgctggccttcctgagccgctacaagttccacctggccctggagaatgccatctgcaatgactacatgacagagaagctgtggaggcccatgcacctgggcgctgtgcctgtgtaccggggcagccccagcgtgcgggactggatgcccaacaaccacagcgtcatcctgattgatgactttgagagcccccagaagctggccgagttcatcgacttcctggacaagaatgatgaggagtacatgaagtacctggcctacaagcagcccggcggcatcaccaaccagttcctgctggacagcctgaagcaccgggagtggggcgtgaatgaccccctgctgcccaactacctgaatggatttgagtgctttgtgtgtgactatgagctggcccggctggatgctgagaaggcccacgccgccagccctggggacagccctgtgtttgagccccacatcgcccagcccagccacatggactgccctgtgcccaccccaggctttggaaatgtggaggagatcccagaaaatgacagctggaaggagatgtggctgcaggactactggcagggcctggaccagggcgaggccctgacagccatgatccacaacaatgaaacagagcagaccaagttctgggactacctgcacgagatcttcatgaagaggcagcacctgtag

SEQ ID NO: 34397 - DNA, 1431 bp, Artificial Sequence
  Description of Artificial Sequence: Synthetic coding sequence
atggctgctggccccatccgggtggtgctggtgctgctgggcgtgctgtctgtgtgtgccgccagcggccacggctctgtggccgagcgggaggccggcggggaggccgagtgggccgagccctgggatggagctgtgttccggcccccatctgccctgggcgctgtgggcgtgaccaggagcagcggcacccccaggcctggccgggaggaggccggggacctgcctgtgctgctgtggtggagccctggcctcttcccccacttccctggggacagcgagagaattgaatgtgcccggggggcctgtgtggccagcaggaacagaagagccctgcgggacagcaggacccgggccctgctcttctatggaacagacttccgggccagcgctgcccccctgccccggctggcccaccagagctgggccctgctgcacgaggagagccccctgaacaacttcctgctgagccacggccctggcatccgcctcttcaacctgaccagcaccttcagccgccacagcgactaccccctgagcctgcagtggctgcctggaacagcctacctgcggcggcctgtgcccccacccatggagagagctgagtggaggagaagaggctacgcccccctgctgtacctgcagagccactgtgatgtgcctgctgaccgggacagatatgtgcgggagctgatgaggcacatccctgtggacagctatggcaagtgcctgcagaaccgggagctgcccacagcccggctgcaggacacagccacagccaccacagaagatcctgagctgctggccttcctgagccgctacaagttccacctggccctggagaatgccatctgcaatgactacatgacagagaagctgtggaggcccatgcacctgggcgctgtgcctgtgtaccggggcagccccagcgtgcgggactggatgcccaacaaccacagcgtcatcctgattgatgactttgagagcccccagaagctggccgagttcatcgacttcctggacaagaatgatgaggagtacatgaagtacctggcctacaagcagcccggcggcatcaccaaccagttcctgctggacagcctgaagcaccgggagtggggcgtgaatgaccccctgctgcccaactacctgaatggatttgagtgctttgtgtgtgactatgagctggcccggctggatgctgagaaggcccacgccgccagccctggggacagccctgtgtttgagccccacatcgcccagcccagccacatggactgccctgtgcccaccccaggctttggaaatgtggaggagatcccagaaaatgacagcagcctggtgcaggtgcgggaccactgcatctgcctgcgcttcctgtggccccacagcgagaagggccgcacccacaactatgctgctgtgccctag

SEQ ID NO: 34398 - DNA, 570 bp, Artificial Sequence
  Description of Artificial Sequence: Synthetic coding sequence
atggagaccagcgccccccgggccggcagccaggtggtggccaccacagcccggcacagcgctgcctacagagctgaccccctgcgggtgagcagccgggacaagctgacagagatggccgccagcagccagggcaactttgagggcaactttgagagcctggacctggccgagtttgccaagaagcagccctggtggaggaagctgtttggccaggagagcggccccagcgctgagaagtacagcgtggccacccagctgttcatcggcggcgtgacaggctggtgcaccggcttcatcttccagaaggtgggcaagctggccgccacagctgtgggcggcggcttcttcctgctgcagctggccaaccacacaggctacatcaaggtggactggcagagggtggagaaggacatgaagaaggccaaggagcagctgaagatcaggaagagcaaccagatccccacagaggtgcgcagcaaggccgaggaggtggtgtcctttgtgaagaagaatgtgctggtgactggaggcttcttcggcggcttcctgctgggcatggccagctag

SEQ ID NO: 34399 - DNA, 1569 bp, Artificial Sequence
  Description of Artificial Sequence: Synthetic coding sequence
atggccctgacagagacccagccccagctgctgtctgctgacctggtgctggccctgcaggtgctgatgctgtgggagatgacagaggccaacaaggtgctgaagaggcggcagcacccccagaggagccactgcatcagcagcaagatcctggagagctacccaggagagaagcccctgaccaagagcctgcagagaggagaggacccccagtttgaccaggtgatcagctccatgagcagcctgtctgagtactgcctgcccagcatcctgcggaccctgtttgactgtgatgagcagcagagggactacctgatggagcggcgggacctggccatcgacttcatcttcagcctggtgctgattgaggtgctgaagcagggcagcctgacctgcctgatcatcccctacctgggcaccctggtgcccaccctggccatctgcatcctgtggcagacctgcatgcagaagagcctggagtgctggcacaagcccagcaagtttcctgctgtgaagaagaagttcatggccgagctgaaggagctgcggcacaaggagcagaacccctacgtggtgcagagcatcatcagcctcatcatgggcatgaagttcttccgcatcaagatgtaccctgtggaggactttgaggccagcctgcagttcatgcaggagtgtgcccactacttcctggaggtgaaggacaaggacatcaagcacgccctggccggcctgtttgtggagatcctggtgcctgtggccgctgctgtgaagaatgaggtgaatgtgccctgcctgaggaactttgtggagagcctgtatgacaccaccctggagctgagcagcaggaagaagcacagcctggccctgtaccccctggtgacctgcctgctgtgtgtgtcccagaagcagctgttcctgaaccgctggcacatcttcctgaacaactgcctgagcaacctgaagaacaaggaccccaagatggcccgggtggccctggagagcctgtaccgcctgctgtgggtgtacatgatccgcatcaagtgtgagagcaacacagccacccagagccgcctcatcaccatcatcaccaccctcttccccaagggcagccggggcgtggtgccccgggacatgcccctgaacatctttgtgaagatcatccagttcatcgcccaggagcggctggactttgccatgaaggagatcatctttgacttcctgtgtgtgggcaagccagccaaggccttcagcctgaaccctgagaggatgaacatcggcctgcgggccttcctggtgattgctgacagcctgcagcagaaggatggagagccccccatgcctgtgactggagctgtgctgcccagcggcaacaccctgcgggtgaagaagacctacctgagcaagaccctgacagaggaggaggccaagatgattggcatgagcctgtactacagccaggtgaggaaggctgtggacaacatcctgcggcacctggacaaggaggtgggccgctgcatgatgctgaccaacgtgcagatgctgaacaaggagcctgaggacatgatctag

SEQ ID NO: 34400 - DNA, 588 bp, Artificial Sequence
  Description of Artificial Sequence: Synthetic coding sequence
atggagagcctggcccagctggagctgtgccagaggctgtacaagctgcacttccagctgctgctgctcttccagagctactgcaagctgattggccaggtgcatgaggtgtcctccatgcctgagctgctgaacatgagccgggagctgagtgacctgaagaagcacctgaaggaggccagcgctgtgattgctgctgaccccctgtacagtgatggagcctggagcgagcccaccttcaccagcacagaagctgccatccagagcatgctggagtgcctgaagaacaatgagctgggcaaggccctgcggcagatccgggagtgccgcagcctgtggcccaatgacatcttcggcagcagcagtgatgatgaggtgcagaccctgctgaacatctacttccgccaccagaccctgggccagacaggcacctacgccctggtgggcagcaaccagagcctgacagagatctgcaccaagctgatggagctgaacatggagatccgggacatgatcagaagagcccagagctacagagtgctgaccaccttcctgcctgacagctctgtgtctggcaccagcctgtag

SEQ ID NO: 34401 - DNA, 1278 bp, Artificial Sequence
  Description of Artificial Sequence: Synthetic coding sequence
atggctgtgaccaggagcaccagcagcaccagcagcggcagcaacagcaatgtgctggtgcctgtgtcctggaagaggccccagtacagccagaagaggaccaaggagaagctggtgcacgtgctgagcctgtgtggccaggaggtgggcctgagcaagaaccccagcgtcatcttcagcagctgtggggacctggacctgctggagcaccagaccagcctggtgtccagtgaagatggagcccgggagcaggagaacatggatgacaccaacagcgagcagcagttccgggtcttccgggactttgacttcctggatgtggagctggaggatggagagggcctgcggggggagagcatggacaacttcaactggggcgtgagaagaagaagcctggacagcctggacaagtgtgacatgcagatcctggaggagcggcagctgagcggcagcacccccagcctgaacaagatgcaccatgaagattctgatgagagcagcgaggaggaggacctgacagccagccagatcctggagcacagcgacctgatcatgaccctgagccccagcgaggagaccaaccccatggagctgctgaccacagcctgtgacagcaccccagctgagccccacagcttcaacaccaggatgagcagctttgatgccagcctgcctgacatgaacaacctgcagatcagcgagggcagcaaggccgaggccgtgcgggaggaggaggacaccaccgtgcatgaagatgacctgagcagcagcatcaatgagctgcctgctgcctttgagtgcagcgacagcttcagcctggacatgacagaaggagaggagaagggcaacagagccctggaccagttcaccctggccagctttggagagggggaccggggcgtgtccccaccacccagccccttcttcagcgccatcctggccgccttccagcctgctgcctgtgatgatgctgaggaggcctggaggagccacatcaaccagctgatgtgtgacagtgatggcagctgtgctgtgtacaccttccacgtgttcagcagcctcttcaagaacatccagaagcgcttctgcttcctgacctgtgatgctgccagctacctgggggacaacctgcggggcatcggcagcaagtttgtgagcagcagccagatgctgaccagctgcagcgagtgccgggcccaggtgcagtgtgtgaggacagcccgcatcttcggctacctgcagcagcaggagcggggccacaccctgtgcaagctgtag

SEQ ID NO: 34402 - DNA, 9042 bp, Artificial Sequence
  Description of Artificial Sequence: Synthetic coding sequence
atggccagccagcaggacagcggcttctttgagatcagcatcaagtacctgctgaagtcctggagcaacaccagccctgtgggcaatggctacatcaagccccctgtgcccccagccagcggcacccaccgggagaagggcccccccaccatgctgcccatcaacgtggaccctgacagcaagccaggagaatatgtgctgaagagcctgtttgtgaacttcaccacccaggccgagaggaagatccgcatcatcatggccgagcccctggagaagcccctgaccaagagcctgcagagaggagaggacccccagtttgaccaggtgatcagctccatgagcagcctgtctgagtactgcctgcccagcatcctgcggaccctgtttgactggtacaagaggcagaatggaattgaagatgagagccatgagtaccggcccaggaccagcaacaagagcaagagtgatgagcagcagagggactacctgatggagcggcgggacctggccatcgacttcatcttcagcctggtgctgattgaggtgctgaagcagatccccctgcaccctgtgattgacagcctcatccatgatgtgatcaacctggccttcaagcacttcaagtacaaggagggctacctgggccccaacacaggcaacatgcacatcgtggccgacctgtatgcagaggtgattggagtgctggcccaggccaagtttcctgctgtgaagaagaagttcatggccgagctgaaggagctgcggcacaaggagcagaacccctacgtggtgcagagcatcatcagcctcatcatgggcatgaagttcttccgcatcaagatgtaccctgtggaggactttgaggccagcctgcagttcatgcaggagtgtgcccactacttcctggaggtgaaggacaaggacatcaagcacgccctggccggcctgtttgtggagatcctggtgcctgtggccgctgctgtgaagaatgaggtgaatgtgccctgcctgaggaactttgtggagagcctgtatgacaccaccctggagctgagcagcaggaagaagcacagcctggccctgtaccccctggtgacctgcctgctgtgtgtgtcccagaagcagctgttcctgaaccgctggcacatcttcctgaacaactgcctgagcaacctgaagaacaaggaccccaagatggcccgggtggccctggagagcctgtaccgcctgctgtgggtgtacatgatccgcatcaagtgtgagagcaacacagccacccagagccgcctcatcaccatcatcaccaccctcttccccaagggcagccggggcgtggtgccccgggacatgcccctgaacatctttgtgaagatcatccagttcatcgcccaggagcggctggactttgccatgaaggagatcatctttgacttcctgtgtgtgggcaagccagccaaggccttcagcctgaaccctgagaggatgaacatcggcctgcgggccttcctggtgattgctgacagcctgcagcagaaggatggagagccccccatgcctgtgactggagctgtgctgcccagcggcaacaccctgcgggtgaagaagacctacctgagcaagaccctgacagaggaggaggccaagatgattggcatgagcctgtactacagccaggtgaggaaggctgtggacaacatcctgcggcacctggacaaggaggtgggccgctgcatgatgctgaccaacgtgcagatgctgaacaaggagcctgaggacatgatcactggagagaggaagcccaagattgacctcttccgcacctgtgtggccgccatcccccggctgctgcctgatggcatgagcaagctggagctgattgacctgctggcccggctgagcatccacatggatgatgagctgcggcacatcgcccagaacagcctgcagggcctgctggtggacttcagtgactggagagaagatgtgctgtttggcttcaccaacttcctgctgcgggaggtgaatgacatgcaccacaccctgctggacagcagcctgaagctgctgctgcagctgctgacccagtggaagctggtgatccagacccagggcaaggtgtatgagcaggccaacaagatccggaacagcgagctgattgccaacggcagcagccaccgcatccagagcgagcggggcccccactgcagcgtgctgcatgctgtggagggctttgccctggtgctgctgtgcagcttccaggtggccaccaggaagctgtctgtgctgatcctgaaggagatccgggccctcttcatcgccctgggccagccagaagatgatgaccggcccatgattgatgtgatggaccagctgagcagcagcatcctggagagcttcatccacgtggccgtgtctgattctgccaccctgcccctgacccacaacgtggacctgcagtggctggtggagtggaatgctgtgctggtgaacagccactatgatgtgaagagccccagccacgtgtggatctttgcccagagcgtgaaggacccctgggtgctgtgcctcttctccttcctgcggcaggagaacctgcccaagcactgccccacagccctgtcctatgcctggccctatgccttcacccggctgcagagcgtgatgcccctggtggaccccaacagccccatcaatgccaagaagaccagcacagctggcagcggggacaactacgtgaccctgtggaggaactacctgatcctgtgctttggagtggccaagcccagcatcatgagccctggccacctgcgggccagcaccccagagatcatggccaccaccccagatggcaccgtgtcctatgacaacaaggccatcggcaccccatctgtgggcgtgctgctgaagcagctggtgcccctgatgaggctggagagcattgagatcacagagagcctggtgctgggcttcggccgcaccaacagcctggtgttccgggagctggtggaggagctgcaccccctgatgaaggaggccctggagaggaggcctgagaacaagaagaggcgggagcggcgggacctgctgcggctgcagctgctgcgcatctttgagctgctggctgatgctggggtcatcagtgacagcaccaatggagccctggagcgggacaccctggccctgggcgccctcttcctggagtatgtggacctgaccaggatgctgctggaggctgaaaatgacaaggaggtggagatcctgaaggacatccgggcccacttcagcgccatggtggccaacctgatccagtgtgtgcctgtgcaccaccggcgcttcctgttcccccagcagagcctgcggcaccacctgttcatcctcttcagccagtgggccggccccttcagcatcatgttcacccccctggaccgctacagcgacaggaaccaccagatcacccgctaccagtactgtgccctgaaggccatgtctgctgtgctgtgctgcggccctgtgtttgacaacgtgggcctgagcccagatggctacctgtacaagtggctggacaacatcctggcctgccaggacctgcgggtgcaccagctgggctgtgaggtggtggtgctgctgctggagctgaacccagaccagatcaacctcttcaactgggccatcgaccgctgctacacaggcagctaccagctggccagcggctgcttcaaggccatcgccaccgtgtgtggcagcaggaactacccctttgatattgtgaccctgctgaacctggtgctcttcaaggccagtgacaccaaccgggagatctatgagatctccatgcagctgatgcagatcctggaggccaagctgtttgtgtacagcaagaaggtggccgagcagaggcctggcagcatcctgtatggcacccacggccccctgccccccctgtacagcgtgtccctggccctgctgagctgtgagctggccaggatgtacccagagctgaccctgcccctcttcagcgaggtgtcccagcgcttccccaccacccaccccaacggccggcagatcatgctgacctacctgctgccctggctgcacaacatcgagctggtggacagccggctgctgctgcccggcagcagccccagcagcccagaagatgaggtgaaggaccgggagggagatgtgacagccagccacggcctgcggggaaatggctggggcagccctgaggccaccagcctggtgctgaacaacctgatgtacatgacagccaagtatggagatgaggtgcccggccctgagatggagaatgcctggaatgccctggccaacaatgagaagtggagcaacaacctgcgcatcaccctgcagttcctgatcagcctgtgtggggtgtccagtgacacagtgctgctgccctacatcaagaaggtggccatctacctgtgcaggaacaacaccatccagaccatggaggagctgctgtttgagctgcagcagacagagcctgtgaaccccatcgtgcagcactgtgacaacccccccttctaccgcttcaccgccagcagcaaggccagcgctgctgccagcggcaccaccagcagcagcaacacagtggtggccggccaggagaacttcccagatgctgaggagaacaagatcctgaaggagagtgatgagcgcttcagcaatgtcatccgggcccacacccggctggagagccgctacagcaacagcagcggcggcagctatgatgaggacaagaatgaccccatcagcccctacacaggctggctgctgaccatcacagagaccaagcagccccagcccctgcccatgccctgcaccggcggctgctgggcccccctggtggactacctgcctgagaccatcaccccccggggccccctgcaccgctgcaacattgctgtgatcttcatgacagagatggtggtggaccacagcgtgcgggaggactgggccctgcacctgcccctgctgctgcatgctgtgttcctgggcctggaccactacagacctgaggtgtttgagcacagcaagaagctgctgctgcacctgctgattgccctgagctgcaacagcaacttccacagcatcgcctctgtgctgctgcagacccgggagatgggagaggccaagaccctgactgtgcagcctgcctaccagcctgagtacctgtacacaggaggctttgacttcctgcgggaggaccagagcagccctgtgcctgacagcggcctgagcagcagcagcaccagcagcagcatcagcctgggcggcagcagcggcaacctgccccagatgacccaggaggtggaggatgtggacacagctgctgagacagatgagaaggccaacaagctgattgagttcctgaccacccgggccttcggccccctgtggtgccacgaggacatcacccccaagaaccagaacagcaagtctgctgagcagctgaccaacttcctgcggcacgtggtgtctgtgttcaaggacagcaagagcggcttccacctggagcaccagctgtctgaggtggccctgcagacagccctggccagcagcagccgccactacgccggccgctccttccagatcttccgggccctgaagcagcccctgagcgcccacgccctgagtgacctgctgagccggctggtggaggtgattggagagcacggagatgagatccagggctacgtgatggaggccctgctgaccctggaggccgctgtggacaacctgagtgactgcctgaagaacagcgacctgctgactgtgctgagccgcagcagcagcccagacctgagcagcagcagcaagctgacagccagcaggaagagcacaggccagctgaacatgaaccctggcaccaccagcggcaacacagccacagctgagaggagccgccaccagaggagcttctctgtgcccaagaagtttggagtgattgacaggagcagtgaccccccaagaagtgccaccctggaccgcatccaggcctgcacccagcagggcctgagcagcaagaccaggagcagcagcagcctgaaggacagcctgacagaccccagccacatcaaccaccccaccaacctgctggccaccatcttctgggtgacagtggccctgatggagagtgactttgaatttgagtacctgatggccctgcggctgctgagccggctgctggcccacatgcccctggacaaggccgagaaccgggagaagctggagaagctgcaggcccagctgaagtgggccgacttcagcggcctgcagcagctgctgctgaagggcttcaccagcctgaccaccacagacctgaccctgcagctgttcagcctgctgacccctgtgtccaagatctccatggtggatgccagccacgccatcggcttccccctgaatgtgctgtgcctgctgccccagctgatccagcactttgagaaccccaaccagttctgcaaggacattgctgagcgcatcgcccaggtgtgcctggaggagaagaaccccaagctgagcaacctggcccacgtgatgaccctgtacaagacccacagctacacccgggactgtgccacctgggtgaatgtggtgtgccgctacctgcacgaggcctatgctgacatcaccctgaacatggtgacctacctggccgagctgctggagaagggcctgcccagcgtgcagcagcccctgctgcaggtgatctacagcctgctgagctacatggacctgtctgtggtgcctgtgaagcagttcaacgtggaggtgctgaagaccatcgagaagtatgtgcagagcgtgcactggagggaggccctgaacatcctgaagctggtggtgagccgcagcgccagcctggtgctgcccagctaccagcacagcgacctgagcaagattgagatccaccgggtgtggaccagcgccagcaaggagctgcccgggaagaccctggacttccactttgacatcagcgagacccccatcatcggccgccgctatgatgagctgcagaacagcagcggcagagatggcaagccccgggccatggctgtgaccaggagcaccagcagcaccagcagcggcagcaacagcaatgtgctggtgcctgtgtcctggaagaggccccagtacagccagaagaggaccaaggagaagctggtgcacgtgctgagcctgtgtggccaggaggtgggcctgagcaagaaccccagcgtcatcttcagcagctgtggggacctggacctgctggagcaccagaccagcctggtgtccagtgaagatggagcccgggagcaggagaacatggatgacaccaacagcgagcagcagttccgggtcttccgggactttgacttcctggatgtggagctggaggatggagagggggagagcatggacaacttcaactggggcgtgagaagaagaagcctggacagcctggacaagtgtgacatgcagatcctggaggagcggcagctgagcggcagcacccccagcctgaacaagatgcaccatgaagattctgatgagagcagcgaggaggaggacctgacagccagccagatcctggagcacagcgacctgatcatgaccctgagccccagcgaggagaccaaccccatggagctgctgaccacagcctgtgacagcaccccagctgagccccacagcttcaacaccaggatgagcagctttgatgccagcctgcctgacatgaacaacctgcagatcagcgagggcagcaaggccgaggccgtgcgggaggaggaggacaccaccgtgcatgaagatgacctgagcagcagcatcaatgagctgcctgctgcctttgagtgcagcgacagcttcagcctggacatgacagaaggagaggagaagggcaacagagccctggaccagttcaccctggccagctttggagagggggaccggggcgtgtccccaccacccagccccttcttcagcgccatcctggccgccttccagcctgctgcctgtgatgatgctgaggaggcctggaggagccacatcaaccagctgatgtgtgacagtgatggcagctgtgctgtgtacaccttccacgtgttcagcagcctcttcaagaacatccagaagcgcttctgcttcctgacctgtgatgctgccagctacctgggggacaacctgcggggcatcggcagcaagtttgtgagcagcagccagatgctgaccagctgcagcgagtgccccaccctgtttgtggatgctgagaccctgctgagctgtggcctgctggacaagctgaagttctctgtgctggagctgcaggagtacctggacacctacaacaacaggaaggaggccaccctgtcctggctggccaactgcaaggccacctttgctgggggcagcagagatggagtcatcacctgccagcccggggacagcgaggagaagcagctggagctgtgccagaggctgtacaagctgcacttccagctgctgctgctcttccagagctactgcaagctgattggccaggtgcatgaggtgtcctccatgcctgagctgctgaacatgagccgggagctgagtgacctgaagaagcacctgaaggaggccagcgctgtgattgctgctgaccccctgtacagtgatggagcctggagcgagcccaccttcaccagcacagaagctgccatccagagcatgctggagtgcctgaagaacaatgagctgggcaaggccctgcggcagatccgggagtgccgcagcctgtggcccaatgacatcttcggcagcagcagtgatgatgaggtgcagaccctgctgaacatctacttccgccaccagaccctgggccagacaggcacctacgccctggtgggcagcaaccagagcctgacagagatctgcaccaagctgatggagctgaacatggagatccgggacatgatcagaagagcccagagctacagagtgctgaccaccttcctgcctgacagctctgtgtctggcaccagcctgtag

SEQ ID NO: 34403 - DNA, 3849 bp, Artificial Sequence
  Description of Artificial Sequence: Synthetic coding sequence
atgtctgctgtgctgtgctgcggccctgtgtttgacaacgtgggcctgagcccagatggctacctgtacaagtggctggacaacatcctggcctgccaggacctgcgggtgcaccagctgggctgtgaggtggtggtgctgctgctggagctgaacccagaccagatcaacctcttcaactgggccatcgaccgctgctacacaggcagctaccagctggccagcggctgcttcaaggccatcgccaccgtgtgtggcagcaggaactacccctttgacatcgtgaccctgctgaacctggtgctcttcaaggccagtgacaccaaccgggagatctatgagatctccatgcagctgatgcagatcctggaggccaagctgtttgtgtacagcaagaaggtggccgagcagaggcctggcagcatcctgtatggcacccacggccccctgccccccctgtacagcgtgtccctggccctgctgagctgtgagctggccaggatgtacccagagctgaccctgcccctcttcagcggcaagccagccatcccccacaacaccccccagagggccccagaccacgcctacctgcctgctgccctggccgcccagcacagagctgggggccagcaggcccctcctcctggcagccccagcagcccagaagatgaggtgaaggaccgggagggagatgtgacagccagccacggcctgcggggaaatggctggggcagccctgaggccaccagcctggtgctgaacaacctgatgtacatgacagccaagtatggagatgaggtgcccggccctgagatggagaatgcctggaatgccctggccaacaatgagaagtggagcaacaacctgcgcatcaccctgcagttcctgatcagcctgtgtggggtgtccagtgacacagtgctgctgccctacatcaagaaggtggccatctacctgtgcaggaacaacaccatccagaccatggaggagctgctgtttgagctgcagcagacagagcctgtgaaccccatcgtgcagcactgtgacaacccccccttctaccgcttcaccgccagcagcaaggccagcgctgctgccagcggcaccaccagcagcagcaacacagtggtggccggccaggagaacttcccagatgctgaggagaacaagatcctgaaggagagtgatgagcgcttcagcaatgtcatccgggcccacacccggctggagagccgctacagcaacagcagcggcggcagctatgatgaggacaagaatgaccccatcagcccctacacaggctggctgctgaccatcacagagaccaagcagccccagcccctgcccatgccctgcacaggaggctgctgggcccccctggtggactacctgcctgagaccatcaccccccggggccccctgcaccgctgcaacattgctgtgatcttcatgacagagatggtggtggaccacagcgtgcgggaggactgggccctgcacctgcccctgctgctgcatgctgtgttcctgggcctggaccactacagacctgaggtgtttgagcacagcaagaagctgctgctgcacctgctgattgccctgagctgcaacagcaacttccacagcatcgcctctgtgctgctgcagacccgggagatgggagaggccaagaccctgactgtgcagcctgcctaccagcctgagtacctgtacacaggaggctttgacttcctgcgggaggaccagagcagccctgtgcctgattctggcctgagcagcagcagcaccagcagcagcatcagcctgggcggcagcagcggcaacctgccccagatgacccaggaggtggaggatgtggacacagctgctgagacagatgagaaggccaacaagctgattgagttcctgaccacccgggccttcggccccctgtggtgccacgaggacatcacccccaagaaccagaacagcaagtctgctgagcagctgaccaacttcctgcggcacgtggtgtctgtgttcaaggacagcaagagcggcttccacctggagcaccagctgtctgaggtggccctgcagacagccctggccagcagcagccgccactacgccggccgctccttccagatcttccgggccctgaagcagcccctgagcgcccacgccctgagtgacctgctgagccggctggtggaggtgattggagaacatggagatgagatccagggctacgtgatggaggccctgctgaccctggaggccgctgtggacaacctgagtgactgcctgaagaacagcgacctgctgactgtgctgagccgcagcagcagcccagacctgagcagcagcagcaagctgacagccagcaggaagagcacaggccagctgaacatgaaccctggcaccaccagcggcaacacagccacagctgagaggagccgccaccagaggagcttctctgtgcccaagaagtttggagtcatcgacaggagcagtgacccccccaggtctgccaccctggaccgcatccaggcctgcacccagcagggcctgagcagcaagaccaggagcagcagcagcctgaaggacagcctgacagaccccagccacatcaaccaccccaccaacctgctggccaccatcttctgggtgacagtggccctgatggagagtgactttgaatttgagtacctgatggccctgcggctgctgagccggctgctggcccacatgcccctggacaaggcagaaaatcgggagaagctggagaagctgcaggcccagctgaagtgggccgacttcagcggcctgcagcagctgctgctgaagggcttcaccagcctgaccaccacagacctgaccctgcagctgttcagcctgctgacccctgtgtccaagatctccatggtggatgccagccacgccatcggcttccccctgaatgtgctgtgcctgctgccccagctgatccagcactttgagaaccccaaccagttctgcaaggacattgctgagagaattgcccaggtgtgcctggaggagaagaaccccaagctgagcaacctggcccacgtgatgaccctgtacaagacccacagctacacccgggactgtgccacctgggtgaatgtggtgtgccgctacctgcacgaggcctatgctgacatcaccctgaacatggtgacctacctggccgagctgctggagaagggcctgcccagcgtgcagcagcccctgctgcaggtgatctacagcctgctgagctacatggacctgtctgtggtgcctgtgaagcagttcaacgtggaggtgctgaagaccatcgagaagtatgtgcagcacagcgacctgagcaagattgagatccaccgggtgtggaccagcgccagcaaggagctgcccgggaagaccctggacttccactttgacatcagcgagacccccatcatcggccgccgctatgatgagctgcagaacagcagcggcagagatggcaagccccgggccatggctgtgaccaggagcaccagcagcaccagcagcggcagcaacagcaatgtgctggtgcctgtgtcctggaagaggccccagtacagccagaagaggaccaaggagaagctggtgcacgtgctgagcctgtgtggccaggaggtgggcctgagcaagaaccccagcgtcatcttcagcagctgtggggacctggacctgctggagcaccagaccagcctggtgtccagtgaagatggagcccgggagcaggagaacatggatgacaccaacagcgagcagcagttccgggtcttccgggactttgacttcctggatgtggagctggaggatggagagtag

SEQ ID NO: 34404 - DNA, 453 bp, Artificial Sequence
  Description of Artificial Sequence: Synthetic coding sequence
atggagatcaccacagcctgctggaggaggagctgtgtgatctccttcatcaagggcctggccagccctgtgggcaatggctacatcaagccccctgtgcccccagccagcggcacccaccgggagaagggcccccccaccatgctgcccatcaacgtggaccctgacagcaagccaggagaatatgtgctgaagagcctgtttgtgaacttcaccacccaggccgagaggaagatccgcatcatcatggccgagcccctggagaagcccctgaccaagagcctgcagagaggagaggacccccagtttgaccaggtgatcagctccatgagcagcctgtctgagtactgcctgcccagcatcctgcggaccctgtttgactggtacaagaggcagaatggaattgaagatgagagccatgagtaccggcccaggaccagcaacaagagctag

SEQ ID NO: 34405 - DNA, 1152 bp, Artificial Sequence
  Description of Artificial Sequence: Synthetic coding sequence
atgacagaaggagaggagaagggcaacagagccctggaccagttcaccctggccagctttggagagggggaccggggcgtgtccccaccacccagccccttcttcagcgccatcctggccgccttccagcctgctgcctgtgatgatgctgaggaggcctggaggagccacatcaaccagctgatgtgtgacagtgatggcagctgtgctgtgtacaccttccacgtgttcagcagcctcttcaagaacatccagaagcgcttctgcttcctgacctgtgatgctgccagctacctgggggacaacctgcggggcatcggcagcaagtttgtgagcagcagccagatgctgaccagctgcagcgagtgccccaccctgtttgtggatgctgagaccctgctgagctgtggcctgctggacaagctgaagttctctgtgctggagctgcaggagtacctggacacctacaacaacaggaaggaggccaccctgtcctggctggccaactgcaaggccacctttgctgggggcagcagagatggagtcatcacctgccagcccggggacagcgaggagaagcagctggagctgtgccagaggctgtacaagctgcacttccagctgctgctgctcttccagagctactgcaagctgattggccaggtgcatgaggtgtcctccatgcctgagctgctgaacatgagccgggagctgagtgacctgaagaagcacctgaaggaggccagcgctgtgattgctgctgaccccctgtacagtgatggagcctggagcgagcccaccttcaccagcacagaagctgccatccagagcatgctggagtgcctgaagaacaatgagctgggcaaggccctgcggcagatccgggagtgccgcagcctgtggcccaatgacatcttcggcagcagcagtgatgatgaggtgcagaccctgctgaacatctacttccgccaccagaccctgggccagacaggcacctacgccctggtgggcagcaaccagagcctgacagagatctgcaccaagctgatggagctgaacatggagatccgggacatgatcagaagagcccagagctacagagtgctgaccaccttcctgcctgacagctctgtgtctggcaccagcctgtag

SEQ ID NO: 34406 - DNA, 270 bp, Artificial Sequence
  Description of Artificial Sequence: Synthetic coding sequence
atggagcgggtgaccctggccctgctgctgctggccggcctgacagccctggaggccaatgacccctttgccaacaaggatgaccccttctactatgactggaagaacctgcagctgagcggcctcatctgtggcggcctgctggccatcgccggcattgctgctgtgctgagcggcaagtgcaagtgcaagagcagccagaagcagcacagccctgtgcctgagaaggccatccccctcatcaccccaggcagcgccaccacctgctag

SEQ ID NO: 34407 - DNA, 270 bp, Artificial Sequence; identical to SEQ ID NO: 34406
  Description of Artificial Sequence: Synthetic coding sequence

SEQ ID NO: 34408 - DNA, 2340 bp, Artificial Sequence
  Description of Artificial Sequence: Synthetic coding sequence
atgctgaccaacctgcgcatctttgccatgagccaccagaccatccccagcgtgtacatcaacaacatctgctgctacaagatccgggccagcctgaagaggctgaagccccacgtgcccctgggcaggaactgcagcagcctgcccggcctgattggaaatgacatcaagagcctgcacagcatcatcaacccccccatcgccaagatcagaaatattggcatcatggcccacattgatgctgggaagaccaccaccacagagcgcatcctgtactacagcggctacaccaggagcctgggagatgtggatgatggagacacagtgacagacttcatggcccaggagcgggagcggggcatcaccatccagagcgctgctgtgacctttgactggaagggctacagagtgaacctgattgacaccccaggccacgtggacttcaccctggaggtggagcgctgcctgcgggtgctggatggagctgtggccgtgtttgatgccagcgctggggtggaggcccagaccctgactgtgtggaggcaggccgacaagcacaacatcccccgcatctgcttcctgaacaagatggacaagacaggagccagcttcaagtatgctgtggagagcatccgggagaagctgaaggccaagcccctgctgctgcagctgcccatcggggaggccaagaccttcaagggcgtggtggatgtggtgatgaaggagaagctgctgtggaactgcaacagcaatgatggcaaggactttgagaggaagcccctgctggagatgaatgaccctgagctgctgaaggagaccacagaggccagaaatgccctgattgagcaggtggccgacctggatgatgaatttgctgacctggtgctggaggagttctctgaaaattttgacctgctgcctgctgagaagctgcagacagccatccaccgggtgaccctggcccagacagctgtgcctgtgctgtgtggcagcgccctgaagaacaagggcatccagcccctgctggatgctgtgaccatgtacctgcccagccctgaggagagaaattatgagttcctgcagtggtacaaggatgacctgtgtgccctggccttcaaggtgctgcatgacaagcagaggggccccctggtgttcatgaggatctacagcggcaccatcaagccccagctggccatccacaacatcaatggaaactgcacagagcgcatcagccggctgctgctgccctttgctgaccagcacgtggagatccccagcctgacagctggcaacatcgccctgactgtgggcctgaagcacacagccactggagacaccatcgtgagcagcaagagcagcgccctggccgccgccaggagagctgagcgggagggggagaagaagcaccggcagaacaatgaagctgagcggctgctgctggccggcgtggagatccctgagcccgtcttcttctgcaccatcgagccccccagcctgagcaagcagcctgacctggagcacgccctgaagtgcctgcagcgggaggaccccagcctgaaggtgcggctggaccctgattctggccagacagtgctgtgtggcatgggagagctgcacatcgagatcatccatgaccgcatcaagcgggagtatggcctggagacctacctgggccccctgcaggtggcctaccgggagaccatcctgaacagcgtgcgggccacagacaccctggacaggaccctgggggacaagaggcacctggtgacagtggaggtggaggcccggcccatcgagaccagctctgtgatgcctgtgattgaatttgaatatgcagagagcatcaatgaaggcctgctgaaggtgtcccaggaggccattgaaaatggcatccacagcgcctgcctgcagggccccctgctgggcagccccatccaggatgtggccatcaccctgcacagcctgaccatccaccctggcaccagcaccaccatgatcagcgcctgtgtgagccgctgtgtgcagaaggccctgaagaaggctgacaagcaggtgctggagcccctgatgaacctggaggtgacagtggcccgggactacctgagccctgtgctggccgacctggcccagaggcggggcaacatccaggagatccagacccggcaggacaacaaggtggtgattggatttgtgcccctggccgagatcatgggctacagcacagtgctgcggaccctgaccagcggcagcgccacctttgccctggagctgagcacctaccaggccatgaacccccaggaccagaacaccctgctgaacagaagaagtggcctgacctag

SEQ ID NO: 34409 - DNA, 2199 bp, Artificial Sequence
  Description of Artificial Sequence: Synthetic coding sequence
atgctgaccaacctgcgcatctttgccatgagccaccagaccatccccagcgtgtacatcaacaacatctgctgctacaagatccgggccagcctgaagaggctgaagccccacgtgcccctgggcaggaactgcagcagcctgcccggcctgattggaaatgacatcaagagcctgcacagcatcatcaacccccccatcgccaagatcagaaatattggcatcatggcccacattgatgctgggaagaccaccaccacagagcgcatcctgtactacagcggctacaccaggagcctgggagatgtggatgatggagacacagtgacagacttcatggcccaggagcgggagcggggcatcaccatccagagcgctgctgtgacctttgactggaagggctacagagtgaacctgattgacaccccaggccacgtggacttcaccctggaggtggagcgctgcctgcgggtgctggatggagctgtggccgtgtttgatgccagcgctggggtggaggcccagaccctgactgtgtggaggcaggccgacaagcacaacatcccccgcatctgcttcctgaacaagatggacaagacaggagccagcttcaagtatgctgtggagagcatccgggagaagctgaaggccaagcccctgctgctgcagctgcccatcggggaggccaagaccttcaagggcgtggtggatgtggtgatgaaggagaagctgctgtggaactgcaacagcaatgatggcaaggactttgagaggaagcccctgctggagatgaatgaccctgagctgctgaaggagaccacagaggccagaaatgccctgattgagcaggtggccgacctggatgatgaatttgctgacctggtgctggaggagttctctgaaaattttgacctgctgcctgctgagaagctgcagacagccatccaccgggtgaccctggcccagacagctgtgcctgtgctgtgtggcagcgccctgaagaacaagggcatccagcccctgctggatgctgtgaccatgtacctgcccagccctgaggagagaaattatgagttcctggagcgcatcagccggctgctgctgccctttgctgaccagcacgtggagatccccagcctgacagctggcaacatcgccctgactgtgggcctgaagcacacagccaccggggacaccatcgtgagcagcaagagcagcgccctggccgccgcccggcgggcagagcgggagggggagaagaagcaccggcagaacaatgaggccgagcggctgctgctggccggcgtggagatccctgagcctgtgttcttctgcaccatcgagccccccagcctgagcaagcagcctgacctggagcacgccctgaagtgcctgcagcgggaggaccccagcctgaaggtgcggctggaccctgacagcggccagacagtgctgtgtggcatgggagagctgcacatcgagatcatccatgaccgcatcaagcgggagtatggcctggagacctacctgggccccctgcaggtggcctaccgggagaccatcctgaacagcgtgcgggccacagacaccctggacaggaccctgggggacaagaggcacctggtgacagtggaggtggaggcccggcccatcgagaccagctctgtgatgcctgtgattgaatttgaatatgcagagagcatcaatgaaggcctgctgaaggtgtcccaggaggccattgaaaatggcatccacagcgcctgcctgcagggccccctgctgggcagccccatccaggatgtggccatcaccctgcacagcctgaccatccaccctggcaccagcaccaccatgatcagcgcctgtgtgagccgctgtgtgcagaaggccctgaagaaggctgacaagcaggtgctggagcccctgatgaacctggaggtgacagtggcccgggactacctgagccctgtgctggccgacctggcccagaggcggggcaacatccaggagatccagacccggcaggacaacaaggtggtgattggatttgtgcccctggccgagatcatgggctacagcacagtgctgcggaccctgaccagcggcagcgccacctttgccctggagctgagcacctaccaggccatgaacccccaggaccagaacaccctgctgaacagaagaagtggcctgacctag

SEQ ID NO: 34410 - DNA, 1542 bp, Artificial Sequence
  Description of Artificial Sequence: Synthetic coding sequence
atgctgaccaacctgcgcatctttgccatgagccaccagaccatccccagcgtgtacatcaacaacatctgctgctacaagatccgggccagcctgaagaggctgaagccccacgtgcccctgggcaggaactgcagcagcctgcccggcctgattggaaatgacatcaagagcctgcacagcatcatcaacccccccatcgccaagatcagaaatattggcatcatggcccacattgatgctgggaagaccaccaccacagagcgcatcctgtactacagcggctacaccaggagcctgggagatgtggatgatggagacacagtgacagacttcatggcccaggagcgggagcggggcatcaccatccagagcgctgctgtgacctttgactggaagggctacagagtgaacctgattgacaccccaggccacgtggacttcaccctggaggtggagcgctgcctgcgggtgctggatggagctgtggccgtgtttgatgccagcgctggggtggaggcccagaccctgactgtgtggaggcaggccgacaagcacaacatcccccgcatctgcttcctgaacaagatggacaagacaggagccagcttcaagtatgctgtggagagcatccgggagaagctgaaggccaagcccctgctgctgcagctgcccatcggggaggccaagaccttcaagggcgtggtggatgtggtgatgaaggagaagctgctgtggaactgcaacagcaatgatggcaaggactttgagaggaagcccctgctggagatgaatgaccctgagctgctgaaggagaccacagaggccagaaatgccctgattgagcaggtggccgacctggatgatgaatttgctgacctggtgctggaggagttctctgaaaattttgacctgctgcctgctgagaagctgcagacagccatccaccgggtgaccctggcccagacagctgtgcctgtgctgtgtggcagcgccctgaagaacaagggcatccagcccctgctggatgctgtgaccatgtacctgcccagccctgaggagagaaattatgagttcctgcagtggtacaaggatgacctgtgtgccctggccttcaaggtgctgcatgacaagcagaggggccccctggtgttcatgaggatctacagcggcaccatcaagccccagctggccatccacaacatcaatggaaactgcacagagcgcatcagccggctgctgctgccctttgctgaccagcacgtggagatccccagcctgacagctggcaacatcgccctgactgtgggcctgaagcacacagccactggagacaccatcgtgagcagcaagagcagcgccctggccgccgccaggagagctgagcgggagggggagaagaagcaccggcagaacaatgaagctgagcggctgctgctggccggcgtggagatccctgagcccgtcttcttctgcaccatcgagccccccagcctgagcaagcagcccggcatcaatggcctgtctgtgtccaccaactag

SEQ ID NO: 34411 - DNA, 2340 bp, Artificial Sequence; identical to SEQ ID NO: 34408
  Description of Artificial Sequence: Synthetic coding sequence

SEQ ID NO: 34412 - DNA, 1806 bp, Artificial Sequence
  Description of Artificial Sequence: Synthetic coding sequence
atgctgaccaacctgcgcatctttgccatgagccaccagaccatccccagcgtgtacatcaacaacatctgctgctacaagatccgggccagcctgaagaggctgaagccccacgtgcccctgggcaggaactgcagcagcctgcccggcctgattggaaatgacatcaagagcctgcacagcatcatcaacccccccatcgccaagatcagaaatattggcatcatggcccacattgatgctgggaagaccaccaccacagagcgcatcctgtactacagcggctacaccaggagcctgggagatgtggatgatggagacacagtgacagacttcatggcccaggagcgggagcggggcatcaccatccagagcgctgctgtgacctttgactggaagggctacagagtgaacctgattgacaccccaggccacgtggacttcaccctggaggtggagcgctgcctgcgggtgctggatggagctgtggccgtgtttgatgccagcgctggggtggaggcccagaccctgactgtgtggaggcaggccgacaagcacaacatcccccgcatctgcttcctgaacaagatggacaagacaggagccagcttcaagtatgctgtggagagcatccgggagaagctgaaggccaagcccctgctgctgcagctgcccatcggggaggccaagaccttcaagggcgtggtggatgtggtgatgaaggagaagctgctgtggaactgcaacagcaatgatggcaaggactttgagaggaagcccctgctggagatgaatgaccctgagctgctgaaggagaccacagaggccagaaatgccctgattgagcaggtggccgacctggatgatgaatttgctgacctggtgctggaggagttctctgaaaattttgacctgctgcctgctgagaagctgcagacagccatccaccgggtgaccctggcccagacagctgtgcctgtgctgtgtggcagcgccctgaagaacaagggcatccagcccctgctggatgctgtgaccatgtacctgcccagccctgaggagagaaattatgagttcctgcagtggtacaaggatgacctgtgtgccctggccttcaaggtgctgcatgacaagcagaggggccccctggtgttcatgaggatctacagcggcaccatcaagccccagctggccatccacaacatcaatggaaactgcacagagcgcatcagccggctgctgctgccctttgctgaccagcacgtggagatccccagcctgacagctggcaacatcgccctgactgtgggcctgaagcacacagccactggagacaccatcgtgagcagcaagagcagcgccctggccgccgccaggagagctgagcgggagggggagaagaagcaccggcagaacaatgaagctgagcggctgctgctggccggcgtggagatccctgagcccgtcttcttctgcaccatcgagccccccagcctgagcaagcagcctgacctggagcacgccctgaagtgcctgcagcgggaggaccccagcctgaaggtgcggctggaccctgattctggccaggtggcccagaggcggggcaacatccaggagatccagacccggcaggacaacaaggtggtgattggatttgtgcccctggccgagatcatgggctacagcacagtgctgcggaccctgaccagcggcagcgccacctttgccctggagctgagcacctaccaggccatgaacccccaggaccagaacaccctgctgaacagaagaagtggcctgacctag

SEQ ID NO: 34413 - DNA, 948 bp, Artificial Sequence
  Description of Artificial Sequence: Synthetic coding sequence
atggccagcgctgtgctgagctctgtgcccaccacagccagcagatttgccctgctgcaggtggacagcggcagcggcagtgacagcgagcctggaaaaggaaaaggaagaaacacaggcaagagccagaccctgggcagcaagagcaccaccaatgagaagaagcgggagaagaggaggaagaagaaggagcagcagcagagcgaggccaatgagctgaggaacctggccttcaagaagatcccccagaagagcagccatgctgtgtgcaatgcccagcacgacctgcccctgagcaaccctgtgcagaaggacagccgggaggagaactggcaggagtggaggcagagagatgagcagctgaccagcgagatgtttgaggccgacctggagaaggccctgctgctgagcaagctggagtatgaggagcacaagaaggagtatgaagatgctgagaacaccagcacccagagcaaggtgatgaacaagaaggacaagaggaagaaccaccagggcaaggaccggcccctgactgtgtccctgaaggacttccacagcgaggaccacatcagcaagaagacagaggaggtggtgctgaaggatggccgcatcgagcggctgaagctggagctggagaggaaggatgctgagatccagaagctgaagaatgtcatcacccagtgggaggccaagtacaaggaggtgaaggccagaaatgcccagctgctgaagatgctgcaggagggggagatgaaggacaaggccgagatcctgctgcaggtggatgagagccagagcatcaagaatgagctgaccatccaggtgaccagcctgcacgccgccctggagcaggagaggagcaaggtgaaggtgctgcaggccgagctggccaagtaccagggcggcaggaagggcaagagaaattctgagagtgaccagtgcaggtag

SEQ ID NO: 34414 - DNA, 1101 bp, Artificial Sequence
  Description of Artificial Sequence: Synthetic coding sequence
atggccagcgctgtgctgagctctgtgcccaccacagccagcagatttgccctgctgcaggtggacagcggcagcggcagtgacagcgagcctggaaaaggaaaaggaagaaacacaggcaagagccagaccctgggcagcaagagcaccaccaatgagaagaagcgggagaagaggaggaagaagaaggagcagcagcagagcgaggccaatgagctgaggaacctggccttcaagaagatcccccagaagagcagccatgctgtgtgcaatgcccagcacgacctgcccctgagcaaccctgtgcagaaggacagccgggaggagaactggcaggagtggaggcagagagatgagcagctgaccagcgagatgtttgaggccgacctggagaaggccctgctgctgagcaagctggagtatgaggagcacaagaaggagtatgaagatgctgagaacaccagcacccagagcaaggtgatgaacaagaaggacaagaggaagaaccaccagggcaaggaccggcccctgactgtgtccctgaaggacttccacagcgaggaccacatcagcaagaagacagaggagctgagcagcagccagaccctgagccatgatggcggcttcttcaaccggctggaggatgatgtgcacaagatcctgatccgggagaagaggcgggagcagctgacagagtacaacggcacagacaactgcacagcccacgagcacaaccaggaggtggtgctgaaggatggaagaattgagcggctgaagctggagctggagaggaaggatgctgagatccagaagctgaagaatgtcatcacccagtgggaggccaagtacaaggaggtgaaggccagaaatgcccagctgctgaagatgctgcaggagggggagatgaaggacaaggccgagatcctgctgcaggtggatgagagccagagcatcaagaatgagctgaccatccaggtgaccagcctgcatgctgccctggagcaggagaggagcaaggtgaaggtgctgcaggccgagctggccaagtaccagggcggcaggaagggcaagaggaacagcgagagtgaccagtgcaggtag

SEQ ID NO: 34415 - DNA, 381 bp, Artificial Sequence
  Description of Artificial Sequence: Synthetic coding sequence
atggccagcgctgtgctgagctctgtgcccaccacagccagcagatttgccctgctgcaggtggacagcggcagcggcagtgacagcgagcctggaaaaggaaaaggaagaaacacaggcaagagccagaccctgggcagcaagagcaccaccaatgagaagaagcgggagaagaggaggaagaagaaggagcagcagcagagcgaggccaatgagctgaggaacctggccttcaagaagatcccccagaagagcagccatgctgtgtgcaatgcccagcacgacctgcccctgagcaaccctgtgcagaaggacagccgggaggagaactggcaggagtggaggcagagagatgagcagatgggcagccggcggcagtag

SEQ ID NO: 34416 - DNA, 165 bp, Artificial Sequence
  Description of Artificial Sequence: Synthetic coding sequence
atggccagcgctgtgctgagctctgtgcccaccacagccagcagatttgccctgctgcaggtggacagcggcagcggcagtgacagcgagcctggaaaaggaaaaggaagaaacacaggcaagagccagaccctgggcagcaagagcaccaccaatgagaagtag

SEQ ID NO: 34417 - DNA, 3027 bp, Artificial Sequence
  Description of Artificial Sequence: Synthetic coding sequence
atggacacagcagaagatcctgcctggctgcagctgctgcagaaggacagcagccccccaggcccccggcccacagccttcttctgcccccaggacggcagcctgggcgccggcagcagcgccatgagggactactgccccagccagcagaaggccagccctgccccacccaggcacaccccagaccagagccctggcatggagagccgccacaggagccccagcggggccggggagggcgccagctgcagtgatggcccccggggcagcctggcctgccccagccccacctgcttcagcccccaggagagccccagcaaggagaccctggaggcccatggagccagcatcagcggcaccccagaggccaccaccagcggcaagccagagcctgtgtcctctgtgaagacagagcccaagagcagtgatgacaggaaccccatgttcctggagaagatggacttcaagagcagcaagcaggccgacagcaccagcatcggcaaggaggaccccggcagcagcaggaaggctgaccccatgttcaccgggaaggccgagcctgagatcctgggcaagggggaccctgtggcccctggccgcatggaccccatgacagtgaggaaagaagacctgggcagcctgggcaaggtggaccccctgtgcagcagcaagacctacacagtgagccccaggaaagaagatcctggcagcctgaggaaggtggaccctgtgtccagtgacaaggtggaccctgtgttccccaggaaggaggagccccgctacagcggcaaggagcaccctgtgagcagcgagaaggtggcccccaccagcgctgagaaggtggacctggtgctgagcggcaagagggaccccggccccagcggcaaggctgaccccatgcccctggagagcatggattctgccagcacaggcaagacagagcccggcctgctgggcaagctgatccctggcagcagcggcaagaatggacctgtgagcagcggcaccggggcccctggcagcctgggccgcctggaccccacctgcctgggcatggctgaccctgcctctgtgggcaatgtggagaccgtgcctgccaccaaggaggacagccgcttcctgggcaagatggaccctgccagcagcggggagggccggcctgtgtctggccacacagacaccacagccagcgccaagacagacctgaccagcctgaagaatgtggaccccatgagcagcggcaaggtggaccctgtgtccctgggcaagatggaccccatgtgcagcggcaagccagagctgctgagccctggccaggccgagcgggtgtctgtgggcaaggccggcaccgtgtccccaggcaaggaggaccctgtgagcagccggcgggaggaccccatctctgctggcagcaggaagaccagcagcgagaaggtgaaccctgagagcagcggcaagaccaaccctgtgagcagcggccctggggaccccaggagcctgggcacagctggccccccatctgctgtgaaggccgagcccgccactggaggcaagggggaccccctgagcagcgagaaggccggcctggtggccagcggcaaggccgcccccacagccagcggcaaggccgagcccctggccgtgggcaaggaggaccctgtgtccaagggcaaggcagatgctggccccagcggccagggcgacagcgtgtccatcggcaaggtggtgtccaccccaggcaagacagtgcctgtgcccagcggcaaggtggaccctgtgtccctgggcaaggccgaggccatccctgagggcaaggtgggcagcctgcccctggagaagggcagccctgtgaccaccaccaaggctgacccccgggccagcggcaaggcccagccccagagcggcggcaaggccgagaccaagctgcccggccaggagggcgctgctgcccctggagaggccggggctgtgtgcctgaagaaggagaccccccaggccagcgagaaggtggaccccggcagctgcaggaaggccgagcccctggccagcgggaaaggagagcctgtgtccctgggcaaggctgacagcgcccccagcaggaagacagagagccccagcctgggcaaggtggtgcccctgagcctggagaagaccaagcccagcagcagcagccggcagctggacaggaaggccctgggcagcgcccggagccctgagggcgcccggggcagcgagggccgggtggagcccaaggccgagcctgtgagcagcacagaggccagcagcctgggccagaaggacctggaggccgccggggctgagaggagcccctgcccagaggccgccgcccctcctcctggccccaggacccgggacaacttcaccaaggcccccagctgggaggccagcgcccctcctccaccccgggaggatgctggcacccaggccggggcccaggcctgtgtgtctgtggccgtgagccccatgagcccccaggatggagctgggggcagcgccttctccttccaggccgccccccgggcccccagcccccccagcagaagagatgctggcctgcaggtgtccctgggcgctgctgagaccaggtctgtggccaccggccccatgaccccccaggccgccgcccccccagccttccctgaggtgcgggtgcggcccggcagcgccctggccgctgctgtggcccctcctgagcctgctgagcctgtgagagatgtgtcctgggatgagaagggcatgacctgggaggtgtatggagctgccatggaggtggaggtgctgggcatggccatccagaagcacctggagcggcagatcgaggagcacggccggcagggcgccccagcccctcctcctgctgcccgggccggccctggccgcagcggctctgtgaggacagcccccccagatggagctgccaagaggcctcctggcctcttccgggccctgctgcagagcgtgagaagaccccgctgctgcagcagagctggccccacagctgagtag

SEQ ID NO: 34418 - DNA, 2397 bp, Artificial Sequence
  Description of Artificial Sequence: Synthetic coding sequence
atggacacagcagaagatcctgcctggctgcagctgctgcagaaggacagcagccccccaggcccccggcccacagccttcttctgcccccaggacggcagcctgggcgccggcagcagcgccatgagggactactgccccagccagcagaaggccagccctgccccacccaggcacaccccagaccagagccctggcatggagagccgccacaggagccccagcggggccggggagggcgccagctgcagtgatggcccccggggcagcctggcctgccccagccccacctgcttcagcccccaggagagccccagcaaggagaccctggaggcccatggagccagcatcagcggcaccccagaggccaccaccagcggcaagccagagcctgtgtcctctgtgaagacagagcccaagagcagtgatgacaggaaccccatgttcctggagaagatggacttcaagagcagcaagcaggccgacagcaccagcatcggcaaggaggaccccggcagcagcaggaaggctgaccccatgttcaccgggaaggccgagcctgagatcctgggcaagggggaccctgtggcccctggccgcatggaccccatgacagtgaggaaagaagacctgggcagcctgggcaaggtggaccccctgtgcagcagcaagacctacacagtgagccccaggaaagaagatcctggcagcctgaggaaggtggaccctgtgtccagtgacaaggtggaccctgtgttccccaggaaggaggagccccgctacagcggcaaggagcaccctgtgagcagcgagaaggtggcccccaccagcgctgagaaggtggacctggtgctgagcggcaagagggaccccggccccagcggcaaggctgaccccatgcccctggagagcatggattctgccagcacaggcaagacagagcccggcctgctgggcaagctgatccctggcagcagcggcaagaatggacctgtgagcagcggcaccggggcccctggcagcctgggccgcctggaccccacctgcctgggcatggctgaccctgcctctgtgggcaatgtggagaccgtgcctgccaccaaggaggacagccgcttcctgggcaagatggaccctgccagcagcggggagggccggcctgtgtctggccacacagacaccacagccagcgccaagacagacctgaccagcctgaagaatgtggaccccatgagcagcggcaaggtggaccctgtgtccctgggcaagatggaccccatgtgcagcggcaagccagagctgctgagccctggccaggccgagcgggtgtctgtgggcaaggccggcaccgtgtccccaggcaaggaggaccctgtgagcagccggcgggaggaccccatctctgctggcagcaggaagaccagcagcgagaaggtgaaccctgagagcagcggcaagaccaaccctgtgagcagcggccctggggaccccaggagcctgggcacagctggccccccatctgctgtgaaggccgagcccgccactggaggcaagggggaccccctgagcagcgagaaggccggcctggtggccagcggcaaggccgcccccacagccagcggcaaggccgagcccctggccgtgggcaaggaggaccctgtgtccaagggcaaggcagatgctggccccagcggccagggcgacagcgtgtccatcggcaaggtggtgtccaccccaggcaagacagtgcctgtgcccagcggcaaggtggaccctgtgtccctgggcaaggccgaggccatccctgagggcaaggtgggcagcctgcccctggagaagggcagccctgtgaccaccaccaaggctgacccccgggccagcggcaaggcccagccccagagcggcggcaaggccgagaccaagctgcccggccaggagggcgctgctgcccctggagaggccggggctgtgtgcctgaagaaggagaccccccaggccagcgagaaggtggaccccggcagctgcaggaaggccgagcccctggccagcgggaaaggagagcctgtgtccctgggcaaggctgacagcgcccccagcaggaagacagagagccccagcctgggcaaggtggtgcccctgagcctggagaagaccaagcccagcagcagcagccggcagctggacaggaaggccctgggcagcgcccggagccctgagggcgcccggggcagcgagggccggcaggccagcgcccggcctgtgcccagggctgctgctgaatgtgccccagctgctgtgctgctggccggcggcacccacggccgggtcatctgcccccactttgtgcggcccagcttccggcccagccaggcccccttcctgatcaccggcccctag

SEQ ID NO: 34419 - DNA, 1659 bp, Artificial Sequence
  Description of Artificial Sequence: Synthetic coding sequence
atggccgccctggcccctgtgggcagccctgccagccggggcccccggctggccgccggcctgcggctgctgcccatgctgggcctgctgcagctgctggccgagcccggcctgggccgggtgcaccacctggccctgaaggatgatgtgcgccacaaggtgcacctgaacaccttcggcttcttcaaggatggctacatggtggtgaatgtgagcagcctgagcctgaatgaacctgaggacaaggatgtgaccatcggcttcagcctggacaggaccaagaatgatggcttcagcagctacctggatgaagatgtgaactactgcatcctgaagaagcagagcgtgtctgtgaccctgctgatcctggacatcagccgctctgaggtgcgggtgaagagccccccagaggccggcacccagctgcccaagatcatcttcagcagagatgagaaggtgctgggccagagccaggagcccaacgtgaacccagccagcgctggcaaccagacccagaagacccaggacggcggcaagagcaagaggagcacagtggacagcaaggccatgggagagaagagcttctctgtgcacaacaacggcggcgctgtgtccttccagttcttcttcaacatcagcacagatgaccaggagggcctgtacagcctgtacttccacaagtgcctgggcaaggagctgcccagcgacaagttcaccttcagcctggacatcgagatcacagagaagaacccagacagctacctgtctgctggggagatccccctgcccaagctgtacatctccatggccttcttcttcttcctgagcggcaccatctggatccacatcctgaggaagagaagaaatgatgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggggccctgctcttcatcaccatcgccctgattggaacaggctgggccttcatcaagcacatcctgagtgacaaggacaagaagatcttcatgatcgtcatccccctgcaggtgctggccaacgtggcctacatcatcatcgagagcacagaggagggcaccacagaatatggcctgtggaaggacagcctcttcctggtggacctgctgtgctgcggggccatcctcttccctgtggtgtggagcatccgccacctgcaggaggccagcgccacagatggcaaggccgccatcaacctggccaagctgaagctgttccgccactactacgtgctgattgtgtgctacatctacttcacccgcatcatcgccttcctgctgaagctggccgtgcccttccagtggaagtggctgtaccagctgctggatgaaacagccaccctggtgttctttgtgctgaccggctacaagttccggcctgccagtgacaacccctacctgcagctgagccaggaggaggaggacctggagatggagagcgtggtgaccaccagcggcgtgatggagagcatgaagaaggtgaagaaggtgaccaatggatctgtggagccccagggcgagtgggagggcgctgtgtag

SEQ ID NO: 34420 - DNA, 1803 bp, Artificial Sequence
  Description of Artificial Sequence: Synthetic coding sequence
atggccgccctggcccctgtgggcagccctgccagccggggcccccggctggccgccggcctgcggctgctgcccatgctgggcctgctgcagctgctggccgagcccggcctgggccgggtgcaccacctggccctgaaggatgatgtgcgccacaaggtgcacctgaacaccttcggcttcttcaaggatggctacatggtggtgaatgtgagcagcctgagcctgaatgaacctgaggacaaggatgtgaccatcggcttcagcctggacaggaccaagaatgatggcttcagcagctacctggatgaagatgtgaactactgcatcctgaagaagcagagcgtgtctgtgaccctgctgatcctggacatcagccgctctgaggtgcgggtgaagagccccccagaggccggcacccagctgcccaagatcatcttcagcagagatgagaaggtgctgggccagagccaggagcccaacgtgaacccagccagcgctggcaaccagacccagaagacccaggacggcggcaagagcaagaggagcacagtggacagcaaggccatgggagagaagagcttctctgtgcacaacaacggcggcgctgtgtccttccagttcttcttcaacatcagcacagatgaccaggagggcctgtacagcctgtacttccacaagtgcctgggcaaggagctgcccagcgacaagttcaccttcagcctggacatcgagatcacagagaagaacccagacagctacctgtctgctggggagatccccctgcccaagctgtacatctccatggccttcttcttcttcctgagcggcaccatctggatccacatcctgaggaagagaagaaatgatgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggggccctgctcttcatcaccatcgccctgattggaacaggctgggccttcatcaagcacatcctgagtgacaaggacaagaagatcttcatgatcgtcatccccctgcaggtgctggccaacgtggcctacatcatcatcgagagcacagaggagggcaccacagaatatggcctgtggaaggacagcctcttcctggtggacctgctgtgctgcggggccatcctcttccctgtggtgtggagcatccgccacctgcaggaggccagcgccacagatggaaaaggagacagcatgggccccctgcagcagagggccaacctgcgggccggcagccgcatcgagagccaccactttgcccaggccgacctggagctgctggccagcagctgccccccagcctctgtgtcccagagagctggcatcacagctgccatcaacctggccaagctgaagctgttccgccactactacgtgctgattgtgtgctacatctacttcacccgcatcatcgccttcctgctgaagctggccgtgcccttccagtggaagtggctgtaccagctgctggatgaaacagccaccctggtgttctttgtgctgaccggctacaagttccggcctgccagtgacaacccctacctgcagctgagccaggaggaggaggacctggagatggagagcgtggtgaccaccagcggcgtgatggagagcatgaagaaggtgaagaaggtgaccaatggatctgtggagccccagggcgagtgggagggcgctgtgtag

SEQ ID NO: 34421 - DNA, 1716 bp, Artificial Sequence
  Description of Artificial Sequence: Synthetic coding sequence
atggccgccctggcccctgtgggcagccctgccagccggggcccccggctggccgccggcctgcggctgctgcccatgctgggcctgctgcagctgctggccgagcccggcctgggccgggtgcaccacctggccctgaaggatgatgtgcgccacaaggtgcacctgaacaccttcggcttcttcaaggatggctacatggtggtgaatgtgagcagcctgagcctgaatgaacctgaggacaaggatgtgaccatcggcttcagcctggacaggaccaagaatgatggcttcagcagctacctggatgaagatgtgaactactgcatcctgaagaagcagagcgtgtctgtgaccctgctgatcctggacatcagccgctctgaggtgcgggtgaagagccccccagaggccggcacccagctgcccaagatcatcttcagcagagatgagaaggtgctgggccagagccaggagcccaacgtgaacccagccagcgctggcaaccagacccagaagacccaggacggcggcaagagcaagaggagcacagtggacagcaaggccatgggagagaagagcttctctgtgcacaacaacggcggcgctgtgtccttccagttcttcttcaacatcagcacagatgaccaggagggcctgtacagcctgtacttccacaagtgcctgggcaaggagctgcccagcgacaagttcaccttcagcctggacatcgagatcacagagaagaacccagacagctacctgtctgctggggagatccccctgcccaagctgtacatctccatggccttcttcttcttcctgagcggcaccatctggatccacatcctgaggaagagaagaaatgatgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggggccctgctcttcatcaccatcgccctgattggaacaggctgggccttcatcaagcacatcctgagtgacaaggacaagaagatcttcatgatcgtcatccccctgcaggtgctggccaacgtggcctacatcatcatcgagagcacagaggagggcaccacagaatatggcctgtggaaggacagcctcttcctggtggacctgctgtgctgcggggccatcctcttccctgtggtgtggagcatccgccacctgcaggaggccagcgccacagatggaaaaggagacagcatgggccccctgcagcagagggccaacctgcgggccggcagcagaattgctgccatcaacctggccaagctgaagctgttccgccactactacgtgctgattgtgtgctacatctacttcacccgcatcatcgccttcctgctgaagctggccgtgcccttccagtggaagtggctgtaccagctgctggatgaaacagccaccctggtgttctttgtgctgaccggctacaagttccggcctgccagtgacaacccctacctgcagctgagccaggaggaggaggacctggagatggagagcgtggtgaccaccagcggcgtgatggagagcatgaagaaggtgaagaaggtgaccaacggctctgtggagccccagggcgagtgggagggcgctgtgtag

SEQ ID NO: 34422 - DNA, 1140 bp, Artificial Sequence
  Description of Artificial Sequence: Synthetic coding sequence
atggccgccctggcccctgtgggcagccctgccagccggggcccccggctggccgccggcctgcggctgctgcccatgctgggcctgctgcagctgctggccgagcccggcctgggccgggtgcaccacctggccctgaaggatgatgtgcgccacaaggtgcacctgaacaccttcggcttcttcaaggatggctacatggtggtgaatgtgagcagcctgagcctgaatgaacctgaggacaaggatgtgaccatcggcttcagcctggacaggaccaagaatgatggcttcagcagctacctggatgaagatgtgaactactgcatcctgaagaagcagagcgtgtctgtgaccctgctgatcctggacatcagccgctctgaggtgcgggtgaagagccccccagaggccggcacccagctgcccaagatcatcttcagcagagatgagaaggtgctgggccagagccaggagcccaacgtgaacccagccagcgctggcaaccagacccagaagacccaggacggcggcaagagcaagaggagcacagtggacagcaaggccatgggagagaagagcttctctgtgcacaacaacggcggcgctgtgtccttccagttcttcttcaacatcagcacagatgaccaggagggcctgtacagcctgtacttccacaagtgcctgggcaaggagctgcccagcgacaagttcaccttcagcctggacatcgagatcacagagaagaacccagacagctacctgtctgctggggagatccccctgcccaagctgtacatctccatggccttcttcttcttcctgagcggcaccatctggatccacatcctgaggaagagaagaaatgatgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggggccctgctcttcatcaccatcgccctgattggaacaggctgggccttcatcaagcacatcctgagtgacaaggacaagaagatcttcatgatcgtcatccccctgcaggtgctgtag

SEQ ID NO: 34423 - DNA, 1632 bp, Artificial Sequence
  Description of Artificial Sequence: Synthetic coding sequence
atggctgtgtctgagcggcggggcctgggccggggcagccctgctgagtggggccagaggctgctgctggtgctgctgctgggcggctgcagcggccgcatccaccagctggccctgaccggggagaagagagctgacatccagctgaacagctttggcttctacaccaacggcagcctggaggtggagctgtctgtgctgcggctgggcctgcgggaggccgaggagaagagcctgctggtgggcttcagcctgagccgggtgcgcagcggccgggtgcgcagctacagcacccgggacttccaggactgccccctgcagaagaacagcagcagcttcctggtgctcttcctgatcaacaccaaggacctgcaggtgcaggtgaggaaatatggagagcagaagaccctcttcatcttccctggcctgctgcctgaggcccccagcaagccaggcctgcccaagccccaggccaccgtgcccaggaaggtggatggcggcggcaccagcgctgccagcaagcccaagagcaccccagctgtgatccagggccccagcggcaaggacaaggacctggtgctgggcctgagccacctgaacaacagctacaacttctccttccacgtggtgattggcagccaggccgaggagggccagtacagcctgaacttccacaactgcaacaacagcgtgcctgggaaggagcacccctttgacatcaccgtgatgatccgggagaagaacccagatggcttcctgtctgctgctgagatgcccctcttcaagctgtacatggtgatgtctgcctgcttcctggccgccggcatcttctgggtgtccatcctgtgcaggaacacctacagcgtcttcaagatccactggctgatggccgccctggccttcaccaagagcatcagcctgctcttccacagcatcaactactacttcatcaacagccagggccaccccatcgagggcctggccgtgatgtactacatcgcccacctgctgaagggggccctgctcttcatcaccatcgccctgattggcagcggctgggccttcatcaagtatgtgctgagtgacaaggagaagaaggtgtttggcatcgtcatccccatgcaggtgctggccaacgtggcctacatcatcatcgagagccgggaggagggcgccagtgactatgtgctgtggaaggagatcctcttcctggtggacctgatctgctgcggggccatcctcttccctgtggtgtggagcatccgccacctgcaggatgccagcggcacagatggcaaggtggccgtgaacctggccaagctgaagctgttccgccactactacgtgatggtgatctgctacgtgtacttcacccgcatcatcgccatcctgctgcaggtggccgtgcccttccagtggcagtggctgtaccagctgctggtggagggcagcaccctggccttctttgtgctgaccggctacaagttccagcccactggaaacaacccctacctgcagctgccccaggaggatgaagaagatgtgcagatggagcaggtgatgacagacagcggcttccgggagggcctgagcaaggtgaacaagacagccagcggccgggagctgctgtag

SEQ ID NO: 34424 - DNA, 906 bp, Artificial Sequence
  Description of Artificial Sequence: Synthetic coding sequence
atgatccgggagaagaacccagatggcttcctgtctgctgctgagatgcccctcttcaagctgtacatggtgatgtctgcctgcttcctggccgccggcatcttctgggtgtccatcctgtgcaggaacacctacagcgtcttcaagatccactggctgatggccgccctggccttcaccaagagcatcagcctgctcttccacagcatcaactactacttcatcaacagccagggccaccccatcgagggcctggccgtgatgtactacatcgcccacctgctgaagggggccctgctcttcatcaccatcgccctgattggcagcggctgggccttcatcaagtatgtgctgagtgacaaggagaagaaggtgtttggcatcgtcatccccatgcaggtgctggccaacgtggcctacatcatcatcgagagccgggaggagggcgccagtgactatgtgctgtggaaggagatcctcttcctggtggacctgatctgctgcggggccatcctcttccctgtggtgtggagcatccgccacctgcaggatgccagcggcacagatggcaaggtggccgtgaacctggccaagctgaagctgttccgccactactacgtgatggtgatctgctacgtgtacttcacccgcatcatcgccatcctgctgcaggtggccgtgcccttccagtggcagtggctgtaccagctgctggtggagggcagcaccctggccttctttgtgctgaccggctacaagttccagcccactggaaacaacccctacctgcagctgccccaggaggatgaagaagatgtgcagatggagcaggtgatgacagacagcggcttccgggagggcctgagcaaggtgaacaagacagccagcggccgggagctgctgtag

SEQ ID NO: 34425 - DNA, 2142 bp, Artificial Sequence
  Description of Artificial Sequence: Synthetic coding sequence
atggacatcagcatccagagaaatggcagcatcgtggccggctatgaggtggtgggcagcagcagcgccagcgagctgctgagcgccatcgagcacgtggccgagaaggccaagacagccctgcacaagctgttccccctggaggatggcagcttccgggtgtttgggaaggcccagtgcaatgacatcgtgtttggatttggcagcaaggatgatgagtacaccctgccctgcagcagcggctaccggggcaacatcacagccaagtgtgagagcagcggctggcaggtgatccgggagacctgtgtgctgagcctgctggaggagctgaacaagaacttctccatgattgtgggcaatgccacagaggccgctgtgagcagctttgtgcagaacctgagcgtcatcatccggcagaaccccagcaccaccgtgggcaacctggcctctgtggtgtccatcctgagcaacatcagcagcctgagcctggccagccacttccgggtgagcaacagcaccatggaggatgtgatcagcattgctgacaacatcctgaacagcgcctctgtgaccaactggacagtgctgctgcgggaggagaagtatgccagcagccggctgctggagaccctggagaacatcagcaccctggtgcccccaacagccctgcccctgaacttcagcaggaagttcatcgactggaagggcatccctgtgaacaagagccagctgaagaggggctacagctaccagatcaagatgtgcccccagaacaccagcatccccatccggggccgggtgctgattggaagtgaccagttccagaggagcctgcctgagaccatcatctccatggccagcctgaccctgggcaacatcctgcctgtgtccaagaatggaaatgcccaggtgaatggacctgtgatcagcaccgtcatccagaactacagcatcaatgaggtgttcctgttcttcagcaagattgagagcaacctgagccagccccactgtgtgttctgggacttcagccacctgcagtggaatgatgctggctgccacctggtgaatgagacccaggacatcgtgacctgccagtgcacccacctgaccagcttcagcatcctgatgagcccctttgtgcccagcaccatcttccctgtggtgaagtggatcacctacgtgggcctgggcatcagcatcggcagcctcatcctgtgcctgatcatcgaggccctcttctggaagcagatcaagaagagccagaccagccacacccggcgcatctgcatggtgaacatcgccctgagcctgctgattgctgatgtgtggttcatcgtgggcgccaccgtggacaccaccgtgaaccccagcggcgtgtgcacagctgctgtgttcttcacccacttcttctacctgagcctcttcttctggatgctgatgctgggcatcctgctggcctaccgcatcatcctggtgttccaccacatggcccagcacctgatgatggctgtgggcttctgcctgggctacggctgccccctcatcatcagcgtcatcaccatcgctgtgacccagcccagcaacacctacaagaggaaggatgtgtgctggctgaactggagcaatggcagcaagcccctgctggcctttgtggtgcctgccctggccatcgtggccgtgaactttgtggtggtgctgctggtgctgaccaagctgtggaggcccaccgtgggggagcggctgagcagagatgacaaggccaccatcatccgggtgggcaagagcctgctgatcctgacccccctgctgggcctgacctggggctttggaattggcaccatcgtggacagccagaacctggcctggcacgtgatctttgccctgctgaatgccttccagggcttcttcatcctgtgcttcggcatcctgctggacagcaagctgcggcagctgctcttcaacaagctgagcgccctgagctcctggaagcagacagagaagcagaacagcagtgacctgagcgccaagcccaagttcagcaagcccttcaaccccctgcagaacaagggccactacgccttcagccacactggagacagcagtgacaacatcatgctgacccagtttgtgtccaatgaatag

SEQ ID NO: 34426 - DNA, 657 bp, Artificial Sequence
  Description of Artificial Sequence: Synthetic coding sequence
atgaaggtgggcgtgctgtggctgatctccttcttcaccttcacagatggccacggcggcttcctgggcaagaatgatggcatcaagaccaagaaggagctgattgtgaacaagaagaagcacctgggccctgtggaggagtaccagctgctgctgcaggtgacctacagagacagcaaggagaagagggacctgaggaacttcctgaagctgctgaagccacccctgctgtggagccacggcctcatccgcatcatccgggccaaggccaccacagactgcaacagcctgaatggagtgctgcagtgcacctgtgaggacagctacacctggttcccccccagctgcctggacccccagaactgctacctgcacacagctggggccctgcccagctgtgagtgccacctgaacaacctgagccagagcgtgaacttctgtgagaggaccaagatctggggcaccttcaagatcaatgaacgcttcaccaatgacctgctgaacagcagcagcgccatctacagcaaatatgccaatggaattgagatccagctgaagaaggcctatgagcgcatccagggctttgaatctgtgcaggtgacccagttcaggatgagcctgctgagccccaagctggagtgcaatggcaccatctag

SEQ ID NO: 34427 - DNA, 1890 bp, Artificial Sequence
  Description of Artificial Sequence: Synthetic coding sequence
atgaaggtgggcgtgctgtggctgatctccttcttcaccttcacagatggccacggcggcttcctgggcaagaatgatggcatcaagaccaagaaggagctgattgtgaacaagaagaagcacctgggccctgtggaggagtaccagctgctgctgcaggtgacctacagagacagcaaggagaagagggacctgaggaacttcctgaagctgctgaagccacccctgctgtggagccacggcctcatccgcatcatccgggccaaggccaccacagactgcaacagcctgaatggagtgctgcagtgcacctgtgaggacagctacacctggttcccccccagctgcctggacccccagaactgctacctgcacacagctggggccctgcccagctgtgagtgccacctgaacaacctgagccagagcgtgaacttctgtgagaggaccaagatctggggcaccttcaagatcaatgaacgcttcaccaatgacctgctgaacagcagcagcgccatctacagcaaatatgccaatggaattgagatccagctgaagaaggcctatgagcgcatccagggctttgaatctgtgcaggtgacccagttcagaaatggcagcatcgtggccggctatgaggtggtgggcagcagcagcgccagcgagctgctgagcgccattgaacatgtggccgagaaggccaagacagccctgcacaagctgttccccctggaggatggcagcttccgggtgtttgggaaggcccagtgcaatgacatcgtgtttggcttcggcagcaaggatgatgagtacaccctgccctgcagcagcggctaccggggcaacatcacagccaagtgtgagagcagcggctggcaggtgatccgggagacctgtgtgctgagcctgctggaggagctgaacaagaacttctccatgattgtgggcaatgccacagaagctgctgtgtcctcctttgtgcagaacctgagcgtcatcatccggcagaaccccagcaccaccgtgggcaacctggcctctgtggtgtccatcctgagcaacatcagcagcctgagcctggccagccacttccgggtgagcaacagcaccatggaggatgtgatcagcattgctgacaacatcctgaacagcgcctctgtgaccaactggacagtgctgctgcgggaggagaagtatgccagcagccggctgctggagaccctggagaacatcagcaccctggtgcccccaacagccctgcccctgaacttcagcaggaagttcatcgactggaagggcatccctgtgaacaagagccagctgaagaggggctacagctaccagatcaagatgtgcccccagaacaccagcatccccatccggggccgggtgctgattggaagtgaccagttccagaggagcctgcctgagaccatcatctccatggccagcctgaccctgggcaacatcctgcctgtgtccaagaatggaaatgcccaggtgaatggacctgtgatcagcaccgtcatccagaactacagcatcaatgaggtgttcctgttcttcagcaagattgagagcaacctgagccagccccactgtgtgttctgggacttcagccacctgcagtggaatgatgctggctgccacctggtgaatgagacccaggacatcgtgacctgccagtgcacccacctgaccagcttcagcatcctgatgagcccctttgtgcccagcaccatcttccctgtggtgaagtggatcacctacgtgggcctgggcatcagcatcggcagcctcatcctgtgcctgatcatcgaggccctcttctggaagcagatcaagaagagccagaccagccacacccggcagaggaagaagaagcagtag

SEQ ID NO: 34428 - DNA, 2733 bp, Artificial Sequence
  Description of Artificial Sequence: Synthetic coding sequence
atgaaggtgggcgtgctgtggctgatctccttcttcaccttcacagatggccacggcggcttcctgggcaagaatgatggcatcaagaccaagaaggagctgattgtgaacaagaagaagcacctgggccctgtggaggagtaccagctgctgctgcaggtgacctacagagacagcaaggagaagagggacctgaggaacttcctgaagctgctgaagccacccctgctgtggagccacggcctcatccgcatcatccgggccaaggccaccacagactgcaacagcctgaatggagtgctgcagtgcacctgtgaggacagctacacctggttcccccccagctgcctggacccccagaactgctacctgcacacagctggggccctgcccagctgtgagtgccacctgaacaacctgagccagagcgtgaacttctgtgagaggaccaagatctggggcaccttcaagatcaatgaacgcttcaccaatgacctgctgaacagcagcagcgccatctacagcaaatatgccaatggaattgagatccagctgaagaaggcctatgagcgcatccagggctttgaatctgtgcaggtgacccagttcagaaatggcagcatcgtggccggctatgaggtggtgggcagcagcagcgccagcgagctgctgagcgccattgaacatgtggccgagaaggccaagacagccctgcacaagctgttccccctggaggatggcagcttccgggtgtttgggaaggcccagtgcaatgacatcgtgtttggcttcggcagcaaggatgatgagtacaccctgccctgcagcagcggctaccggggcaacatcacagccaagtgtgagagcagcggctggcaggtgatccgggagacctgtgtgctgagcctgctggaggagctgaacaagaacttctccatgattgtgggcaatgccacagaagctgctgtgtcctcctttgtgcagaacctgagcgtcatcatccggcagaaccccagcaccaccgtgggcaacctggcctctgtggtgtccatcctgagcaacatcagcagcctgagcctggccagccacttccgggtgagcaacagcaccatggaggatgtgatcagcattgctgacaacatcctgaacagcgcctctgtgaccaactggacagtgctgctgcgggaggagaagtatgccagcagccggctgctggagaccctggagaacatcagcaccctggtgcccccaacagccctgcccctgaacttcagcaggaagttcatcgactggaagggcatccctgtgaacaagagccagctgaagaggggctacagctaccagatcaagatgtgcccccagaacaccagcatccccatccggggccgggtgctgattggaagtgaccagttccagaggagcctgcctgagaccatcatctccatggccagcctgaccctgggcaacatcctgcctgtgtccaagaatggaaatgcccaggtgaatggacctgtgatcagcaccgtcatccagaactacagcatcaatgaggtgttcctgttcttcagcaagattgagagcaacctgagccagccccactgtgtgttctgggacttcagccacctgcagtggaatgatgctggctgccacctggtgaatgagacccaggacatcgtgacctgccagtgcacccacctgaccagcttcagcatcctgatgagcccctttgtgcccagcaccatcttccctgtggtgaagtggatcacctacgtgggcctgggcatcagcatcggcagcctcatcctgtgcctgatcatcgaggccctcttctggaagcagatcaagaagagccagaccagccacacccggcgcatctgcatggtgaacatcgccctgagcctgctgattgctgatgtgtggttcatcgtgggcgccaccgtggacaccaccgtgaaccccagcggcgtgtgcacagctgctgtgttcttcacccacttcttctacctgagcctcttcttctggatgctgatgctgggcatcctgctggcctaccgcatcatcctggtgttccaccacatggcccagcacctgatgatggctgtgggcttctgcctgggctacggctgccccctcatcatcagcgtcatcaccatcgctgtgacccagcccagcaacacctacaagaggaaggatgtgtgctggctgaactggagcaatggcagcaagcccctgctggcctttgtggtgcctgccctggccatcgtggccgtgaactttgtggtggtgctgctggtgctgaccaagctgtggaggcccaccgtgggggagcggctgagcagagatgacaaggccaccatcatccgggtgggcaagagcctgctgatcctgacccccctgctgggcctgacctggggcttcggcatcggcaccatcgtggacagccagaacctggcctggcacgtgatctttgccctgctgaatgccttccagggcttcttcatcctgtgcttcggcatcctgctggacagcaagctgcggcagctgctcttcaacaagctgagcgccctgagctcctggaagcagacagagaagcagaacagcagtgacctgagcgccaagcccaagttcagcaagcccttcaaccccctgcagaacaagggccactacgccttcagccacactggagacagcagtgacaacatcatgctgacccagtttgtgtccaatgaatag

SEQ ID NO: 34429 - DNA, 2127 bp, Artificial Sequence
  Description of Artificial Sequence: Synthetic coding sequence
atgggcctgacagcctacggcaacagaagagtgcagcctggagagctgccctttggagccaacctgaccctcatccacacccgggcccagcctgtgatctgcagcaagctgctgctgaccaagagggtgagccccatctccttcttcctgagcaagttccagaacagctggggagaagatggctgggtgcagctggaccagctgcccagccccaatgctgtgtccagtgaccaggtgcactgcagcgctggctgcacccacaggaaatgtggctgggccgccagcaagagcaaggagaaggtgcctgcccggccccacggcgtgtgtgatggagtgtgcacagactacagccagtgcacccagccctgccccccagacacccagggcaacatgggcttcagctgccggcagaagacctggcacaagatcacagacacctgccagaccctgaatgccctgaacatctttgaggaggacagccggctggtgcagccctttgaggacaacatcaagatctctgtgtacaccgggaagtctgagaccatcacagacatgctgctgcagaagtgccccacagacctgagctgtgtgatccggaacatccagcagagcccctggatccctggcaacattgctgtgattgtgcagctgctgcacaacatcagcacagccatctggacaggagtggatgaggccaagatgcagagctacagcaccatcgccaaccacatcctgaacagcaagagcatcagcaactggaccttcatcccagacaggaacagcagctacatcctgctgcacagcgtgaacagctttgcccggcggctcttcatcgacaagcaccctgtggacatcagtgatgtgttcatccacaccatgggcaccaccatcagcggggacaacatcggcaagaacttcaccttctccatgaggatcaatgacaccagcaatgaggtgacaggccgggtgctgatcagcagagatgagctgaggaaggtgcccagccccagccaggtgatcagcatcgccttccccaccatcggggccatcctggaggccagcctgctggagaatgtgacagtgaatggcctggtgctgagcgccatcctgcccaaggagctgaagaggatcagcctcatctttgagaagatcagcaagtctgaggagaggaggacccagtgtgtgggctggcacagcgtggagaaccgctgggaccagcaggcctgcaagatgatccaggagaacagccagcaggccgtgtgcaagtgccggcccagcaagctgttcaccagcttcagcatcctgatgagcccccacatcctggagagcctcatcctgacctacatcacctacgtgggcctgggcatcagcatctgcagcctcatcctgtgcctgagcattgaggtgctggtgtggagccaggtgaccaagacagagatcacctacctgcggcacgtgtgcatcgtgaacattgctgccaccctgctgatggctgatgtgtggttcatcgtggccagcttcctgagcggccccatcacccaccacaagggctgtgtggccgccaccttctttgtgcacttcttctacctgtctgtgttcttctggatgctggccaaggccctgctgatcctgtatggcatcatgattgtgttccacaccctgcccaagtctgtgctggtggccagcctcttctctgtgggctacggctgccccctggccatcgccgccatcaccgtggccgccacagagcccgggaagggctacctgcggcctgagatctgctggctgaactgggacatgaccaaggccctgctggcctttgtgatcccagccctggccatcgtggtggtgaacctgatcaccgtgaccctggtgattgtgaagacccagagagctgccatcggcaacagcatgttccaggaggtgcgggccatcgtgcgcatcagcaagaacatcgccatcctgacccccctgctgggcctgacctggggctttggagtggccaccgtgattgatgacaggagcctggccttccacatcatcttcagcctgctgaatgccttccaggtgtccccagatgccagtgaccaggtgcagagcgagcgcatccatgaagatgtgctgtag

SEQ ID NO: 34430 - DNA, 1929 bp, Artificial Sequence
  Description of Artificial Sequence: Synthetic coding sequence
atgacccacatcctgctgctgtactacctggtgttcctgctgcccacagagagctgcaggaccctgtaccaggccgccagcaagagcaaggagaaggtgcctgcccggccccacggcgtgtgtgatggagtgtgcacagactacagccagtgcacccagccctgccccccagacacccagggcaacatgggcttcagctgccggcagaagacctggcacaagatcacagacacctgccagaccctgaatgccctgaacatctttgaggaggacagccggctggtgcagccctttgaggacaacatcaagatctctgtgtacaccgggaagtctgagaccatcacagacatgctgctgcagaagtgccccacagacctgagctgtgtgatccggaacatccagcagagcccctggatccctggcaacattgctgtgattgtgcagctgctgcacaacatcagcacagccatctggacaggagtggatgaggccaagatgcagagctacagcaccatcgccaaccacatcctgaacagcaagagcatcagcaactggaccttcatcccagacaggaacagcagctacatcctgctgcacagcgtgaacagctttgcccggcggctcttcatcgacaagcaccctgtggacatcagtgatgtgttcatccacaccatgggcaccaccatcagcggggacaacatcggcaagaacttcaccttctccatgaggatcaatgacaccagcaatgaggtgacaggccgggtgctgatcagcagagatgagctgaggaaggtgcccagccccagccaggtgatcagcatcgccttccccaccatcggggccatcctggaggccagcctgctggagaatgtgacagtgaatggcctggtgctgagcgccatcctgcccaaggagctgaagaggatcagcctcatctttgagaagatcagcaagtctgaggagaggaggacccagtgtgtgggctggcacagcgtggagaaccgctgggaccagcaggcctgcaagatgatccaggagaacagccagcaggccgtgtgcaagtgccggcccagcaagctgttcaccagcttcagcatcctgatgagcccccacatcctggagagcctcatcctgacctacatcacctacgtgggcctgggcatcagcatctgcagcctcatcctgtgcctgagcattgaggtgctggtgtggagccaggtgaccaagacagagatcacctacctgcggcacgtgtgcatcgtgaacattgctgccaccctgctgatggctgatgtgtggttcatcgtggccagcttcctgagcggccccatcacccaccacaagggctgtgtggccgccaccttctttgtgcacttcttctacctgtctgtgttcttctggatgctggccaaggccctgctgatcctgtatggcatcatgattgtgttccacaccctgcccaagtctgtgctggtggccagcctcttctctgtgggctacggctgccccctggccatcgccgccatcaccgtggccgccacagagcccgggaagggctacctgcggcctgagatctgctggctgaactgggacatgaccaaggccctgctggcctttgtgatcccagccctggccatcgtggtggtgaacctgatcaccgtgaccctggtgattgtgaagacccagagagctgccatcggcaacagcatgttccaggaggtgcgggccatcgtgcgcatcagcaagaacatcgccatcctgacccccctgctgggcctgacctggggctttggagtggccaccgtgattgatgacaggagcctggccttccacatcatcttcagcctgctgaatgccttccagggcttcttcatcctggtgtttggcaccatcctggaccccaagatccgggaggccctgaagggctag

SEQ ID NO: 34431 - DNA, 1929 bp, Artificial Sequence; identical to SEQ ID NO: 34430
  Description of Artificial Sequence: Synthetic coding sequence

SEQ ID NO: 34432 - DNA, 8415 bp, Artificial Sequence
  Description of Artificial Sequence: Synthetic coding sequence
atggatgacaacagccgctactggatggccttctcctacatcaccaacaatgccctgctgggcagagaagatattgacctgggcctggccggggaccaccagcagctgatcctgtaccgcctgggcaagaccttcagcatccgccaccacctggccagcttccagtggcacaccatctgcctgatctgggatggagtgaagggcaagctggagctgttcctgaacaaggagcgcatcctggaggtgacagaccagccccacaacctgaccccccacggcaccctcttcctgggccacttcctgaagaatgaaagcagcgaggtgaagtccatgatgaggagcttccctggcagcctgtactacttccagctgtgggaccacatcctggagaatgaggagttcatgaagtgcctggatggcaacatcgtgtcctgggaggaggatgtgtggctggtgaacaagatcatccccaccgtggacaggaccctgcgctgctttgtgcctgagaacatgaccatccaggagaagagcaccaccgtgtcccagcagattgacatgaccacccccagccagatcactggagtgaagccccagaacacagcccacagcagcaccctgctgagccagagcatccccatctttgccacagactacaccaccatctcctacagcaacaccaccagcccccccctggagaccatgacagcccagaagatcctgaagaccctggtggatgaaacagccacctttgctgtggatgtgctgagcaccagcagcgccatcagcctgcccacccagagcatcagcattgacaacaccaccaacagcatgaagaagaccaagagccccagcagcgagagcaccaagaccaccaagatggtggaggccatggccacagagatcttccagccccccacccccagcaacttcctgagcaccagccgcttcaccaagaacagcgtggtgtccaccaccagcgccatcaagagccagagcgctgtgaccaagaccaccagcctcttcagcaccatcgagagcacctccatgagcaccaccccctgcctgaagcagaagagcaccaacacaggagccctgcccatcagcacagctggccaggagttcatcgagagcacagctgctggcaccgtgccctggttcaccgtggagaagaccagccctgccagcacccacgtgggcacagccagcagcttccccccagagcctgtgctgatcagcacagctgcccctgtggacagcgtcttccccaggaaccagacagccttccccctggccaccacagacatgaagatcgccttcaccgtgcacagcctgaccctgcccacccggctgattgagaccaccccagcccccaggacagctgagacagagctgaccagcaccaacttccaggatgtgtccctgccccgggtggaggatgccatgagcacctccatgagcaaggagaccagcagcaagaccttctccttcctgaccagcttctccttcaccggcacagaatctgtgcagacagtgattgatgctgaggccaccaggacagccctgaccccagagatcaccctggccagcacagtggccgagaccatgctgagcagcaccatcaccggccgggtgtacacccagaacacccccacagcagatggccacctgctgaccctgatgagcaccaggtctgccagcaccagcaaggcccctgagagcggccccaccagcaccacagatgaggccgcccacctgttcagcagcaatgagaccatctggaccagcaggccagaccaggccctgctggcctccatgaacaccaccaccatcctgacctttgtgcccaatgaaaacttcaccagcgccttccacgagaacaccacctacacagagtacctgagcgccaccaccaacatcacccccctgaaggccagccctgagggcaagggcaccacagccaatgatgccaccacagcccgctacaccacagctgtgtccaagctgaccagcccctggtttgccaacttcagcatcgtgtctggcaccaccagcatcaccaacatgcctgagttcaagctgaccaccctgctgctgaagaccatccccatgagcaccaagccagccaatgagctgcccctgaccccccgggagaccgtggtgcccagcgtggacatcatcagcaccctggcctgcatccagcccaacttcagcacagaggagagcgccagcgagaccacccagacagagatcaatggagccatcgtgtttggaggcaccaccacccctgtgcccaagagcgccaccacccagaggctgaatgccaccgtgaccaggaaggaggccaccagccactacctgatgaggaagagcaccatcgctgctgtggccgaggtgagccccttcagcaccatgctggaggtgacagatgaaagtgcccagagggtgacagcctctgtgacagtgtcctccttcccagacatcgagaagctgagcacccccctggacaacaagacagccaccacagaggtgcgggagagctggctgctgaccaagctggtgaagaccacccccaggagcagctacaatgagatgacagagatgttcaacttcaaccacacctacgtggcccactggaccagcgagaccagcgagggcatctctgctggcagccccaccagcggcagcacccacatctttggagagcccctgggcgccagcaccacccgcatcagcgagaccagcttcagcaccacccccacagacagaacagccaccagcctgagtgatggcatcctgcccccccagcccacagctgcccacagcagcgccacccctgtgcctgtgacccacatgttcagcctgcctgtgaatggcagctctgtggtggccgaggagacagaggtgaccatgtctgagcccagcaccctggcccgggccttcagcacctctgtgctgagtgatgtgagcaacctgagcagcaccaccatgaccacagccctggtgccccccctggaccagacagccagcaccaccatcgtcatcgtgcccacccacggggacctgatccgcaccaccagcgaggccaccgtcatctctgtgaggaagacctccatggctgtgcccagcctgacagagacccccttccacagcctgcggctgagcacccctgtgacagccaaggccgagaccaccctcttcagcacctctgtggacacagtgacccccagcacccacaccctggtgtgcagcaagcccccaccagacaacatccccccagccagcagcacccacgtgatcagcaccaccagcaccccagaggccacccagcccatcagccaggtggaggagaccagcacctacgccctgtccttcccctacaccttcagcggcggcggcgtggtggccagcctggccaccggcaccacagagacctctgtggtggatgagaccacccccagccacatcagcgccaacaagctgaccacctctgtgaacagccacatcagcagcagcgccacctacagagtgcacacccctgtgtccatccagctggtgaccagcacctctgtgctgagcagtgacaaggaccagatgaccatcagcctgggcaagacccccaggaccatggaggtgacagagatgagccccagcaagaacagcttcatctcctacagccggggcacccccagcctggagatgacagacaccggcttccctgagaccaccaagatcagcagccaccagacccacagccccagcgagatccccctgggcacccccagtgatggcaacctggccagcagccccaccagcggcagcacccagatcacccccaccctgaccagcagcaacacagtgggcgtgcacatccctgagatgagcaccagcctgggcaagacagccctgcccagccaggccctgaccatcaccaccttcctgtgcccagagaaggagagcaccagcgccctgcctgcctacacccccaggacagtggagatgattgtgaacagcacctacgtgacccacagcgtgtcctatggccaggacaccagctttgtggacaccaccaccagcagcagcacccgcatcagcaaccccatggacatcaacaccaccttcagccacctgcacagcctgcggacccagcctgaggtgacctctgtggccagcttcatcagcgagagcacccagaccttccctgagagcctgagcctgagcacagctggcctgtacaatgatggcttcaccgtgctgagtgaccgcatcaccacagccttctctgtgcccaacgtgcccaccatgctgccccgggagagctccatggccaccagcacccccatctaccagatgagcagcctgcctgtgaatgtgacagccttcaccagcaagaaggtgtctgacaccccacccatcgtcatcaccaagagcagcaagaccatgcaccctggctgcctgaagagcccctgcacagccaccagcggccccatgtctgagatgagcagcatccctgtgaacaacagcgccttcaccccagccaccgtgtccagtgacaccagcaccagggtgggcctcttcagcaccctgctgagctctgtgacccccaggaccaccatgaccatgcagaccagcaccctggatgtgacccctgtgatctatgctggggccaccagcaagaacaagatggtgagcagcgccttcaccacagagatgattgaggcccccagccgcatcacccccaccaccttcctgagccccacagagcccaccctgccctttgtgaagacagtgcccaccaccatcatggccggcatcgtgaccccatttgtgggcaccacagccttcagccccctgagcagcaagagcactggagccatcagcagcatccccaagaccaccttcagccccttcctgagcgccacccagcagagcagccaggctgatgaggccaccaccctgggcatcctgagcggcatcaccaacagaagcctgagcacagtgaacagcggcaccggggtggccctgacagacacctacagccgcatcaccgtgcctgagaacatgctgagccccacccatgctgacagcctgcacaccagcttcaacatccaggtgagccccagcctgaccagcttcaagagcgccagcggccccaccaagaatgtgaagaccaccaccaactgcttcagcagcaacaccaggaagatgaccagcctgctggagaagaccagcctgaccaactatgccaccagcctgaacacccctgtgtcctacccaccctggacccccagcagcgccaccctgcccagcctgaccagctttgtgtacagcccccacagcacagaggccgagatcagcacccccaagaccagccccccacccaccagccagatggtggagttccctgtgctgggcaccaggatgaccagcagcaacacccagcccctgctgatgacctcctggaacatccccacagctgagggcagccagttccccatcagcaccaccatcaacgtgcccaccagcaatgagatggagacagagaccctgcacctggtgcccggccccctgagcaccttcaccgccagccagacaggcctggtgtccaaggatgtgatggccatgagcagcatccccatgagcggcatcctgcccaaccacggcctgtctgagaaccccagcctgagcaccagcctgcgggccatcaccagcaccctggctgatgtgaagcacacctttgagaagatgaccacctctgtgaccccaggcaccaccctgcccagcatcctgagcggggccaccagcggcagcgtcatcagcaagagccccatcctgacctggctgctgagcagcctgcccagcggcagccccccagccaccgtgtccaatgcccctcatgtgatgaccagcagcacagtggaggtgtccaagagcaccttcctgaccagtgacatgatcagcgcccaccccttcaccaacctgaccaccctgcccagcgccaccatgagcaccatcctgaccaggaccatccccacccccaccctgggcggcatcaccaccggcttccccaccagcctgcccatgagcatcaacgtgacagatgacatcgtgtacatcagcacccaccctgaggccagcagcaggaccaccatcacagccaaccccaggacagtgagccaccccagcagcttcagcaggaagaccatgagccccagcaccacagaccacaccctgtctgtgggcgccatgcccctgcccagcagcaccatcaccagctcctggaaccgcatccccacagccagcagccccagcaccctcatcatccccaagcccaccctggacagcctgctgaacatcatgaccaccaccagcacagtgcctggggccagcttccccctcatcagcactggagtgacctaccccttcaccgccaccgtgagcagccccatcagcagcttctttgagaccacctggctggacagcacccccagcttcctgagcacagaggccagcaccagccccacagccaccaagagcacagagcccggcaactgcaaggcagatgaaacagccagcaagtacaagggcacctacaagtggctgctgaccaaccccacagaaacagcccagacccgctgcatcaagaatgaagatggaaatgccacccgcttctgcagcatcagcatcaacacaggcaagagccagtgggagaagcccaagttcaagcagtgcaagctgctgcaggagctgcctgacaagatcgtggacctggccaacatcaccatcagtgatgaaaatgcagaagatgtggccgagcacatcctgaacctgatcaatgaatctccagccctgggcaaggaggagaccaagatcatcgtgtccaagatcagtgacatcagccagtgtgatgagatctccatgaacctgacccacgtgatgctgcagatcatcaacgtggtgctggagaagcagaacaacagcgccagtgacctgcacgagatcagcaatgagatcctgcgcatcattgaaagaacaggccacaagatggagttcagcggccagatcgccaacctgactgtggccggcctggccctggccgtgctgcggggggaccacacctttgatggcatggccttcagcatccacagctatgaggagggcacagatcctgagaccaagaatgtgaccaaggccctgaccacctacgtggtgtctgccagcatcagtgatgacatgttcatccagaacctggccgaccctgtggtgatcaccctgcagcacatcggcggcaaccagaactacggccaggtgcactgtgccttctgggactttgagaacaacaacggcctgggcggctggaacagcagcggctgcaaggtgaaggagaccaacgtgaactacaccatctgccagtgtgaccacctgacccactttggagtgctgatggacctgagccgcagcacagtggacagcgtgaatgagcagatcctggccctgatcacctacacaggctgcggcatcagcagcatcttcctgggcgtggccgtggtgacctacatcgccttccacaagctgaggaaggactacccagccaagatcctgatcaacctgtgcacagccctgctgatgctgaacctggtgttcctgatcaacagctggctgagcagcttccagaaggtgggcgtgtgcatcacagctgctgtggccctgcactacttcctgctggtgtccttcacctggatgggcctggaggccgtgcacatgtacctggccctggtgaaggtgttcaacatctacatccccaactacatcctgaagttctgcctggtgggctggggcatcccagccatcatggtggccatcaccgtgtctgtgaagaaggacctgtatggcaccctgagccccaccacccccttctgctggatcaaggatgacagcatcttctacatctctgtggtggcctacttctgcctgatcttcctgatgaacctgtccatgttctgcaccgtgctggtgcagctgaacagcgtgaagagccagatccagaagaccaggaggaagatgatcctgcatgacctgaagggcaccatgagcctgaccttcctgctgggcctgacctggggctttgccttctttgcctggggccccatgaggaacttcttcctgtacctgtttgccatcttcaacaccctgcaggacggcagcagccgctgccagatcaaggtgggctacaagcaggagggcctgaagaagatctttgagcacaagctgctgacccccagcctgaagagcacagccaccagcagcaccttcaagagcctgggcagcgcccagggcaccccatctgagatctccttccccaatgcccctgagctgagcgccctgcacgtggtggccagcgagcccaccactggatag

SEQ ID NO: 34433 - DNA, 9243 bp, Artificial Sequence
  Description of Artificial Sequence: Synthetic coding sequence
atgaaggagcacatcatctaccagaagctgtatggcctcatcctgatgagcagcttcatcttcctgagtgacaccctgagcctgaagggcaagaagctggacttcttcggccgcggggacacctacgtgtccctgattgacaccatccctgagctgagccgcttcaccgcctgcatcgacctggtgttcatggatgacaacagccgctactggatggccttctcctacatcaccaacaatgccctgctgggccgggaggacatcgacctgggcctggccggggaccaccagcagctgatcctgtaccgcctgggcaagaccttcagcatccgccaccacctggccagcttccagtggcacaccatctgcctgatctgggatggagtgaagggcaagctggagctgttcctgaacaaggagcgcatcctggaggtgacagaccagccccacaacctgacccctcatggcaccctcttcctgggccacttcctgaagaatgaatcttctgaggtgaagtccatgatgaggagcttccctggcagcctgtactacttccagctgtgggaccacatcctggagaatgaggagttcatgaagtgcctggatggcaacatcgtgtcctgggaggaggatgtgtggctggtgaacaagatcatccccaccgtggacaggaccctgcgctgctttgtgcctgagaacatgaccatccaggagaagagcaccaccgtgtcccagcagattgacatgaccacccccagccagatcaccggggtgaagccccagaacacagcccacagcagcaccctgctgagccagagcatccccatctttgccacagactacaccaccatctcctacagcaacaccaccagcccccccctggagaccatgacagcccagaagatcctgaagaccctggtggatgaaacagccacctttgctgtggatgtgctgagcaccagcagcgccatcagcctgcccacccagagcatcagcattgacaacaccaccaacagcatgaagaagaccaagagccccagcagcgagagcaccaagaccaccaagatggtggaggccatggccacagagatcttccagccccccacccccagcaacttcctgagcaccagccgcttcaccaagaacagcgtggtgtccaccaccagcgccatcaagagccagagcgctgtgaccaagaccaccagcctcttcagcaccatcgagagcacctccatgagcaccaccccctgcctgaagcagaagagcaccaacacaggagccctgcccatcagcacagctggccaggagttcatcgagagcacagctgctggcaccgtgccctggttcaccgtggagaagaccagccctgccagcacccacgtgggcacagccagcagcttccccccagagcctgtgctgatcagcacagctgcccctgtggacagcgtcttccccaggaaccagacagccttccccctggccaccacagacatgaagatcgccttcaccgtgcacagcctgaccctgcccaccaggctcatcgagaccaccccagcccccaggacagctgagacagagctgaccagcaccaacttccaggatgtgtccctgccccgggtggaggatgccatgagcacctccatgagcaaggagaccagcagcaagaccttctccttcctgaccagcttctccttcaccggcacagagagcgtgcagacagtgattgatgctgaggccaccaggacagccctgaccccagagatcaccctggccagcacagtggccgagaccatgctgagcagcaccatcaccggccgggtgtacacccagaacacccccacagcagatggccacctgctgaccctgatgagcaccaggtctgccagcaccagcaaggcccctgagagcggccccaccagcaccacagatgaagctgcccacctgttcagcagcaatgagaccatctggaccagcaggccagaccaggccctgctggcctccatgaacaccaccaccatcctgacctttgtgcccaatgaaaacttcaccagcgccttccacgagaacaccacctacacagagtacctgagcgccaccaccaacatcacccccctgaaggccagccctgagggcaagggcaccacagccaatgatgccaccacagcccgctacaccacagctgtgtccaagctgaccagcccctggtttgccaacttcagcatcgtgtctggcaccaccagcatcaccaacatgcctgagttcaagctgaccaccctgctgctgaagaccatccccatgagcaccaagccagccaatgagctgcccctgaccccccgggagaccgtggtgcccagcgtggacatcatcagcaccctggcctgcatccagcccaacttcagcacagaggagagcgccagcgagaccacccagacagagatcaacggggccatcgtgtttggaggcaccaccacccctgtgcccaagagcgccaccacccagaggctgaatgccaccgtgaccaggaaggaggccaccagccactacctgatgaggaagagcaccatcgctgctgtggccgaggtgagccccttcagcaccatgctggaggtgacagatgagagcgcccagagggtgacagcctctgtgacagtgagcagcttcccagacatcgagaagctgagcacccccctggacaacaagacagccaccacagaggtgcgggagagctggctgctgaccaagctggtgaagaccacccccaggagcagctacaatgagatgacagagatgttcaacttcaaccacacctacgtggcccactggaccagcgagaccagcgagggcatctctgctggcagccccaccagcggcagcacccacatctttggagagcccctgggcgccagcaccacccgcatcagcgagaccagcttcagcaccacccccacagacagaacagccaccagcctgagtgatggcatcctgcccccccagcccacagctgcccacagcagcgccacccctgtgcctgtgacccacatgttcagcctgcctgtgaatggcagctctgtggtggccgaggagacagaggtgaccatgtctgagcccagcaccctggcccgggccttcagcacctctgtgctgagtgatgtgagcaacctgagcagcaccaccatgaccacagccctggtgccccccctggaccagacagccagcaccaccatcgtgattgtgcccacccatggagacctgatccgcaccaccagcgaggccaccgtcatctctgtgaggaagacctccatggctgtgcccagcctgacagagacccccttccacagcctgcggctgagcacccctgtgacagccaaggccgagaccaccctcttcagcacctctgtggacacagtgacccccagcacccacaccctggtgtgcagcaagcccccaccagacaacatccccccagccagcagcacccacgtgatcagcaccaccagcaccccagaggccacccagcccatcagccaggtggaggagaccagcacctacgccctgtccttcccctacaccttcagcggcggcggcgtggtggccagcctggccaccggcaccacagagacctctgtggtggatgagaccacccccagccacatcagcgccaacaagctgaccacctctgtgaacagccacatcagcagcagcgccacctacagagtgcacacccctgtgtccatccagctggtgaccagcacctctgtgctgagcagtgacaaggaccagatgaccatcagcctgggcaagacccccaggaccatggaggtgacagagatgagccccagcaagaacagcttcatctcctacagccggggcacccccagcctggagatgacagacaccggcttccctgagaccaccaagatcagcagccaccagacccacagccccagcgagatccccctgggcacccccagtgatggcaacctggccagcagccccaccagcggcagcacccagatcacccccaccctgaccagcagcaacacagtgggcgtgcacatccctgagatgagcaccagcctgggcaagacagccctgcccagccaggccctgaccatcaccaccttcctgtgcccagagaaggagagcaccagcgccctgcctgcctacacccccaggacagtggagatgattgtgaacagcacctacgtgacccacagcgtgtcctatggccaggacaccagctttgtggacaccaccaccagcagcagcacccgcatcagcaaccccatggacatcaacaccaccttcagccacctgcacagcctgcggacccagcctgaggtgacctctgtggccagcttcatcagcgagagcacccagaccttccctgagagcctgagcctgagcacagctggcctgtacaatgatggcttcaccgtgctgagtgaccgcatcaccacagccttctctgtgcccaacgtgcccaccatgctgccccgggagagctccatggccaccagcacccccatctaccagatgagcagcctgcctgtgaatgtgacagccttcaccagcaagaaggtgtctgacaccccacccatcgtcatcaccaagagcagcaagaccatgcaccctggctgcctgaagagcccctgcacagccaccagcggccccatgtctgagatgagcagcatccctgtgaacaacagcgccttcaccccagccaccgtgtccagtgacaccagcaccagggtgggcctcttcagcaccctgctgagctctgtgacccccaggaccaccatgaccatgcagaccagcaccctggatgtgacccctgtgatctatgctggggccaccagcaagaacaagatggtgtcctctgccttcaccacagagatgattgaggcccccagccgcatcacccccaccaccttcctgagccccacagagcccaccctgccctttgtgaagacagtgcccaccaccatcatggccggcatcgtgaccccatttgtgggcaccacagccttcagccccctgagcagcaagagcactggagccatcagcagcatccccaagaccaccttcagccccttcctgagcgccacccagcagagcagccaggctgatgaggccaccaccctgggcatcctgagcggcatcaccaacagaagcctgagcacagtgaacagcggcactggagtggccctgacagacacctacagccgcatcaccgtgcctgagaacatgctgagccccacccacgccgacagcctgcacaccagcttcaacatccaggtgagccccagcctgaccagcttcaagagcgccagcggccccaccaagaatgtgaagaccaccaccaactgcttcagcagcaacaccaggaagatgaccagcctgctggagaagaccagcctgaccaactatgccaccagcctgaacacccctgtgtcctacccaccctggacccccagcagcgccaccctgcccagcctgaccagctttgtgtacagcccccacagcacagaagctgagatcagcacccccaagaccagccccccacccaccagccagatggtggagttccctgtgctgggcaccaggatgaccagcagcaacacccagcccctgctgatgacctcctggaacatccccacagctgagggcagccagttccccatcagcaccaccatcaacgtgcccaccagcaatgagatggagacagagaccctgcacctggtgcccggccccctgagcaccttcaccgccagccagacaggcctggtgtccaaggatgtgatggccatgagcagcatccccatgagcggcatcctgcccaaccacggcctgtctgagaaccccagcctgagcaccagcctgcgggccatcaccagcaccctggctgatgtgaagcacacctttgagaagatgaccacctctgtgaccccaggcaccaccctgcccagcatcctgagcggggccaccagcggcagcgtcatcagcaagagccccatcctgacctggctgctgagcagcctgcccagcggcagccccccagccaccgtgtccaatgccccccacgtgatgaccagcagcacagtggaggtgtccaagagcaccttcctgaccagtgacatgatcagcgcccaccccttcaccaacctgaccaccctgcccagcgccaccatgagcaccatcctgaccaggaccatccccacccccaccctgggcggcatcaccaccggcttccccaccagcctgcccatgagcatcaacgtgacagatgacatcgtgtacatcagcacccaccctgaggccagcagcaggaccaccatcacagccaaccccaggacagtgagccaccccagcagcttcagcaggaagaccatgagccccagcaccacagaccacaccctgtctgtgggcgccatgcccctgcccagcagcaccatcaccagctcctggaaccgcatccccacagccagcagccccagcaccctcatcatccccaagcccaccctggacagcctgctgaacatcatgaccaccaccagcacagtgcctggggccagcttccccctcatcagcactggagtgacctaccccttcaccgccaccgtgagcagccccatcagcagcttctttgagaccacctggctggacagcacccccagcttcctgagcacagaggccagcaccagccccacagccaccaagagcacagtgtccttctacaacgtggagatgtccttctctgtgtttgtggaggagccccgcatccccatcaccagcgtcatcaatgagttcacagagaacagcctgaacagcatcttccagaacagcgagttcagcctggccaccctggagacccagatcaagagccgggacatcagcgaggaggagatggtgatggaccgggccatcctggagcagcgggagggccaggagatggccaccatctcctatgtgccctacagctgtgtgtgccaggtgatcatcaaggccagcagcagcctggccagcagcgagctgatgaggaagatcaagagcaagatccacggcaacttcacccacggcaacttcacccaggaccagctgaccctgctggtgaactgtgaacatgtggccgtgaagaagctggagcccggcaactgcaaggcagatgaaacagccagcaagtacaagggcacctacaagtggctgctgaccaaccccacagaaacagcccagacccgctgcatcaagaatgaagatggaaatgccacccgcttctgcagcatcagcatcaacacaggcaagagccagtgggagaagcccaagttcaagcagtgcaagctgctgcaggagctgcctgacaagatcgtggacctggccaacatcaccatcagtgatgaaaatgcagaagatgtggccgagcacatcctgaacctgatcaatgaatctccagccctgggcaaggaggagaccaagatcatcgtgtccaagatcagtgacatcagccagtgtgatgagatctccatgaacctgacccacgtgatgctgcagatcatcaacgtggtgctggagaagcagaacaacagcgccagtgacctgcacgagatcagcaatgagatcctgcgcatcattgaaagaacaggccacaagatggagttcagcggccagatcgccaacctgactgtggccggcctggccctggccgtgctgcggggggaccacacctttgatggcatggccttcagcatccacagctatgaggagggcacagatcctgagatcttcctgggcaatgtgcctgtgggcggcatcctggccagcatctacctgcccaagagcctgacagagcgcatccccctgagcaacctgcagaccatcctcttcaacttcttcggccagaccagcctcttcaagaccaagaatgtgaccaaggccctgaccacctacgtggtgtctgccagcatcagtgatgacatgttcatccagaacctggccgaccctgtggtgatcaccctgcagcacatcggcggcaaccagaactacggccaggtgcactgtgccttctgggactttgagaacaacaacggcctgggcggctggaacagcagcggctgcaaggtgaaggagaccaacgtgaactacaccatctgccagtgtgaccacctgacccactttggagtgctgatggacctgagccgcagcacagtggacagcgtgaatgagcagatcctggccctgatcacctacacaggctgcggcatcagcagcatcttcctgggcgtggccgtggtgacctacatcgccttccacaagctgaggaaggactacccagccaagatcctgatcaacctgtgcacagccctgctgatgctgaacctggtgttcctgatcaacagctggctgagcagcttccagaaggtgggcgtgtgcatcacagctgctgtggccctgcactacttcctgctggtgtccttcacctggatgggcctggaggccgtgcacatgtacctggccctggtgaaggtgttcaacatctacatccccaactacatcctgaagttctgcctggtgggctggggcatcccagccatcatggtggccatcaccgtgtctgtgaagaaggacctgtatggcaccctgagccccaccacccccttctgctggatcaaggatgacagcatcttctacatctctgtggtggcctacttctgcctgatcttcctgatgaacctgtccatgttctgcaccgtgctggtgcagctgaacagcgtgaagagccagatccagaagaccaggaggaagatgatcctgcatgacctgaagggcaccatgagcctgaccttcctgctgggcctgacctggggctttgccttctttgcctggggccccatgaggaacttcttcctgtacctgtttgccatcttcaacaccctgcagggcttcttcatctttgtgttccactgtgtgatgaaggagagcgtgcgggagcagtggcagatccacctgtgctgcggctggctgcggctggacaacagcagtgatggcagcagccgctgccagatcaaggtgggctacaagcaggagggcctgaagaagatctttgagcacaagctgctgacccccagcctgaagagcacagccaccagcagcaccttcaagagcctgggcagcgcccagggcacccccagcgagatctccttccccaatgatgactttgacaaggacccctactgcagcagcccctag

SEQ ID NO: 34434 - DNA, 9243 bp, Artificial Sequence; identical to SEQ ID NO: 34433
  Description of Artificial Sequence: Synthetic coding sequence

SEQ ID NO: 34435 - DNA, 8628 bp, Artificial Sequence
  Description of Artificial Sequence: Synthetic coding sequence
atgaaggagcacatcatctaccagaagctgtatggcctcatcctgatgagcagcttcatcttcctgtctgtggtgcctgagaacatgaccatccaggagaagagcaccaccgtgtcccagcagattgacatgaccacccccagccagatcactggagtgaagccccagaacacagcccacagcagcaccctgctgagccagagcatccccatctttgccacagactacaccaccatctcctacagcaacaccaccagcccccccctggagaccatgacagcccagaagatcctgaagaccctggtggatgaaacagccacctttgctgtggatgtgctgagcaccagcagcgccatcagcctgcccacccagagcatcagcattgacaacaccaccaacagcatgaagaagaccaagagccccagcagcgagagcaccaagaccaccaagatggtggaggccatggccacagagatcttccagccccccacccccagcaacttcctgagcaccagccgcttcaccaagaacagcgtggtgtccaccaccagcgccatcaagagccagagcgctgtgaccaagaccaccagcctcttcagcaccatcgagagcacctccatgagcaccaccccctgcctgaagcagaagagcaccaacacaggagccctgcccatcagcacagctggccaggagttcatcgagagcacagctgctggcaccgtgccctggttcaccgtggagaagaccagccctgccagcacccacgtgggcacagccagcagcttccccccagagcctgtgctgatcagcacagctgcccctgtggacagcgtcttccccaggaaccagacagccttccccctggccaccacagacatgaagatcgccttcaccgtgcacagcctgaccctgcccacccggctgattgagaccaccccagcccccaggacagctgagacagagctgaccagcaccaacttccaggatgtgtccctgccccgggtggaggatgccatgagcacctccatgagcaaggagaccagcagcaagaccttctccttcctgaccagcttctccttcaccggcacagaatctgtgcagacagtgattgatgctgaggccaccaggacagccctgaccccagagatcaccctggccagcacagtggccgagaccatgctgagcagcaccatcaccggccgggtgtacacccagaacacccccacagcagatggccacctgctgaccctgatgagcaccaggtctgccagcaccagcaaggcccctgagagcggccccaccagcaccacagatgaggccgcccacctgttcagcagcaatgagaccatctggaccagcaggccagaccaggccctgctggcctccatgaacaccaccaccatcctgacctttgtgcccaatgaaaacttcaccagcgccttccacgagaacaccacctacacagagtacctgagcgccaccaccaacatcacccccctgaaggccagccctgagggcaagggcaccacagccaatgatgccaccacagcccgctacaccacagctgtgtccaagctgaccagcccctggtttgccaacttcagcatcgtgtctggcaccaccagcatcaccaacatgcctgagttcaagctgaccaccctgctgctgaagaccatccccatgagcaccaagccagccaatgagctgcccctgaccccccgggagaccgtggtgcccagcgtggacatcatcagcaccctggcctgcatccagcccaacttcagcacagaggagagcgccagcgagaccacccagacagagatcaatggagccatcgtgtttggaggcaccaccacccctgtgcccaagagcgccaccacccagaggctgaatgccaccgtgaccaggaaggaggccaccagccactacctgatgaggaagagcaccatcgctgctgtggccgaggtgagccccttcagcaccatgctggaggtgacagatgaaagtgcccagagggtgacagcctctgtgacagtgtcctccttcccagacatcgagaagctgagcacccccctggacaacaagacagccaccacagaggtgcgggagagctggctgctgaccaagctggtgaagaccacccccaggagcagctacaatgagatgacagagatgttcaacttcaaccacacctacgtggcccactggaccagcgagaccagcgagggcatctctgctggcagccccaccagcggcagcacccacatctttggagagcccctgggcgccagcaccacccgcatcagcgagaccagcttcagcaccacccccacagacagaacagccaccagcctgagtgatggcatcctgcccccccagcccacagctgcccacagcagcgccacccctgtgcctgtgacccacatgttcagcctgcctgtgaatggcagctctgtggtggccgaggagacagaggtgaccatgtctgagcccagcaccctggcccgggccttcagcacctctgtgctgagtgatgtgagcaacctgagcagcaccaccatgaccacagccctggtgccccccctggaccagacagccagcaccaccatcgtcatcgtgcccacccacggggacctgatccgcaccaccagcgaggccaccgtcatctctgtgaggaagacctccatggctgtgcccagcctgacagagacccccttccacagcctgcggctgagcacccctgtgacagccaaggccgagaccaccctcttcagcacctctgtggacacagtgacccccagcacccacaccctggtgtgcagcaagcccccaccagacaacatccccccagccagcagcacccacgtgatcagcaccaccagcaccccagaggccacccagcccatcagccaggtggaggagaccagcacctacgccctgtccttcccctacaccttcagcggcggcggcgtggtggccagcctggccaccggcaccacagagacctctgtggtggatgagaccacccccagccacatcagcgccaacaagctgaccacctctgtgaacagccacatcagcagcagcgccacctacagagtgcacacccctgtgtccatccagctggtgaccagcacctctgtgctgagcagtgacaaggaccagatgaccatcagcctgggcaagacccccaggaccatggaggtgacagagatgagccccagcaagaacagcttcatctcctacagccggggcacccccagcctggagatgacagacaccggcttccctgagaccaccaagatcagcagccaccagacccacagccccagcgagatccccctgggcacccccagtgatggcaacctggccagcagccccaccagcggcagcacccagatcacccccaccctgaccagcagcaacacagtgggcgtgcacatccctgagatgagcaccagcctgggcaagacagccctgcccagccaggccctgaccatcaccaccttcctgtgcccagagaaggagagcaccagcgccctgcctgcctacacccccaggacagtggagatgattgtgaacagcacctacgtgacccacagcgtgtcctatggccaggacaccagctttgtggacaccaccaccagcagcagcacccgcatcagcaaccccatggacatcaacaccaccttcagccacctgcacagcctgcggacccagcctgaggtgacctctgtggccagcttcatcagcgagagcacccagaccttccctgagagcctgagcctgagcacagctggcctgtacaatgatggcttcaccgtgctgagtgaccgcatcaccacagccttctctgtgcccaacgtgcccaccatgctgccccgggagagctccatggccaccagcacccccatctaccagatgagcagcctgcctgtgaatgtgacagccttcaccagcaagaaggtgtctgacaccccacccatcgtcatcaccaagagcagcaagaccatgcaccctggctgcctgaagagcccctgcacagccaccagcggccccatgtctgagatgagcagcatccctgtgaacaacagcgccttcaccccagccaccgtgtccagtgacaccagcaccagggtgggcctcttcagcaccctgctgagctctgtgacccccaggaccaccatgaccatgcagaccagcaccctggatgtgacccctgtgatctatgctggggccaccagcaagaacaagatggtgagcagcgccttcaccacagagatgattgaggcccccagccgcatcacccccaccaccttcctgagccccacagagcccaccctgccctttgtgaagacagtgcccaccaccatcatggccggcatcgtgaccccatttgtgggcaccacagccttcagccccctgagcagcaagagcactggagccatcagcagcatccccaagaccaccttcagccccttcctgagcgccacccagcagagcagccaggctgatgaggccaccaccctgggcatcctgagcggcatcaccaacagaagcctgagcacagtgaacagcggcaccggggtggccctgacagacacctacagccgcatcaccgtgcctgagaacatgctgagccccacccatgctgacagcctgcacaccagcttcaacatccaggtgagccccagcctgaccagcttcaagagcgccagcggccccaccaagaatgtgaagaccaccaccaactgcttcagcagcaacaccaggaagatgaccagcctgctggagaagaccagcctgaccaactatgccaccagcctgaacacccctgtgtcctacccaccctggacccccagcagcgccaccctgcccagcctgaccagctttgtgtacagcccccacagcacagaggccgagatcagcacccccaagaccagccccccacccaccagccagatggtggagttccctgtgctgggcaccaggatgaccagcagcaacacccagcccctgctgatgacctcctggaacatccccacagctgagggcagccagttccccatcagcaccaccatcaacgtgcccaccagcaatgagatggagacagagaccctgcacctggtgcccggccccctgagcaccttcaccgccagccagacaggcctggtgtccaaggatgtgatggccatgagcagcatccccatgagcggcatcctgcccaaccacggcctgtctgagaaccccagcctgagcaccagcctgcgggccatcaccagcaccctggctgatgtgaagcacacctttgagaagatgaccacctctgtgaccccaggcaccaccctgcccagcatcctgagcggggccaccagcggcagcgtcatcagcaagagccccatcctgacctggctgctgagcagcctgcccagcggcagccccccagccaccgtgtccaatgcccctcatgtgatgaccagcagcacagtggaggtgtccaagagcaccttcctgaccagtgacatgatcagcgcccaccccttcaccaacctgaccaccctgcccagcgccaccatgagcaccatcctgaccaggaccatccccacccccaccctgggcggcatcaccaccggcttccccaccagcctgcccatgagcatcaacgtgacagatgacatcgtgtacatcagcacccaccctgaggccagcagcaggaccaccatcacagccaaccccaggacagtgagccaccccagcagcttcagcaggaagaccatgagccccagcaccacagaccacaccctgtctgtgggcgccatgcccctgcccagcagcaccatcaccagctcctggaaccgcatccccacagccagcagccccagcaccctcatcatccccaagcccaccctggacagcctgctgaacatcatgaccaccaccagcacagtgcctggggccagcttccccctcatcagcactggagtgacctaccccttcaccgccaccgtgagcagccccatcagcagcttctttgagaccacctggctggacagcacccccagcttcctgagcacagaggccagcaccagccccacagccaccaagagcacagtgtccttctacaacgtggagatgtccttctctgtgtttgtggaggagccccgcatccccatcaccagcgtcatcaatgagttcacagagaacagcctgaacagcatcttccagaacagcgagttcagcctggccaccctggagacccagatcaagagccgggacatcagcgaggaggagatggtgatggaccgggccatcctggagcagcgggagggccaggagatggccaccatctcctatgtgccctacagctgtgtgtgccaggtgatcatcaaggccagcagcagcctggccagcagcgagctgatgaggaagatcaagagcaagatccacggcaacttcacccacggcaacttcacccaggaccagctgaccctgctggtgaactgtgagcacgtggccgtgaagaagctggagcccggcaactgcaaggcagatgaaacagccagcaagtacaagggcacctacaagtggctgctgaccaaccccacagaaacagcccagacccgctgcatcaagaatgaagatggaaatgccacccgcttctgcagcatcagcatcaacacaggcaagagccagtgggagaagcccaagttcaagcagtgcaagctgctgcaggagctgcctgacaagatcgtggacctggccaacatcaccatcagtgatgaaaatgcagaagatgtggccgagcacatcctgaacctgatcaatgaaagccctgccctgggcaaggaggagaccaagatcatcgtgtccaagatcagtgacatcagccagtgtgatgagatctccatgaacctgacccacgtgatgctgcagatcatcaacgtggtgctggagaagcagaacaacagcgccagtgacctgcacgagatcagcaatgagatcctgcgcatcatcgagaggacaggccacaagatggagttcagcggccagatcgccaacctgactgtggccggcctggccctggccgtgctgcggggggaccacacctttgatggcatggccttcagcatccacagctatgaggagggcacagatcctgagatcttcctgggcaatgtgcctgtgggcggcatcctggccagcatctacctgcccaagagcctgacagagcgcatccccctgagcaacctgcagaccatcctcttcaacttcttcggccagaccagcctcttcaagaccaagaatgtgaccaaggccctgaccacctacgtggtgtctgccagcatcagtgatgacatgttcatccagaacctggccgaccctgtggtgatcaccctgcagcacatcggcggcaaccagaactacggccaggtgcactgtgccttctgggactttgagaacaacaacggcctgggcggctggaacagcagcggctgcaaggtgaaggagaccaacgtgaactacaccatctgccagtgtgaccacctgacccactttggagtgctgatggacctgagccgcagcacagtggacagcgtgaatgagcagatcctggccctgatcacctacacaggctgcggcatcagcagcatcttcctgggcgtggccgtggtgacctacatcgccttccacaagctgaggaaggactacccagccaagatcctgatcaacctgtgcacagccctgctgatgctgaacctggtgttcctgatcaacagctggctgagcagcttccagaaggtgggcgtgtgcatcacagctgctgtggccctgcactacttcctgctggtgtccttcacctggatgggcctggaggccgtgcacatgtacctggccctggtgaaggtgttcaacatctacatccccaactacatcctgaagttctgcctggtgggctggggcatcccagccatcatggtggccatcaccgtgtctgtgaagaaggacctgtatggcaccctgagccccaccacccccttctgctggatcaaggatgacagcatcttctacatctctgtggtggcctacttctgcctgatcttcctgatgaacctgtccatgttctgcaccgtgctggtgcagctgaacagcgtgaagagccagatccagaagaccaggaggaagatgatcctgcatgacctgaagggcaccatgagcctgaccttcctgctgggcctgacctggggctttgccttctttgcctggggccccatgaggaacttcttcctgtacctgtttgccatcttcaacaccctgcagggcttcttcatctttgtgttccactgtgtgatgaaggagagcgtgcgggagcagtggcagatccacctgtgctgcggctggctgcggctggacaacagcagtgatggcagcagccgctgccagatcaaggtgggctacaagcaggagggcctgaagaagatctttgagcacaagctgctgacccccagcctgaagagcacagccaccagcagcaccttcaagagcctgggcagcgcccagggcaccccatctgagatctccttccccaatgatgactttgacaaggacccctactgcagcagcccctag

SEQ ID NO: 34436 - DNA, 3240 bp, Artificial Sequence
  Description of Artificial Sequence: Synthetic coding sequence
atggtgtgcagcgctgcccccctgctgctgctggccaccaccctgcccctgctgggcagccctgtggcccaggccagccagcctgtgtctgagaccggggtgcggccccgggagggcctgcagaggcggcagtggggccccctgattggccgggacaaggcctggaatgaaagaattgaccggcccttccctgcctgccccatccccctgagcagcagctttggccgctggcccaagggccagaccatgtgggcccagaccagcaccctgaccctgacagaggaggagctgggccagagccaggccggcggggagagcggcagcggccagctgctggaccaggagaatggagctggggagagcgccctggtgtctgtgtatgtgcacctggacttcccagacaagacctggcccccagagctgagcaggaccctgaccctgcctgctgccagcgccagcagcagcccccggcccctgctgaccggcctgcggctgaccacagagtgcaatgtgaaccacaagggcaacttctactgtgcctgcctgagcggctaccagtggaacaccagcatctgcctgcactacccaccctgccagagcctgcacaaccaccagccctgtggctgcctggtgttcagccaccctgagcccggctactgccagctgctgcccccaggcagccctgtgacctgcctgcctgctgtgcccggcatcctgaacctgaacagccagctgcagatgcctggggacaccctgagcctgaccctgcacctgagccaggaggccaccaacctgtcctggttcctgcggcaccctggcagccccagccccatcctgctgcagcccggcacccaggtgtctgtgaccagcagccacggccaggccgccctgtctgtgagcaacatgagccaccactgggccggggagtacatgagctgctttgaggcccagggcttcaagtggaacctgtatgaggtggtgcgggtgcccctgaaggccacagatgtggcccggctgccctaccagctgagcatcagctgtgccaccagccctggcttccagctgagctgctgcatccccagcaccaacctggcctacacagctgcctggagccctggagagggcagcaaggccagcagcttcaatgaaagtggcagccagtgctttgtgctggccgtgcagcgctgccccatggctgacaccacctacgcctgtgacctgcagagcctgggcctggcccccctgcgggtgcccatcagcatcaccatcatccaggatggagacatcacctgcccagaagatgcctctgtgctgacctggaatgtgaccaaggccggccacgtggcccaggccccctgcccagagagcaagaggggcatcgtgcggcggctgtgtggggctgatggagtgtggggccctgtgcacagcagctgcacagatgcccggctgctggccctcttcaccaggaccaagctgctgcaggccggccagggcagccctgctgaggaggtgccccagatcctggcccagctgcccggccaggccgctgaggccagcagccccagcgacctgctgaccctgctgagcaccatgaagtatgtggccaaggtggtggccgaggcccgcatccagctggacagaagagccctgaagaacctgctgattgccacagacaaggtgctggacatggacaccaggagcctgtggaccctggcccaggccaggaagccctgggccggcagcaccctgctgctggccgtggagaccctggcctgcagcctgtgcccccaggaccacccctttgccttcagcctgcccaacgtgctgctgcagagccagctgtttggccccaccttccctgctgactacagcatctccttccccaccaggcctcccctgcaggcccagatccccaggcacagcctggcccccctggtgagaaatggaacagagatcagcatcaccagcctggtgctgaggaagctggaccacctgctgcccagcaactacggccagggcctgggggacagcctgtatgccaccccaggcctggtgctggtgatcagcatcatggccggggaccgggccttcagccagggcgaggtgatcatggactttggaaacacagatggcagcccccactgtgtgttctgggaccacagcctcttccagggccggggcggctggagcaaggagggctgccaggcccaggtggccagcgccagccccacagcccagtgcctgtgccagcacctgacagccttctctgtgctgatgagcccccacacagtgcctgaggagcccgccctggccctgctgacccaggtgggcctgggcgccagcatcctggccctgctggtgtgcctgggcgtgtactggctggtgtggagggtggtggtgaggaacaagatctcctacttcagacatgctgccctgctgaacatggtgttctgcctgctggccgctgacacctgcttcctgggcgcccccttcctgagccctggccccaggagccccctgtgcctggccgccgccttcctgtgccacttcctgtacctggccaccttcttctggatgctggcccaggccctggtgctggcccaccagctgctgtttgtgttccaccagctggccaagcaccgggtgctgcccctgatggtgctgctgggctacctgtgccccctgggcctggccggcgtgaccctgggcctgtacctgccccagggccagtacctgcgggagggggagtgctggctggatggcaagggcggggccctgtacacctttgtgggccctgtgctggccatcattggagtgaatggcctggtgctggccatggccatgctgaagctgctgcggcccagcctgtctgagggccccccagctgagaagaggcaggccctgctgggcgtcatcaaggccctgctgatcctgacccccatcttcggcctgacctggggcctgggcctggccaccctgctggaggaggtgtccacagtgccccactacatcttcaccatcctgaacaccctgcagggcgtcttcatcctgctgtttggctgcctgatggacaggaagatccaggaggccctgaggaagcgcttctgccgggcccaggcccccagcagcaccatcagcctggtgtcctgctgcctgcagatcctgagctgtgccagcaagtccatgtctgagggcatcccctggcccagcagcgaggacatgggcacagcccggagctag

SEQ ID NO: 34437 - DNA, 2622 bp, Artificial Sequence
  Description of Artificial Sequence: Synthetic coding sequence
atgaccaccaggaagctgagcgcccacagcgctgccaccccaggctacaaggctgtgacccacaagcaccacacaggctgggccaggatggccaagacaggcctgcctgagaagggccagagccaggccggcggggagagcggcagcggccagctgctggaccaggagaatggagctggggagagcgccctggtgtctgtgtatgtgcacctggacttcccagacaagacctggcccccagagctgagcaggaccctgaccctgcctgctgccagcgccagcagcagcccccggcccctgctgaccggcctgcggctgaccaccggggagtacatgagctgctttgaggcccagggcttcaagtggaacctgtatgaggtggtgcgggtgcccctgaaggccacagatgtggcccggctgccctaccagctgagcatcagctgtgccaccagccctggcttccagctgagctgctgcatccccagcaccaacctggcctacacagctgcctggagccctggagagggcagcaaggccagcagcttcaatgaaagtggcagccagtgctttgtgctggccgtgcagcgctgccccatggctgacaccacctacgcctgtgacctgcagagcctgggcctggcccccctgcgggtgcccatcagcatcaccatcatccaggatggagacatcacctgcccagaagatgcctctgtgctgacctggaatgtgaccaaggccggccacgtggcccaggccccctgcccagagagcaagaggggcatcgtgcggcggctgtgtggggctgatggagtgtggggccctgtgcacagcagctgcacagatgcccggctgctggccctcttcaccaggaccaagctgctgcaggccggccagggcagccctgctgaggaggtgccccagatcctggcccagctgcccggccaggccgctgaggccagcagccccagcgacctgctgaccctgctgagcaccatgaagtatgtggccaaggtggtggccgaggcccgcatccagctggaccggcgggccctgaagaacctgctgattgccacagacaaggtgctggacatggacaccaggagcctgtggaccctggcccaggccaggaagccctgggccggcagcaccctgctgctggccgtggagaccctggcctgcagcctgtgcccccaggaccacccctttgccttcagcctgcccaacgtgctgctgcagagccagctgtttggccccaccttccctgctgactacagcatctccttccccacccggccccccctgcaggcccagatccccaggcacagcctggcccccctggtgagaaatggaacagagatcagcatcaccagcctggtgctgaggaagctggaccacctgctgcccagcaactacggccagggcctgggggacagcctgtatgccaccccaggcctggtgctggtgatcagcatcatggccggggaccgggccttcagccagggcgaggtgatcatggactttggaaacacagatggcagcccccactgtgtgttctgggaccacagcctcttccagggccggggcggctggagcaaggagggctgccaggcccaggtggccagcgccagccccacagcccagtgcctgtgccagcacctgacagccttctctgtgctgatgagcccccacacagtgcctgaggagcccgccctggccctgctgacccaggtgggcctgggcgccagcatcctggccctgctggtgtgcctgggcgtgtactggctggtgtggagggtggtggtgaggaacaagatctcctacttcagacatgctgccctgctgaacatggtgttctgcctgctggccgctgacacctgcttcctgggcgcccccttcctgagccctggccccaggagccccctgtgcctggccgccgccttcctgtgccacttcctgtacctggccaccttcttctggatgctggcccaggccctggtgctggcccaccagctgctgtttgtgttccaccagctggccaagcaccgggtgctgcccctgatggtgctgctgggctacctgtgccccctgggcctggccggcgtgaccctgggcctgtacctgccccagggccagtacctgcgggagggggagtgctggctggatggaaaaggaggagccctgtacacctttgtgggccctgtgctggccatcatcggcgtgaatggcctggtgctggccatggccatgctgaagctgctgcggcccagcctgtctgagggccccccagctgagaagaggcaggccctgctgggcgtcatcaaggccctgctgatcctgacccccatcttcggcctgacctggggcctgggcctggccaccctgctggaggaggtgtccacagtgccccactacatcttcaccatcctgaacaccctgcagggcgtcttcatcctgctgtttggctgcctgatggacaggaagatccaggaggccctgaggaagcgcttctgccgggcccaggcccccagcagcaccatcagcctggccaccaatgaaggctgcatcctggagcacagcaagggcggcagtgacacagccaggaagacagatgccagcgagtag

SEQ ID NO: 34438 - DNA, 2028 bp, Artificial Sequence
  Description of Artificial Sequence: Synthetic coding sequence
atggctgacaccacctacgcctgtgacctgcagagcctgggcctggcccccctgcgggtgcccatcagcatcaccatcatccaggatggagacatcacctgcccagaagatgcctctgtgctgacctggaatgtgaccaaggccggccacgtggcccaggccccctgcccagagagcaagaggggcatcgtgcggcggctgtgtggggctgatggagtgtggggccctgtgcacagcagctgcacagatgcccggctgctggccctcttcaccaggaccaagctgctgcaggccggccagggcagccctgctgaggaggtgccccagatcctggcccagctgcccggccaggccgctgaggccagcagccccagcgacctgctgaccctgctgagcaccatgaagtatgtggccaaggtggtggccgaggcccgcatccagctggaccggcgggccctgaagaacctgctgattgccacagacaaggtgctggacatggacaccaggagcctgtggaccctggcccaggccaggaagccctgggccggcagcaccctgctgctggccgtggagaccctggcctgcagcctgtgcccccaggaccacccctttgccttcagcctgcccaacgtgctgctgcagagccagctgtttggccccaccttccctgctgactacagcatctccttccccacccggccccccctgcaggcccagatccccaggcacagcctggcccccctggtgagaaatggaacagagatcagcatcaccagcctggtgctgaggaagctggaccacctgctgcccagcaactacggccagggcctgggggacagcctgtatgccaccccaggcctggtgctggtgatcagcatcatggccggggaccgggccttcagccagggcgaggtgatcatggactttggaaacacagatggcagcccccactgtgtgttctgggaccacagcctcttccagggccggggcggctggagcaaggagggctgccaggcccaggtggccagcgccagccccacagcccagtgcctgtgccagcacctgacagccttctctgtgctgatgagcccccacacagtgcctgaggagcccgccctggccctgctgacccaggtgggcctgggcgccagcatcctggccctgctggtgtgcctgggcgtgtactggctggtgtggagggtggtggtgaggaacaagatctcctacttcagacatgctgccctgctgaacatggtgttctgcctgctggccgctgacacctgcttcctgggcgcccccttcctgagccctggccccaggagccccctgtgcctggccgccgccttcctgtgccacttcctgtacctggccaccttcttctggatgctggcccaggccctggtgctggcccaccagctgctgtttgtgttccaccagctggccaagcaccgggtgctgcccctgatggtgctgctgggctacctgtgccccctgggcctggccggcgtgaccctgggcctgtacctgccccagggccagtacctgcgggagggggagtgctggctggatggaaaaggaggagccctgtacacctttgtgggccctgtgctggccatcatcggcgtgaatggcctggtgctggccatggccatgctgaagctgctgcggcccagcctgtctgagggccccccagctgagaagaggcaggccctgctgggcgtcatcaaggccctgctgatcctgacccccatcttcggcctgacctggggcctgggcctggccaccctgctggaggaggtgtccacagtgccccactacatcttcaccatcctgaacaccctgcagggcgtcttcatcctgctgtttggctgcctgatggacaggaagatccaggaggccctgaggaagcgcttctgccgggcccaggcccccagcagcaccatcagcctggccaccaatgaaggctgcatcctggagcacagcaagggcggcagtgacacagccaggaagacagatgccagcgagtag

SEQ ID NO: 34439 - DNA, 2994 bp, Artificial Sequence
  Description of Artificial Sequence: Synthetic coding sequence
atggtgtgcagcgctgcccccctgctgctgctggccaccaccctgcccctgctgggcagccctgtggcccaggccagccagcccggccagagccaggccggcggggagagcggcagcggccagctgctggaccaggagaatggagctggggagagcgccctggtgtctgtgtatgtgcacctggacttcccagacaagacctggcccccagagctgagcaggaccctgaccctgcctgctgccagcgccagcagcagcccccggcccctgctgaccggcctgcggctgaccacagaatgtaatgtgaaccacaagggcaacttctactgtgcctgcctgagcggctaccagtggaacaccagcatctgcctgcactacccaccctgccagagcctgcacaaccaccagccctgtggctgcctggtgttcagccaccctgagcccggctactgccagctgctgcccccaggcagccctgtgacctgcctgcctgctgtgcccggcatcctgaacctgaacagccagctgcagatgcctggggacaccctgagcctgaccctgcacctgagccaggaggccaccaacctgtcctggttcctgcggcaccctggcagccccagccccatcctgctgcagcccggcacccaggtgtctgtgaccagcagccacggccaggccgccctgtctgtgagcaacatgagccaccactgggccggggagtacatgagctgctttgaggcccagggcttcaagtggaacctgtatgaggtggtgcgggtgcccctgaaggccacagatgtggcccggctgccctaccagctgagcatcagctgtgccaccagccctggcttccagctgagctgctgcatccccagcaccaacctggcctacacagctgcctggagccctggagagggcagcaaggccagcagcttcaatgaaagtggcagccagtgctttgtgctggccgtgcagcgctgccccatggctgacaccacctacgcctgtgacctgcagagcctgggcctggcccccctgcgggtgcccatcagcatcaccatcatccaggatggagacatcacctgcccagaagatgcctctgtgctgacctggaatgtgaccaaggccggccacgtggcccaggccccctgcccagagagcaagaggggcatcgtgcggcggctgtgtggggctgatggagtgtggggccctgtgcacagcagctgcacagatgcccggctgctggccctcttcaccaggaccaagctgctgcaggccggccagggcagccctgctgaggaggtgccccagatcctggcccagctgcccggccaggccgctgaggccagcagccccagcgacctgctgaccctgctgagcaccatgaagtatgtggccaaggtggtggccgaggcccgcatccagctggaccggcgggccctgaagaacctgctgattgccacagacaaggtgctggacatggacaccaggagcctgtggaccctggcccaggccaggaagccctgggccggcagcaccctgctgctggccgtggagaccctggcctgcagcctgtgcccccaggaccacccctttgccttcagcctgcccaacgtgctgctgcagagccagctgtttggccccaccttccctgctgactacagcatctccttccccacccggccccccctgcaggcccagatccccaggcacagcctggcccccctggtgagaaatggaacagagatcagcatcaccagcctggtgctgaggaagctggaccacctgctgcccagcaactacggccagggcctgggggacagcctgtatgccaccccaggcctggtgctggtgatcagcatcatggccggggaccgggccttcagccagggcgaggtgatcatggactttggaaacacagatggcagcccccactgtgtgttctgggaccacagcctcttccagggccggggcggctggagcaaggagggctgccaggcccaggtggccagcgccagccccacagcccagtgcctgtgccagcacctgacagccttctctgtgctgatgagcccccacacagtgcctgaggagcccgccctggccctgctgacccaggtgggcctgggcgccagcatcctggccctgctggtgtgcctgggcgtgtactggctggtgtggagggtggtggtgaggaacaagatctcctacttcagacatgctgccctgctgaacatggtgttctgcctgctggccgctgacacctgcttcctgggcgcccccttcctgagccctggccccaggagccccctgtgcctggccgccgccttcctgtgccacttcctgtacctggccaccttcttctggatgctggcccaggccctggtgctggcccaccagctgctgtttgtgttccaccagctggccaagcaccgggtgctgcccctgatggtgctgctgggctacctgtgccccctgggcctggccggcgtgaccctgggcctgtacctgccccagggccagtacctgcgggagggggagtgctggctggatggaaaaggaggagccctgtacacctttgtgggccctgtgctggccatcatcggcgtgaatggcctggtgctggccatggccatgctgaagctgctgcggcccagcctgtctgagggccccccagctgagaagaggcaggccctgctgggcgtcatcaaggccctgctgatcctgacccccatcttcggcctgacctggggcctgggcctggccaccctgctggaggaggtgtccacagtgccccactacatcttcaccatcctgaacaccctgcagggcgtcttcatcctgctgtttggctgcctgatggacaggaagatccaggaggccctgaggaagcgcttctgccgggcccaggcccccagcagcaccatcagcctggccaccaatgaaggctgcatcctggagcacagcaagggcggcagtgacacagccaggtag

SEQ ID NO: 34440 - DNA, 1587 bp, Artificial Sequence
  Description of Artificial Sequence: Synthetic coding sequence
atggaccactgtggggccctcttcctgtgcctgtgcctgctgaccctgcagaatgccaccacagagacctgggaggagctgctgagctacatggagaacatgcaggtgtcccggggccgcagcagcgtcttcagcagccggcagctgcaccagctggagcagatgctgctgaacaccagcttccctggctacaacctgaccctgcagacccccaccatccagagcctggccttcaagctgagctgtgacttcagcggcctgagcctgaccagcgccaccctgaagagggtgccccaggccggcggccagcacgcccggggccagcacgccatgcagtttcctgctgagctgaccagagatgcctgcaagacccggccccgggagctgcggctcatctgcatctacttcagcaacacccacttcttcaaggatgagaacaacagcagcctgctgaacaactacgtgctgggcgcccagctgagccacggccacgtgaacaacctgcgggaccctgtgaacatctccttctggcacaaccagagcctggagggctacaccctgacctgtgtgttctggaaggagggcgccaggaagcagccctggggcggctggagccctgagggctgcaggacagagcagcccagccacagccaggtgctgtgccgctgcaaccacctgacctactttgctgtgctgatgcagctgagccctgccctggtgcctgctgagctgctggcccccctgacctacatcagcctggtgggctgcagcatcagcatcgtggccagcctcatcaccgtgctgctgcacttccacttcaggaagcagagcgacagcctgacccgcatccacatgaacctgcacgcctctgtgctgctgctgaacatcgccttcctgctgagccctgcctttgccatgagccctgtgcccggcagcgcctgcacagccctggccgccgccctgcactacgccctgctgagctgcctgacctggatggccatcgagggcttcaacctgtacctgctgctgggccgggtgtacaacatctacatccgccgctacgtgttcaagctgggcgtgctgggctggggcgccccagccctgctggtgctgctgagcctgtctgtgaagagctctgtgtatggcccctgcaccatccctgtgtttgacagctgggagaatggcaccggcttccagaacatgagcatctgctgggtgcgcagccctgtggtgcacagcgtgctggtgatgggctatggaggcctgaccagcctcttcaacctggtggtgctggcctgggccctgtggaccctgcggcggctgcgggagcgggcagatgcccccagcgtgcgggcctgccacgacacagtgacagtgctgggcctgactgtgctgctgggcaccacctgggccctggccttcttctcctttggagtcttcctgctgccccagctgttcctgttcaccatcctgaacagcctgtatggcttcttcctgttcctgtggttctgcagccagcgctgccgctctgaggccgaggccaaggcccagatcgaggccttcagcagcagccagaccacccagtag

SEQ ID NO: 34441 - DNA, 1713 bp, Artificial Sequence
  Description of Artificial Sequence: Synthetic coding sequence
atggaccactgtggggccctcttcctgtgcctgtgcctgctgaccctgcagaatgccaccacagagacctgggaggagctgctgagctacatggagaacatgcaggtgtcccggggccgcagcagcgtcttcagcagccggcagctgcaccagctggagcagatgctgctgaacaccagcttccctggctacaacctgaccctgcagacccccaccatccagagcctggccttcaagctgagctgtgacttcagcggcctgagcctgaccagcgccaccctgaagagggtgccccaggccggcggccagcacgcccggggccagcacgccatgcagtttcctgctgagctgaccagagatgcctgcaagacccggccccgggagctgcggctcatctgcatctacttcagcaacacccacttcttcaaggatgagaacaacagcagcctgctgaacaactacgtgctgggcgcccagctgagccacggccacgtgaacaacctgcgggaccctgtgaacatctccttctggcacaaccagagcctggagggctacaccctgacctgtgtgttctggaaggagggcgccaggaagcagccctggggcggctggagccctgagggctgcaggacagagcagcccagccacagccaggtgctgtgccgctgcaaccacctgacctactttgctgtgctgatgcagctgagccctgccctggtgcctgctgagctgctggcccccctgacctacatcagcctggtgggctgcagcatcagcatcgtggccagcctcatcaccgtgctgctgcacttccacttcaggaagcagagcgacagcctgacccgcatccacatgaacctgcacgcctctgtgctgctgctgaacatcgccttcctgctgagccctgcctttgccatgagccctgtgcccggcagcgcctgcacagccctggccgccgccctgcactacgccctgctgagctgcctgacctggatggccatcgagggcttcaacctgtacctgctgctgggccgggtgtacaacatctacatccgccgctacgtgttcaagctgggcgtgctgggctggggcgccccagccctgctggtgctgctgagcctgtctgtgaagagctctgtgtatggcccctgcaccatccctgtgtttgacagctgggagaatggcaccggcttccagaacatgagcatctgctgggtgcgcagccctgtggtgcacagcgtgctggtgatgggctatggaggcctgaccagcctcttcaacctggtggtgctggcctgggccctgtggaccctgcggcggctgcgggagcgggcagatgcccccagcgtgcgggcctgccacgacacagtgacagtgctgggcctgactgtgctgctgggcaccacctgggccctggccttcttctcctttggagtcttcctgctgccccagctgttcctgttcaccatcctgaacagcctgtatggaaaaggaggcggcaccgtgtccaagaagagtgatgacaccaccgtcttcctgaagaatgatgaaacagcctggggcaagctgctgtgcctgccctacagcggcttcttcttcagcaagcccatcagcagcctggccatgatccggggcaacaccccagcccctgtgggcggagatgacatcccagccatctatgaggtggagcacttccagcaggagcaggtgtag

SEQ ID NO: 34442 - DNA, 1356 bp, Artificial Sequence
  Description of Artificial Sequence: Synthetic coding sequence
atggaccactgtggggccctcttcctgtgcctgtgcctgctgaccctgcagaatgccaccacagagacctgggaggagctgctgagctacatggagaacatgcaggtgtcccggggccgcagcagcgtcttcagcagccggcagctgcaccagctggagcagatgctgctgaacaccagcttccctggctacaacctgaccctgcagacccccaccatccagagcctggccttcaagctgagctgtgacttcagcggcctgagcctgaccagcgccaccctgaagagggtgccccaggccggcggccagcacgcccggggccagcacgccatgcagtttcctgctgagctgaccagagatgcctgcaagacccggccccgggagctgcggctcatctgcatctacttcagcaacacccacttcttcaaggatgagaacaacagcagcctgctgaacaactacgtgctgggcgcccagctgagccacggccacgtgaacaacctgcgggaccctgtgaacatctccttctggcacaaccagagcctggagggctacaccctgacctgtgtgttctggaaggagggcgccaggaagcagccctggggcggctggagccctgagggctgcaggacagagcagcccagccacagccaggtgctgtgccgctgcaaccacctgacctactttgctgtgctgatgcagctgagccctgccctggtgcctgctgagctgctggcccccctgacctacatcagcctggtgggctgcagcatcagcatcgtggccagcctcatcaccgtgctgctgcacttccacttcaggaagcagagcgacagcctgacccgcatccacatgaacctgcacgcctctgtgctgctgctgaacatcgccttcctgctgagccctgcctttgccatgagccctgtgcccggcagcgcctgcacagccctggccgccgccctgcactacgccctgctgagctgcctgacctggatggccatcgagggcttcaacctgtacctgctgctgggccgggtgtacaacatctacatccgccgctacgtgttcaagctgggcgtgctgggctgggatgctggctgtggggccccctggtgcaccgtgtcctggagctgggccacagctgccagccggcccagcagcacctggtggtgctggccaggccgctgtggcccctgtgccggctgcggcagcggccgcatgcaccaggtgtctggccctgccatgaccctgagcctgtgctgggccagcccctgctgctgggagcccccaggcccctggcccagcttcctgctggccagcagctgctgccccagctgcagcagcagccccagctag

SEQ ID NO: 34443 - DNA, 4041 bp, Artificial Sequence
  Description of Artificial Sequence: Synthetic coding sequence
atgaagagccccaggaggaccaccctgtgcctgatgttcatcgtcatctacagcagcaaggccgccctgaactggaactatgagagcaccatccaccccctgagcctgcatgaacatgagcctgctggggaggaggccctgcggcagaagagagctgtggccaccaagagccccacagctgaggagtacacagtgaacatcgagatcagctttgaaaatgccagcttcctggaccccatcaaggcctacctgaacagcctgtccttccccatccacggcaacaacacagaccagatcacagacatcctgagcatcaacgtgaccaccgtgtgcaggcctgctggaaatgagatctggtgcagctgtgagaccggctacggctggccccgggagcgctgcctgcacaacctgatctgccaggagagagatgtgttcctgcccggccaccactgcagctgcctgaaggagctgccccccaacggccccttctgcctgctgcaggaggatgtgaccctgaacatgagggtgcggctgaatgtgggcttccaggaggacctgatgaacaccagcagcgccctgtaccgcagctacaagacagacctggagacagccttcaggaagggctacggcatcctgcccggcttcaagggcgtgacagtgacaggcttcaagagcggctctgtggtggtgacctatgaggtgaagaccaccccacccagcctggagctgatccacaaggccaatgagcaggtggtgcagagcctgaaccagacctacaagatggactacaacagcttccaggccgtgaccatcaatgaaagcaacttctttgtgaccccagagatcatctttgaaggagacacagtgtccctggtgtgtgagaaggaggtgctgagcagcaatgtgtcctggaggtatgaggagcagcagctggagatccagaacagcagccgcttcagcatctacacagccctcttcaacaacatgacctctgtgtccaagctgaccatccacaacatcaccccaggagatgctggggagtatgtgtgcaagctgatcctggacatctttgaatatgagtgcaagaagaagattgatgtgatgcccatccagatcctggccaatgaggagatgaaggtgatgtgtgacaacaaccctgtgtccctgaactgctgcagccagggcaatgtgaactggagcaaggtggagtggaagcaggagggcaagatcaacatccctggcaccccagagacagacatcgacagcagctgcagccgctacaccctgaaggcagatggcacccagtgccccagcggcagcagcggcaccaccgtcatctacacctgtgagttcatcagcgcctatggagcccggggcagcgccaacatcaaggtgaccttcatctctgtggccaacctgaccatcaccccagaccccatctctgtgtctgagggccagaacttcagcatcaagtgcatcagtgatgtgagcaactatgatgaggtgtactggaacaccagcgctggcatcaagatctaccagcgcttctacaccacccggcgctacctggatggagctgagagcgtgctgactgtgaagaccagcacccgggagtggaatggcacctaccactgcatcttccgctacaagaacagctacagcatcgccaccaaggatgtgattgtgcaccccctgcccctgaagctgaacatcatggtggaccccctggaggccaccgtgtcctgcagcggcagccaccacatcaagtgctgcatcgaggaggatggagactacaaggtgaccttccacacaggcagcagcagcctgcctgctgccaaggaggtgaacaagaagcaggtgtgctacaagcacaacttcaatgccagctctgtgtcctggtgcagcaagacagtggatgtgtgctgccacttcaccaatgctgccaacaacagcgtgtggagccccagcatgaagctgaacctggtgcctggagagaacatcacctgccaggaccccgtcatcggcgtgggggagcccgggaaggtgatccagaagctgtgccgcttcagcaatgtgcccagcagccctgagagccccatcggcggcaccatcacctacaagtgtgtgggcagccagtgggaggagaagagaaatgactgcatcagcgcccccatcaacagcctgctgcagatggccaaggccctgatcaagagccccagccaggatgagatgctgcccacctacctgaaggacctgagcatcagcattgacaaggccgagcacgagatcagcagcagccctggcagcctgggcgccatcatcaacatcctggacctgctgagcacagtgcccacccaggtgaacagcgagatgatgacccacgtgctgagcacagtgaatgtcatcctgggcaagcctgtgctgaacacctggaaggtgctgcagcagcagtggaccaaccagagcagccagctgctgcacagcgtggagcgcttcagccaggccctgcagagcggggacagcccccccctgtccttcagccagaccaacgtgcagatgagctccatggtgatcaagagcagccaccctgagacctaccagcagagatttgtgttcccctactttgacctgtggggcaatgtggtgattgacaagagctacctggagaacctgcagagcgacagcagcatcgtgaccatggccttccccaccctgcaggccatcctggcccaggacatccaggagaacaactttgctgagagcctggtgatgaccaccaccgtgagccacaacaccaccatgcccttccgcatctccatgaccttcaagaacaacagccccagcggcggggagaccaagtgtgtgttctggaacttccggctggccaacaacacaggaggctgggacagcagcggctgctacgtggaggagggagatggagacaacgtgacctgcatctgtgaccacctgaccagcttcagcatcctgatgagcccagacagcccagaccccagcagcctgctgggcatcctgctggacatcatctcctatgtgggcgtgggcttcagcatcctgagcctggccgcctgcctggtggtggaggccgtggtgtggaagtctgtgaccaagaacagaaccagctacatgaggcacacctgcatcgtgaacattgctgccagcctgctggtggccaacacctggttcatcgtggtggccgccatccaggacaaccgctacatcctgtgcaagacagcctgtgtggccgccaccttcttcatccacttcttctacctgtctgtgttcttctggatgctgaccctgggcctgatgctgttctaccgcctggtgttcatcctgcacgagaccagccgcagcacccagaaggccatcgccttctgcctgggctacggctgccccctggccatcagcgtcatcaccctgggcgccacccagccccgggaggtgtacaccaggaagaatgtgtgctggctgaactgggaggacaccaaggccctgctggcctttgccatcccagccctgatcatcgtggtggtgaacatcaccatcaccatcgtggtgatcaccaagatcctgcggcccagcatcggggacaagccctgcaagcaggagaagagcagcctcttccagatcagcaagagcattggagtgctgacccccctgctgggcctgacctggggcttcggcctgaccaccgtcttccctggcaccaacctggtgttccacatcatctttgccatcctgaatgtgttccagggcctcttcatcctgctgtttggctgcctgtgggacctgaaggtgcaggaggccctgctgaacaagttcagcctgagccgctggagcagccagcacagcaagagcaccagcctgggcagcagcacccctgtgttctccatgagcagccccatcagccgccgcttcaacaacctgtttgggaagacaggcacctacaacgtgtccaccccagaggccaccagcagcagcctggagaacagcagcagcgccagcagcctgctgaactag

SEQ ID NO: 34444 - DNA, 4041 bp, Artificial Sequence; identical to SEQ ID NO: 34443
  Description of Artificial Sequence: Synthetic coding sequence

SEQ ID NO: 34445 - DNA, 3981 bp, Artificial Sequence
  Description of Artificial Sequence: Synthetic coding sequence
atgaagagccccaggaggaccaccctgtgcctgatgttcatcgtcatctacagcagcaaggccgccctgaactggaactatgagagcaccatccaccccctgagcctgcatgaacatgagcctgctggggaggaggccctgcggcagaagagagctgtggccaccaagagccccacagctgaggagtacacagtgaacatcgagatcagctttgaaaatgccagcttcctggaccccatcaaggcctacctgaacagcctgtccttccccatccacggcaacaacacagaccagatcacagacatcctgagcatcaacgtgaccaccgtgtgcaggcctgctggaaatgagatctggtgcagctgtgagaccggctacggctggccccgggagcgctgcctgcacaacctgatctgccaggagagagatgtgttcctgcccggccaccactgcagctgcctgaaggagctgccccccaacggccccttctgcctgctgcaggaggatgtgaccctgaacatgagggtgcggctgaatgtgggcttccaggaggacctgatgaacaccagcagcgccctgtaccgcagctacaagacagacctggagacagccttcaggaagggctacggcatcctgcccggcttcaagggcgtgacagtgacaggcttcaagagcggctctgtggtggtgacctatgaggtgaagaccaccccacccagcctggagctgatccacaaggccaatgagcaggtggtgcagagcctgaaccagacctacaagatggactacaacagcttccaggccgtgaccatcaatgaaagcaacttctttgtgaccccagagatcatctttgaaggagacacagtgtccctggtgtgtgagaaggaggtgctgagcagcaatgtgtcctggaggtatgaggagcagcagctggagatccagaacagcagccgcttcagcatctacacagccctcttcaacaacatgacctctgtgtccaagctgaccatccacaacatcaccccaggagatgctggggagtatgtgtgcaagctgatcctggacatctttgaatatgagtgcaagaagaagattgatgtgatgcccatccagatcctggccaatgaggagatgaaggtgatgtgtgacaacaaccctgtgtccctgaactgctgcagccagggcaatgtgaactggagcaaggtggagtggaagcaggagggcaagatcaacatccctggcaccccagagacagacatcgacagcagctgcagccgctacaccctgaaggcagatggcacccagtgccccagcggcagcagcggcaccaccgtcatctacacctgtgagttcatcagcgcctatggagcccggggcagcgccaacatcaaggtgaccttcatctctgtggccaacctgaccatcaccccagaccccatctctgtgtctgagggccagaacttcagcatcaagtgcatcagtgatgtgagcaactatgatgaggtgtactggaacaccagcgctggcatcaagatctaccagcgcttctacaccacccggcgctacctggatggagctgagagcgtgctgactgtgaagaccagcacccgggagtggaatggcacctaccactgcatcttccgctacaagaacagctacagcatcgccaccaaggatgtgattgtgcaccccctgcccctgaagctgaacatcatggtggaccccctggaggccaccgtgtcctgcagcggcagccaccacatcaagtgctgcatcgaggaggatggagactacaaggtgaccttccacacaggcagcagcagcctgcctgctgccaaggaggtgaacaagaagcaggtgtgctacaagcacaacttcaatgccagctctgtgtcctggtgcagcaagacagtggatgtgtgctgccacttcaccaatgctgccaacaacagcgtgtggagccccagcatgaagctgaacctggtgcctggagagaacatcacctgccaggaccccgtcatcggcgtgggggagcccgggaaggtgatccagaagctgtgccgcttcagcaatgtgcccagcagccctgagagccccatcggcggcaccatcacctacaagtgtgtgggcagccagtgggaggagaagagaaatgactgcatcagcgcccccatcaacagcctgctgcagatggccaaggccctgatcaagagccccagccaggatgagatgctgcccacctacctgaaggacctgagcatcagcattgacaaggccgagcacgagatcagcagcagccctggcagcctgggcgccatcatcaacatcctggacctgctgagcacagtgcccacccaggtgaacagcgagatgatgacccacgtgctgagcacagtgaatgtcatcctgggcaagcctgtgctgaacacctggaaggtgctgcagcagcagtggaccaaccagagcagccagctgctgcacagcgtggagcgcttcagccaggccctgcagagcggggacagcccccccctgtccttcagccagaccaacgtgcagatgagctccatggtgatcaagagcagccaccctgagacctaccagcagagatttgtgttcccctactttgacctgtggggcaatgtggtgattgacaagagctacctggagaacctgcagagcgacagcagcatcgtgaccatggccttccccaccctgcaggccatcctggcccaggacatccaggagaacaactttgctgagagcctggtgatgaccaccaccgtgagccacaacaccaccatgcccttccgcatctccatgaccttcaagaacaacagccccagcggcggggagaccaagtgtgtgttctggaacttccggctggccaacaacacaggaggctgggacagcagcggctgctacgtggaggagggagatggagacaacgtgacctgcatctgtgaccacctgaccagcttcagcatcctgatgagcccagacagcccagaccccagcagcctgctgggcatcctgctggacatcatctcctatgtgggcgtgggcttcagcatcctgagcctggccgcctgcctggtggtggaggccgtggtgtggaagtctgtgaccaagaacagaaccagctacatgaggcacacctgcatcgtgaacattgctgccagcctgctggtggccaacacctggttcatcgtggtggccgccatccaggacaaccgctacatcctgtgcaagacagcctgtgtggccgccaccttcttcatccacttcttctacctgtctgtgttcttctggatgctgaccctgggcctgatgctgttctaccgcctggtgttcatcctgcacgagaccagccgcagcacccagaaggccatcgccttctgcctgggctacggctgccccctggccatcagcgtcatcaccctgggcgccacccagccccgggaggtgtacaccaggaagaatgtgtgctggctgaactgggaggacaccaaggccctgctggcctttgccatcccagccctgatcatcgtggtggtgaacatcaccatcaccatcgtggtgatcaccaagatcctgcggcccagcatcggggacaagccctgcaagcaggagaagagcagcctcttccagatcagcaagagcattggagtgctgacccccctgctgggcctgacctggggcttcggcctgaccaccgtcttccctggcaccaacctggtgttccacatcatctttgccatcctgaatgtgttccagggcctcttcatcctgctgtttggctgcctgtgggacctgaagagcaccagcctgggcagcagcacccctgtgttctccatgagcagccccatcagccgccgcttcaacaacctgtttgggaagacaggcacctacaacgtgtccaccccagaggccaccagcagcagcctggagaacagcagcagcgccagcagcctgctgaactag

SEQ ID NO: 34446 - DNA, 4041 bp, Artificial Sequence; identical to SEQ ID NO: 34443
  Description of Artificial Sequence: Synthetic coding sequence

SEQ ID NO: 34447 - DNA, 3615 bp, Artificial Sequence
  Description of Artificial Sequence: Synthetic coding sequence
atgaagagccccaggaggaccaccctgtgcctgatgttcatcgtcatctacagcagcaaggccgccctgaactggaactatgagagcaccatccaccccctgagcctgcatgaacatgagcctgctggggaggaggccctgcggcagaagagagctgtggccaccaagagccccacagctgaggagtacacagtgaacatcgagatcagctttgaaaatgccagcttcctggaccccatcaaggcctacctgaacagcctgtccttccccatccacggcaacaacacagaccagatcacagacatcctgagcatcaacgtgaccaccgtgtgcaggcctgctggaaatgagatctggtgcagctgtgagaccggctacggctggccccgggagcgctgcctgcacaacctgatctgccaggagagagatgtgttcctgcccggccaccactgcagctgcctgaaggagctgccccccaacggccccttctgcctgctgcaggaggatgtgaccctgaacatgagggtgcggctgaatgtgggcttccaggaggacctgatgaacaccagcagcgccctgtaccgcagctacaagacagacctggagacagccttcaggaagggctacggcatcctgcccggcttcaagggcgtgacagtgacaggcttcaagagcggctctgtggtggtgacctatgaggtgaagaccaccccacccagcctggagctgatccacaaggccaatgagcaggtggtgcagagcctgaaccagacctacaagatggactacaacagcttccaggccgtgaccatccgcaccccagagacagacatcgacagcagctgcagccgctacaccctgaaggcagatggcacccagtgccccagcggcagcagcggcaccaccgtcatctacacctgtgagttcatcagcgcctatggagcccggggcagcgccaacatcaaggtgaccttcatctctgtggccaacctgaccatcaccccagaccccatctctgtgtctgagggccagaacttcagcatcaagtgcatcagtgatgtgagcaactatgatgaggtgtactggaacaccagcgctggcatcaagatctaccagcgcttctacaccacccggcgctacctggatggagctgagagcgtgctgactgtgaagaccagcacccgggagtggaatggcacctaccactgcatcttccgctacaagaacagctacagcatcgccaccaaggatgtgattgtgcaccccctgcccctgaagctgaacatcatggtggaccccctggaggccaccgtgtcctgcagcggcagccaccacatcaagtgctgcatcgaggaggatggagactacaaggtgaccttccacacaggcagcagcagcctgcctgctgccaaggaggtgaacaagaagcaggtgtgctacaagcacaacttcaatgccagctctgtgtcctggtgcagcaagacagtggatgtgtgctgccacttcaccaatgctgccaacaacagcgtgtggagccccagcatgaagctgaacctggtgcctggagagaacatcacctgccaggaccccgtcatcggcgtgggggagcccgggaaggtgatccagaagctgtgccgcttcagcaatgtgcccagcagccctgagagccccatcggcggcaccatcacctacaagtgtgtgggcagccagtgggaggagaagagaaatgactgcatcagcgcccccatcaacagcctgctgcagatggccaaggccctgatcaagagccccagccaggatgagatgctgcccacctacctgaaggacctgagcatcagcattgacaaggccgagcacgagatcagcagcagccctggcagcctgggcgccatcatcaacatcctggacctgctgagcacagtgcccacccaggtgaacagcgagatgatgacccacgtgctgagcacagtgaatgtcatcctgggcaagcctgtgctgaacacctggaaggtgctgcagcagcagtggaccaaccagagcagccagctgctgcacagcgtggagcgcttcagccaggccctgcagagcggggacagcccccccctgtccttcagccagaccaacgtgcagatgagctccatggtgatcaagagcagccaccctgagacctaccagcagagatttgtgttcccctactttgacctgtggggcaatgtggtgattgacaagagctacctggagaacctgcagagcgacagcagcatcgtgaccatggccttccccaccctgcaggccatcctggcccaggacatccaggagaacaactttgctgagagcctggtgatgaccaccaccgtgagccacaacaccaccatgcccttccgcatctccatgaccttcaagaacaacagccccagcggcggggagaccaagtgtgtgttctggaacttccggctggccaacaacacaggaggctgggacagcagcggctgctacgtggaggagggagatggagacaacgtgacctgcatctgtgaccacctgaccagcttcagcatcctgatgagcccagacagcccagaccccagcagcctgctgggcatcctgctggacatcatctcctatgtgggcgtgggcttcagcatcctgagcctggccgcctgcctggtggtggaggccgtggtgtggaagtctgtgaccaagaacagaaccagctacatgaggcacacctgcatcgtgaacattgctgccagcctgctggtggccaacacctggttcatcgtggtggccgccatccaggacaaccgctacatcctgtgcaagacagcctgtgtggccgccaccttcttcatccacttcttctacctgtctgtgttcttctggatgctgaccctgggcctgatgctgttctaccgcctggtgttcatcctgcacgagaccagccgcagcacccagaaggccatcgccttctgcctgggctacggctgccccctggccatcagcgtcatcaccctgggcgccacccagccccgggaggtgtacaccaggaagaatgtgtgctggctgaactgggaggacaccaaggccctgctggcctttgccatcccagccctgatcatcgtggtggtgaacatcaccatcaccatcgtggtgatcaccaagatcctgcggcccagcatcggggacaagccctgcaagcaggagaagagcagcctcttccagatcagcaagagcattggagtgctgacccccctgctgggcctgacctggggcttcggcctgaccaccgtcttccctggcaccaacctggtgttccacatcatctttgccatcctgaatgtgttccagggcctcttcatcctgctgtttggctgcctgtgggacctgaaggtgcaggaggccctgctgaacaagttcagcctgagccgctggagcagccagcacagcaagagcaccagcctgggcagcagcacccctgtgttctccatgagcagccccatcagccgccgcttcaacaacctgtttgggaagacaggcacctacaacgtgtccaccccagaggccaccagcagcagcctggagaacagcagcagcgccagcagcctgctgaactag

SEQ ID NO: 34448 - DNA, 2154 bp, Artificial Sequence
  Description of Artificial Sequence: Synthetic coding sequence
gactaccgcagccaggtgcacgtggagagccgggagggcctgtggaagatcaagggcaagatcaagaagctgggcagcagcgagaaggtgacagagagcaagggggagaacatcacctgccaggaccctgtgattggagtgggggagcccgggaaggtgatccagaagctgtgccgcttcagcaatgtgcccagcagccctgagagccccatcggcggcaccatcacctacaagtgtgtgggcagccagtgggaggagaagagaaatgactgcatcagcgcccccatcaacagcctgctgcagatggccaaggccctgatcaagagccccagccaggatgagatgctgcccacctacctgaaggacctgagcatcagcattgacaaggccgagcacgagatcagcagcagccctggcagcctgggcgccatcatcaacatcctggacctgctgagcacagtgcccacccaggtgaacagcgagatgatgacccacgtgctgagcacagtgaatgtcatcctgggcaagcctgtgctgaacacctggaaggtgctgcagcagcagtggaccaaccagagcagccagctgctgcacagcgtggagcgcttcagccaggccctgcagagcggggacagcccccccctgtccttcagccagaccaacgtgcagatgagctccatggtgatcaagagcagccaccctgagacctaccagcagagatttgtgttcccctactttgacctgtggggcaatgtggtgattgacaagagctacctggagaacctgcagagcgacagcagcatcgtgaccatggccttccccaccctgcaggccatcctggcccaggacatccaggagaacaactttgctgagagcctggtgatgaccaccaccgtgagccacaacaccaccatgcccttccgcatctccatgaccttcaagaacaacagccccagcggcggggagaccaagtgtgtgttctggaacttccggctggccaacaacacaggaggctgggacagcagcggctgctacgtggaggagggagatggagacaacgtgacctgcatctgtgaccacctgaccagcttcagcatcctgatgagcccagacagcccagaccccagcagcctgctgggcatcctgctggacatcatctcctatgtgggcgtgggcttcagcatcctgagcctggccgcctgcctggtggtggaggccgtggtgtggaagtctgtgaccaagaacagaaccagctacatgaggcacacctgcatcgtgaacattgctgccagcctgctggtggccaacacctggttcatcgtggtggccgccatccaggacaaccgctacatcctgtgcaagacagcctgtgtggccgccaccttcttcatccacttcttctacctgagcgtcttcttctggatgctgaccctgggcctgatgctgttctaccgcctggtgttcatcctgcacgagaccagccgcagcacccagaaggccatcgccttctgcctgggctacggctgccccctggccatcagcgtcatcaccctgggcgccacccagccccgggaggtgtacaccaggaagaatgtgtgctggctgaactgggaggacaccaaggccctgctggcctttgccatcccagccctgatcatcgtggtggtgaacatcaccatcaccatcgtggtgatcaccaagatcctgcggcccagcattggagacaagccctgcaagcaggagaagagcagcctcttccagatcagcaagagcattggagtgctgacccccctgctgggcctgacctggggcttcggcctgaccaccgtcttccctggcaccaacctggtgttccacatcatctttgccatcctgaatgtgttccagggcctcttcatcctgctgtttggctgcctgtgggacctgaaggtgcaggaggccctgctgaacaagttcagcctgagccgctggagcagccagcacagcaagagcaccagcctgggcagcagcacccctgtgttctccatgagcagccccatcagccgccgcttcaacaacctgtttgggaagacaggcacctacaacgtgtccaccccagaggccaccagcagcagcctggagaacagcagcagcgccagcagcctgctgaactag

SEQ ID NO: 34449 - DNA, 2313 bp, Artificial Sequence
  Description of Artificial Sequence: Synthetic coding sequence
atggtggaccccctggaggccaccgtgtcctgcagcggcagccaccacatcaagtgctgcattgaagaagatggagactacaaggtgaccttccacacaggcagcagcagcctgcctgctgccaaggaggtgaacaagaagcaggtgtgctacaagcacaacttcaatgccagctctgtgtcctggtgcagcaagacagtggatgtgtgctgccacttcaccaatgctgccaacaacagcgtgtggagccccagcatgaagctgaacctggtgcctggagagaacatcacctgccaggaccctgtgattggagtgggggagcccgggaaggtgatccagaagctgtgccgcttcagcaatgtgcccagcagccctgagagccccatcggcggcaccatcacctacaagtgtgtgggcagccagtgggaggagaagagaaatgactgcatcagcgcccccatcaacagcctgctgcagatggccaaggccctgatcaagagccccagccaggatgagatgctgcccacctacctgaaggacctgagcatcagcattgacaaggccgagcacgagatcagcagcagccctggcagcctgggcgccatcatcaacatcctggacctgctgagcacagtgcccacccaggtgaacagcgagatgatgacccacgtgctgagcacagtgaatgtcatcctgggcaagcctgtgctgaacacctggaaggtgctgcagcagcagtggaccaaccagagcagccagctgctgcacagcgtggagcgcttcagccaggccctgcagagcggggacagcccccccctgtccttcagccagaccaacgtgcagatgagctccatggtgatcaagagcagccaccctgagacctaccagcagagatttgtgttcccctactttgacctgtggggcaatgtggtgattgacaagagctacctggagaacctgcagagcgacagcagcatcgtgaccatggccttccccaccctgcaggccatcctggcccaggacatccaggagaacaactttgctgagagcctggtgatgaccaccaccgtgagccacaacaccaccatgcccttccgcatctccatgaccttcaagaacaacagccccagcggcggggagaccaagtgtgtgttctggaacttccggctggccaacaacacaggaggctgggacagcagcggctgctacgtggaggagggagatggagacaacgtgacctgcatctgtgaccacctgaccagcttcagcatcctgatgagcccagacagcccagaccccagcagcctgctgggcatcctgctggacatcatctcctatgtgggcgtgggcttcagcatcctgagcctggccgcctgcctggtggtggaggccgtggtgtggaagtctgtgaccaagaacagaaccagctacatgaggcacacctgcatcgtgaacattgctgccagcctgctggtggccaacacctggttcatcgtggtggccgccatccaggacaaccgctacatcctgtgcaagacagcctgtgtggccgccaccttcttcatccacttcttctacctgagcgtcttcttctggatgctgaccctgggcctgatgctgttctaccgcctggtgttcatcctgcacgagaccagccgcagcacccagaaggccatcgccttctgcctgggctacggctgccccctggccatcagcgtcatcaccctgggcgccacccagccccgggaggtgtacaccaggaagaatgtgtgctggctgaactgggaggacaccaaggccctgctggcctttgccatcccagccctgatcatcgtggtggtgaacatcaccatcaccatcgtggtgatcaccaagatcctgcggcccagcattggagacaagccctgcaagcaggagaagagcagcctcttccagatcagcaagagcattggagtgctgacccccctgctgggcctgacctggggcttcggcctgaccaccgtcttccctggcaccaacctggtgttccacatcatctttgccatcctgaatgtgttccagggcctcttcatcctgctgtttggctgcctgtgggacctgaaggtgcaggaggccctgctgaacaagttcagcctgagccgctggagcagccagcacagcaagagcaccagcctgggcagcagcacccctgtgttctccatgagcagccccatcagccgccgcttcaacaacctgtttgggaagacagctgcccccaagatccccccaggccatgatggcaacctggtgtctgggggcagcagcgccatctag

SEQ ID NO: 34450 - DNA, 1008 bp, Artificial Sequence
  Description of Artificial Sequence: Synthetic coding sequence
atggagagcagcttctcctttggagtcatcctggccgtgctggccagcctcatcatcgccaccaacaccctggtggccgtggccgtgctgctgctgatccacaagaatgatggagtgtccctgtgcttcaccctgaacctggccgtggccgacaccctcatcggcgtggccatcagcggcctgctgacagaccagctgagcagccccagccggcccacccagaagaccctgtgcagcctgaggatggcctttgtgaccagcagcgctgctgcctctgtgctgactgtgatgctgatcacctttgaccgctacctggccatcaagcagcccttccgctacctgaagatcatgagcggctttgtggccggggcctgcatcgccggcctgtggctggtgtcctacctgattggcttcctgcccctgggcatccccatgttccagcagacagcctacaagggccagtgcagcttctttgctgtgttccacccccactttgtgctgaccctgagctgtgtgggcttcttccctgccatgctgctgtttgtgttcttctactgtgacatgctgaagatcgcctccatgcacagccagcagatcaggaagatggagcacgccggggccatggccggcggctaccgcagccccaggacccccagcgacttcaaggccctgaggacagtgtctgtgctgattggcagctttgccctgtcctggacccccttcctgatcaccggcatcgtgcaggtggcctgccaggagtgccacctgtacctggtgctggagcgctacctgtggctgctgggcgtgggcaacagcctgctgaaccccctcatctatgcctactggcagaaggaggtgcggctgcagctgtaccacatggccctgggcgtgaagaaggtgctgaccagcttcctgctcttcctgagcgccaggaactgtggccctgagcggccccgggagagcagctgccacatcgtgaccatcagcagcagcgagtttgatggatag

SEQ ID NO: 34451 - DNA, 1485 bp, Artificial Sequence
  Description of Artificial Sequence: Synthetic coding sequence
atggaggagccccagcccccccggcccccagcctccatggccctgctgggcagccagcacagcggggcccccagcgctgctggccccccaggcggcaccagcagcgctgccacagctgctgtgctgtccttcagcacagtggccacagctgccctgggcaacctgagtgatgccagcggcggcggcacagctgctgcccctgggggcggcggcctgggcggcagcggggccgcccgggaggccggggctgctgtgcggcggcccctgggccctgaggccgcccccctgctgagccatggagctgctgtggccgcccaggccctggtgctgctgctgatcttcctgctgagcagcctgggcaactgtgctgtgatgggcgtcatcgtgaagcaccggcagctgaggacagtgaccaatgccttcatcctgagcctgagcctgagtgacctgctgacagccctgctgtgcctgcctgctgccttcctggacctcttcaccccacctgggggcagcgccccagctgctgctgctggcccctggaggggcttctgtgccgccagccgcttcttcagcagctgcttcggcatcgtgtccaccctgtctgtggccctgatcagcctggaccgctactgtgccatcgtgcggcccccccgggagaagattggaagaagaagagccctgcagctgctggccggggcctggctgacagccctgggcttcagcctgccctgggagctgctgggcgccccccgggagctggccgccgcccagagcttccacggctgcctgtaccgcaccagcccagaccctgcccagctgggcgccgccttctctgtgggcctggtggtggcctgctacctgctgcccttcctgctgatgtgcttctgccactaccacatctgcaagacagtgcggctgagtgatgtgcgggtgcggcctgtgaacacctacgcccgggtgctgcgcttcttcagcgaggtgaggacagccaccaccgtgctgatcatgattgtgtttgtgatctgctgctggggcccctactgcttcctggtgctgctggccgccgcccggcaggcccagaccatgcaggcccccagcctgctgtctgtggtggccgtgtggctgacctgggccaatggagccatcaaccctgtgatctatgccatccggaaccccaacatctccatgctgctgggcaggaaccgggaggagggctaccgcaccagaaatgtggatgccttcctgcccagccagggccctggcctgcaggcccggagccgcagccggctgaggaacagatatgccaaccggctgggcgcctgcaacaggatgagcagcagcaacccagccagcggcgtggccggagatgtggccatgtgggccaggaagaaccctgtggtgctcttctgccgggagggccccccagagcctgtgacagctgtgaccaagcagcccaagtctgaggccggggacaccagcctgtag

SEQ ID NO: 34452 - DNA, 1485 bp, Artificial Sequence; identical to SEQ ID NO: 34451
  Description of Artificial Sequence: Synthetic coding sequence

SEQ ID NO: 34453 - DNA, 969 bp, Artificial Sequence
  Description of Artificial Sequence: Synthetic coding sequence
atggccctgctgggcagccagcacagcggggcccccagcgctgctggccccccaggcggcaccagcagcgctgccacagctgctgtgctgtccttcagcacagtggccacagctgccctgggcaacctgagtgatgccagcggcggcggcacagctgctgcccctgggggcggcggcctgggcggcagcggggccgcccgggaggccggggctgctgtgcggcggcccctgggccctgaggccgcccccctgctgagccatggagctgctgtggccgcccaggccctggtgctgctgctgatcttcctgctgagcagcctgggcaactgtgctgtgatgggcgtcatcgtgaagcaccggcagctgaggacagtgaccaatgccttcatcctgagcctgagcctgagtgacctgctgacagccctgctgtgcctgcctgctgccttcctggacctcttcaccccacctgggggcagcgccccagctgctgctgctggcccctggaggggcttctgtgccgccagccgcttcttcagcagctgcttcggcatcgtgcacgcccagagaggagcccacctggtgggccccctgctgcgctacagaagaccaccccgggagaagattggaagaagaagagccctgcagctgctggccggggcctggctgacagccctgggcttcagcctgccctgggagctgctgggcgccccccgggagctggccgccgcccagagcttccacggctgcctgtaccgcaccagcccagaccctgcccagctgggcgccgccttctctgtgggcctggtggtggcctgctacctgctgcccttcctgctgatgtgcttctgccactaccacatctgcaagacagtgcggctgagtgatgtgcgggtgcggcctgtgaacacctacgcccgggtgctgcggagcagcgcccgctgtgcccggcccccacccagcagcagctag

SEQ ID NO: 34454 - DNA, 1254 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgccatgggcggggccatggtgctgctgtatgccagccgggcctgctacaacctgacagccctggccctggccccccagagccggctggacacctttgattatgactggtacaacgtgtctgaccaggccgacctggtgaatgacctgggcaacaagggctacctggtgtttggcctcatcctgtttgtgtgggagctgctgcccaccaccctgctggtgggcttcttccgggtgcaccggcccccccaggacctgagcaccagccacatcctgaatggccaggtgtttgccagccgcagctacttctttgacagagctggccactgtgaagatgagggctgctcctgggagcacagcagaggagagagcacccgctgccaggaccaggccgccaccaccaccgtgtccaccccaccccaccggcgggaccccccacccagccccacagagtacccaggccccagccccccccacccccggcccctgtgccaggtgtgcctgcccctgctggcccaggaccccggcggccggggctaccccctgctgtggccagccccctgctgcagctgccacagcgagctggtgcccagcccctag

SEQ ID NO: 34455 - DNA, 1041 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaaggctgacctggtgaatgacctgggcaacaagggctacctggtgtttggcctcatcctgtttgtgtgggagctgctgcccaccaccctgctggtgggcttcttccgggtgcaccggcccccccaggacctgagcaccagccacatcctgaatggccaggtgtttgccagccgcagctacttctttgacagagctggccactgtgaagatgagggctgctcctgggagcacagcagaggagagagcacctccatgagcggcagcctgggcagcggctcctggtatggagccatcggccgggagcccggctggtatggaggcagccagaccaagaccacccccctgctcttcagccaggtgcccggccctgggggccaccaccacagcctgtacagcaccccccagacctag

SEQ ID NO: 34456 - DNA, 1428 bp, Artificial Sequence
  Description of Artificial Sequence: Synthetic coding sequence
atgctgtgggccgtgaggacccgctgctacgtggtgaaggcccagctgggccccaccgtggccctggagggccgggccccccgggcccctggccccagctgcctgggcaatggaaactgccagaggcctggccccatcaccagcagaaatgtgacccgggccagcctgcctgacatggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgccatgggcggggccatggtgctgctgtatgccagccgggcctgctacaacctgacagccctggccctggccccccagagccggctggacacctttgattatgactggtacaacgtgtctgaccaggccgacctggtgaatgacctgggcaacaagggctacctggtgtttggcctcatcctgtttgtgtgggagctgctgcccaccaccctgctggtgggcttcttccgggtgcaccggcccccccaggacctgagcaccagccacatcctgaatggccaggtgtttgccagccgcagctacttctttgacagagctggccactgtgaagatgagggctgctcctgggagcacagcagaggagagagcacccgctgccaggaccaggccgccaccaccaccgtgtccaccccaccccaccggcgggaccccccacccagccccacagagtacccaggccccagccccccccacccccggcccctgtgccaggtgtgcctgcccctgctggcccaggaccccggcggccggggctaccccctgctgtggccagccccctgctgcagctgccacagcgagctggtgcccagcccctag

SEQ ID NO: 34457 - DNA, 1191 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgccatgggcggggccatggtgctgctgtatgccagccgggcctgctacaacctgacagccctggccctggccccccagagccggctggacacctttgattatgactggtacaacgtgtctgaccaggccgacctggtgaatgacctgggcaacaagggctacctggtgtttggcctcatcctgtttgtgtgggagctgctgcccaccaccctgctggtgggcttcttccgggtgcaccggcccccccaggacctgagcaccagccacatcctgaatggccaggtgtttgccagccgcagctacttctttgacagagctggccactgtgaagatgagggctgctcctgggagcacagcagaggagagagcacctccatgagcggcagcctgggcagcggctcctggtatggagccatcggccgggagcccggctggtatggaggcagccagaccaagaccacccccctgctcttcagccaggtgcccggccctgggggccaccaccacagcctgtacagcaccccccagacctag

SEQ ID NO: 34458 - DNA, 399 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgtag

SEQ ID NO: 34459 - DNA, 504 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagtag

SEQ ID NO: 34460 - DNA, 192 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctgtag

SEQ ID NO: 34461 - DNA, 663 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgcctag

SEQ ID NO: 34462 - DNA, 963 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgccatgggcggggccatggtgctgctgtatgccagccgggcctgctacaacctgacagccctggccctggccccccagagccggctggacacctttgattatgactggtacaacgtgtctgaccaggccgacctggtgaatgacctgggcaacaagggctacctggtgtttggcctcatcctgtttgtgtgggagctgctgcccaccaccctgctggtgggcttcttccgggtgcaccggcccccccaggacctgtatgtgggccagagccggctgtgggagctggtgtggtgccaccgggcctag

SEQ ID NO: 34463 - DNA, 237 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctcctag

SEQ ID NO: 34464 - DNA, 636 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggccggcggccggccccccctggccagcacctggaggcccaggtag

SEQ ID NO: 34465 - DNA, 723 bp, Artificial Sequence
  Description of Artificial Sequence: Synthetic coding sequence
atggagagcaacctgagcggcctggtgcctgctgctggcctggtgcctgccctgcccccagctgtgaccctgggcctgacagctgcctacaccaccctgtatgccctgctcttcttctctgtgtatgcccagctgtggctggtgctgctgtatggccacaagaggctgagctaccagaccgtcttcctggccctgtgcctgctgtgggccgccctgcggaccaccctcttctccttctacttccgggacaccccccgggccaaccggctgggccccctgcccttctggctgctgtactgctgccctgtgtgcctgcagttcttcaccctgaccctgatgaacctgtactttgcccaggtggtgttcaaggccaaggtgaagaggaggcctgagatgagccggggcctgctggccgtgcggggggcctttgtgggcgccagcctgctcttcctgctggtgaatgtgctgtgtgctgtgctgagccacagaagaagagcccagccctgggccctgctgctggtgcgggtgctggtgtctgacagcctgtttgtgatctgtgccctgagcctggccgcctgcctgtgcctggtggcccggcgggcccccagcaccagcatctacctggaggccaagggcacctctgtgtgccaggccgccgccatgggcggggccatggtgctgctgtatgccagccgggcctgctacaacctgacagccctgtag

SEQ ID NO: 34466 - DNA, 702 bp, Artificial Sequence
  Description of Artificial Sequence: Synthetic coding sequence
atgaggcctgagcggccccggccccggggcagcgcccctggccccatggagaccccaccctgggaccctgccagaaatgacagcctgccccccaccctgaccccagctgtgcccccctacgtgaagctgggcctgactgtggtgtacaccgtcttctacgccctgctgtttgtgttcatctacgtgcagctgtggctggtgctgcgctaccgccacaagaggctgagctaccagagcgtcttcctgttcctgtgcctcttctgggccagcctgaggacagtgctcttctccttctacttcaaggactttgtggccgccaacagcctgagcccctttgtgttctggctgctgtactgcttccctgtgtgcctgcagttcttcaccctgaccctgatgaacctgtacttcacccagggcagctctgtgtgccaggtgacagccatcggcgtgaccgtcatcctgctgtacaccagccgggcctgctacaacctcttcatcctgtccttcagccagaacaagtctgtgcacagctttgattatgactggtacaacgtgtctgaccaggtgtctgggggcgctgaggaggtgtccccagaccagggcctgctggtgagcagccgccactggttccaggaccccaggaagtaccagaacctggatgcccaggtgcctgacatcaagtggtgcagcatctgcatctag

SEQ ID NO: 34467 - DNA, 1200 bp, Artificial Sequence
  Description of Artificial Sequence: Synthetic coding sequence
atgaggcctgagcggccccggccccggggcagcgcccctggccccatggagaccccaccctgggaccctgccagaaatgacagcctgccccccaccctgaccccagctgtgcccccctacgtgaagctgggcctgactgtggtgtacaccgtcttctacgccctgctgtttgtgttcatctacgtgcagctgtggctggtgctgcgctaccgccacaagaggctgagctaccagagcgtcttcctgttcctgtgcctcttctgggccagcctgaggacagtgctcttctccttctacttcaaggactttgtggccgccaacagcctgagcccctttgtgttctggctgctgtactgcttccctgtgtgcctgcagttcttcaccctgaccctgatgaacctgtacttcacccaggtgatcttcaaggccaagagcaagtacagccctgagctgctgaagtaccgcctgcccctgtacctggccagcctcttcatcagcctggtgttcctgctggtgaacctgacctgtgctgtgctggtgaagacaggcaactgggagaggaaggtgattgtgtctgtgcgggtggccatcaatgacaccctgtttgtgctgtgtgctgtgtccctgagcatctgcctgtacaagatcagcaagatgagcctggccaacatctacctggagagcaagggcagctctgtgtgccaggtgacagccatcggcgtgaccgtcatcctgctgtacaccagccgggcctgctacaacctcttcatcctgtccttcagccagaacaagtctgtgcacagctttgattatgactggtacaacgtgtctgaccaggccgacctgaagaaccagctgggagatgctggctacgtgctgtttggagtggtgctgtttgtgtgggagctgctgcccaccaccctggtggtgtacttcttccgggtgaggaaccccaccaaggacctgaccaaccctggcatggtgcccagccacggcttcagccccaggagctacttctttgacaacccccggcgctatgacagtgatgatgacctggcctggaacatcgccccccagggcctgcagggcggctttgccccagactactatgactggggccagcagaccaacagcttcctggcccaggccggcaccctgcaggacagcaccctggaccctgacaagcccagcctgggctag

SEQ ID NO: 34468 - DNA, 1197 bp, Artificial Sequence
  Description of Artificial Sequence: Synthetic coding sequence
atgagaggagacccccggccccggggcagcgcccctggccccatggagaccccaccctgggaccctgccagaaatgacagcctgccccccaccctgaccccagctgtgcccccctacgtgaagctgggcctgactgtggtgtacacagtgttctacgccctgctgtttgtgttcatctacgtgcagctgtggctggtgctgcgctaccgccacaagaggctgagctaccagagcgtcttcctgttcctgtgcctcttctgggccagcctgaggacagtgctcttctccttctacttcaaggactttgtggccgccaacagcctgagcccctttgtgttctggctgctgtactgcttccctgtgtgcctgcagttcttcaccctgaccctgatgaacctgtacttcacccaggtgatcttcaaggccaagagcaagtacagccctgagctgctgaagtaccgcctgcccctgtacctggccagcctcttcatcagcctggtgttcctgctggtgaacctgacctgtgctgtgctggtgaagacaggcaactgggagaggaaggtgattgtgtctgtgcgggtggccatcaatgacaccctgtttgtgctgtgtgctgtgtccctgagcatctgcctgtacaagatcagcaagatgagcctggccaacatctacctggagagcaagggcagctctgtgtgccaggtgacagccatcggcgtgaccgtcatcctgctgtacaccagccgggcctgctacaacctcttcatcctgtccttcagccagaacaagtctgtgcacagctttgattatgactggtacaacgtgtctgaccaggccgacctgaagaaccagctgggagatgctggctacgtgctgtttggagtggtgctgtttgtgtgggagctgctgcccaccaccctggtggtgtacttcttccgggtgaggaaccccaccaaggacctgaccaaccctggcatggtgcccagccacggcttcagccccaggagctacttctttgacaaccccaggagatatgacagtgatgatgacctggcctggaacatcgccccccagggcctgcagggcggctttgccccagactactatgactggggccagcagaccaacagcttcctggcccaggccggcaccctgcaggacagcaccctggaccctgacaagcccagcctgggctag

SEQ ID NO: 34469 - DNA, 387 bp, Artificial Sequence
  Description of Artificial Sequence: Synthetic coding sequence
atgagcctggccaacatctacctggagagcaagggcagctctgtgtgccaggtgacagccatcggcgtgaccgtcatcctgctgtacaccagccgggcctgctacaacctcttcatcctgtccttcagccagaacaagtctgtgcacagctttgattatgactggtacaacgtgtctgaccaggccgacctgaagaaccagctgggagatgctggctacgtgctgtttggagtggtgctgtttgtgtgggagctgctgcccaccaccctggtggtgtacttcttccgggtgaggaaccccaccaaggacctgaccaaccctggcatggtgcccagccacggcttcagccccaggagctacttctttgacaacccccggcgctactag

SEQ ID NO: 34470 - DNA, 693 bp, Artificial Sequence
  Description of Artificial Sequence: Synthetic coding sequence
tgacaggtgatcttcaaggccaagagcaagtacagccctgagctgctgaagtaccgcctgcccctgtacctggccagcctcttcatcagcctggtgttcctgctggtgaacctgacctgtgctgtgctggtgaagacaggcaactgggagaggaaggtgattgtgtctgtgcgggtggccatcaatgacaccctgtttgtgctgtgtgctgtgtccctgagcatctgcctgtacaagatcagcaagatgagcctggccaacatctacctggagagcaagggcagctctgtgtgccaggtgacagccatcggcgtgaccgtcatcctgctgtacaccagccgggcctgctacaacctcttcatcctgtccttcagccagaacaagtctgtgcacagctttgattatgactggtacaacgtgtctgaccaggccgacctgaagaaccagctgggagatgctggctacgtgctgtttggagtggtgctgtttgtgtgggagctgctgcccaccaccctggtggtgtacttcttccgggtgaggaaccccaccaaggacctgaccaaccctggcatggtgcccagccacggcttcagccccaggagctacttctttgacaacccccggcgctatgacagtgatgatgacctggcctggaacatcgccccccagggcctgcagggcggcctgctgtag

SEQ ID NO: 34471 - DNA, 1290 bp, Artificial Sequence
  Description of Artificial Sequence: Synthetic coding sequence
atgagggtgtctgtgcccggccctgctgctgctgctgccccagctgctggccgggagcccagcaccccaggcggcggcagcggcggcggcggcgctgtggccgccgccagcggggctgctgtgcccggctctgtgcagctggccctgtctgtgctgcacgccctgctgtatgctgccctgtttgcctttgcctacctgcagctgtggaggctgctgctgtaccgggagcggcggctgagctaccagagcctgtgcctcttcctgtgcctgctgtgggccgccctgcggaccaccctcttctctgctgccttcagcctgagcggcagcctgcccctgctgcggcccccagcccacctgcacttcttcccccactggctgctgtactgcttccccagctgcctgcagttcagcaccctgtgcctgctgaacctgtacctggccgaggtgatctgcaaggtgcgctgtgccacagagctggacagacacaagatcctgctgcacctgggcttcatcatggccagcctgctcttcctggtggtgaacctgacctgtgccatgctggtgcatggagatgtgcctgagaaccagctgaagtggacagtgtttgtgcgggccctgatcaatgacagcctcttcatcctgtgtgccatcagcctggtgtgctacatctgcaagatcaccaagatgagcagcgccaacgtgtacctggagagcaagggcatgagcctgtgccagacagtggtggtgggctctgtggtgatcctgctgtacagcagccgggcctgctacaacctggtggtggtgaccatcagccaggacaccctggagagccccttcaactacggctgggacaacctgagtgacaaggcccacgtggaggacatcagcggggaggagtacatcgtgtttggcatggtgctcttcctgtgggagcacgtgcctgcctggagcgtggtgctcttcttccgggcccagaggctgaaccagaacctggccccagctggcatgatcaacagccacagctacagcagccgggcctacttctttgacaaccccaggagatatgacagtgatgatgacctgccccggctgggcagcagccgggagggcagcctgcccaacagccagagcctgggctggtacggcaccatgacaggctgcggcagcagcagctacacagtgaccccccacctgaatggccccatgacagacacagcccccctgctcttcacctgcagcaacctggacctgaacaaccaccacagcctgtatgtgaccccccagaactag

SEQ ID NO: 34472 - DNA, 1062 bp, Artificial Sequence
  Description of Artificial Sequence: Synthetic coding sequence
atggagcacacccacgcccacctggccgccaacagcagcctgtcctggtggagccctggcagcgcctgtggcctgggctttgtgcctgtggtgtactacagcctgctgctgtgcctgggcctgcctgccaacatcctgaccgtcatcatcctgagccagctggtggcccggcggcagaagagcagctacaactacctgctggccctggccgctgctgacatcctggtgctcttcttcatcgtgtttgtggacttcctgctggaggacttcatcctgaacatgcagatgccccaggtgcctgacaagatcatcgaggtgctggagttcagcagcatccacaccagcatctggatcaccgtgcccctgaccatcgaccgctacatcgctgtgtgccaccccctgaagtaccacacagtgtcctacccagcccggaccaggaaggtgattgtgtctgtgtacatcacctgcttcctgaccagcatcccctactactggtggcccaacatctggacagaggactacatcagcacctctgtgcaccacgtgctgatctggatccactgcttcaccgtgtacctggtgccctgcagcatcttcttcatcctgaacagcatcatcgtgtacaagctgcggaggaagagcaacttccggctgcggggctacagcacaggcaagaccacagccatcctcttcaccatcaccagcatctttgccaccctgtgggccccccgcatcatcatgatcctgtaccacctgtatggagcccccatccagaaccgctggctggtgcacatcatgtctgacatcgccaacatgctggccctgctgaacacagccatcaacttcttcctgtactgcttcatcagcaagcgcttccgcaccatggctgctgccaccctgaaggccttcttcaagtgccagaagcagcctgtgcagttctacaccaaccacaacttcagcatcaccagcagcccctggatcagccctgccaacagccactgcatcaagatgctggtgtaccagtatgacaagaatggcaagcccatcaaggtgagcccctag

SEQ ID NO: 34473 - DNA, 1062 bp, Artificial Sequence; identical to SEQ ID NO: 34472
  Description of Artificial Sequence: Synthetic coding sequence

SEQ ID NO: 34474 - DNA, 918 bp, Artificial Sequence
  Description of Artificial Sequence: Synthetic coding sequence
atgcctggccacaacaccagcaggaacagcagctgtgaccccatcgtgaccccccacctgatcagcctgtacttcatcgtgctgattggaggcctggtgggcgtcatcagcatcctcttcctgctggtgaagatgaacaccaggtctgtgaccaccatggccgtcatcaacctggtggtggtgcacagcgtcttcctgctgactgtgcccttccggctgacctacctgatcaagaagacctggatgtttggcctgcccttctgcaagtttgtgtctgccatgctgcacatccacatgtacctgaccttcctgttctacgtggtgatcctggtgacccgctacctgatcttcttcaagtgcaaggacaaggtggagttctacaggaagctgcatgctgtggccgccagcgctggcatgtggaccctggtgattgtcatcgtggtgcccctggtggtgagccgctatggcatccacgaggagtacaatgaggagcactgcttcaagttccacaaggagctggcctacacctacgtgaagatcatcaactacatgatcgtcatctttgtgattgctgtggccgtcatcctgctggtgttccaggtgttcatcatcatgctgatggtgcagaagctgcggcacagcctgctgagccaccaggagttctgggcccagctgaagaacctcttcttcatcggggtcatcctggtgtgcttcctgccctaccagttcttccgcatctactacctgaatgtggtgacccacagcaatgcctgcaacagcaaggtggccttctacaatgagatcttcctgtctgtgacagccatcagctgctatgacctgctgctgtttgtgtttggaggcagccactggttcaagcagaagatcatcggcctgtggaactgtgtgctgtgcaggtag

SEQ ID NO: 34475 - DNA, 918 bp, Artificial Sequence; identical to SEQ ID NO: 34474
  Description of Artificial Sequence: Synthetic coding sequence

SEQ ID NO: 34476 - DNA, 315 bp, Artificial Sequence
  Description of Artificial Sequence: Synthetic coding sequence
atgcctggccacaacaccagcaggaacagcagctgtgaccccatcgtgaccccccacctgatcagcctgtacttcatcgtgctgattggaggcctggtgggcgtcatcagcatcctcttcctgctggtgaagatgaacaccaggtctgtgaccaccatggccgtcatcaacctggtggtggtgcacagcgtcttcctgctgactgtgcccttccggctgacctacctgatcaagaagacctggatgtttggcctgcccttctgcaagtttgtgtctgccatgctgcacatccacatgtacctgaccttcctgtag

SEQ ID NO: 34477 - DNA, 1389 bp, Artificial Sequence
  Description of Artificial Sequence: Synthetic coding sequence
atgagcatcatgatgctgcccatggagcagaagatccagtgggtgcccaccagcctgcaggacatcacagctgtgctgggcacagaggcctacacagaggaggacaagtccatggtgtcccatgcccagaagagccagcacagctgcctgagccacagccgctggctgcggagcccccaggtgactggaggctcctgggacctgcgcatccggcccagcaaggacagcagcagcttccggcaggcccagtgcctgaggaaggaccccggggccaacaaccacctggagagccagggcgtgcggggcacagctggagatgctgaccgggagctgcggggccccagcgagaaggccacagctggccagccccgggtgaccctgctgcccaccccccacgtgtctggcctgagccaggagtttgagagccactggccagaaattgctgagaggagcccctgtgtggccggggtcatccctgtgatctactacagcgtgctgctgggcctgggcctgcctgtgtccctgctgacagctgtggccctggcccggctggccaccaggacccggcggcccagctactactacctgctggccctgacagccagtgacatcatcatccaggtggtgattgtgtttgctggcttcctgctgcagggcgctgtgctggcccggcaggtgccccaggccgtggtgaggacagccaacatcctggagtttgctgccaaccacgcctctgtgtggatcgccatcctgctgactgtggaccgctacacagccctgtgccaccccctgcaccaccgggccgccagcagccctggccgcacccggcgggccatcgctgctgtgctgtctgctgccctgctgaccggcatccccttctactggtggctggacatgtggagggacacagacagccccaggaccctggatgaggtgctgaagtgggcccactgcctgactgtgtacttcatcccctgtggggtcttcctggtgaccaacagcgccatcatccaccggctgcggcggcggggccgcagcggcctgcagccccgggtgggcaagagcacagccatcctgctgggcatcaccaccctcttcaccctgctgtgggccccccgggtgtttgtgatgctgtaccacatgtatgtggcccctgtgcaccgggactggagggtgcacctggccctggatgtggccaacatggtggccatgctgcacacagctgccaactttggcctgtactgctttgtgtccaagaccttccgggccaccgtgcggcaggtgattcatgatgcctacctgccctgcaccctggccagccagcctgagggcatggccgccaagcctgtgatggagcccccaggcctgcccaccggggctgaggtgtag

SEQ ID NO: 34478 - DNA, 2892 bp, Artificial Sequence
  Description of Artificial Sequence: Synthetic coding sequence
atggatgccccctggggcgctggggagcgctggctgcatggagctgctgtggacagaagtggagtgtccctgggccccccacccaccccccaggtgaaccagggcaccctgggcccccaggtggcccctgtggccgccggggaggtggtgaagacagctggaggagtgtgcaagttcagcggccagaggctgtcctggtggcaggcccaggagagctgtgagcagcagtttggccacctggccctgcagcccccagatggagtgctggccagccggctgcgggaccctgtgtgggtgggccagcgggaggcccccctgcggcggcccccccagaggcgggcccggaccacagctgtgctggtgtttgatgagaggacagctgaccgggccgcccggctgcggagccccctgcctgagctggccgccctgacagcctgcacccacgtgcagtgggactgtgccagcccagaccctgctgccctcttctctgtggccgccccagccctgcccaatgccctgcagctgcgggcctttgctgagcctggaggagtggtgcgggccgccctggtggtgcggggccagcacgcccccttcctggccgccttccgggcagatggccgctggcaccacgtgtgtgccacctgggagcagagaggaggccgctgggccctcttcagtgatggaagaagaagagctggggcccggggcctgggcgccggccaccctgtgcccagcggcggcatcctggtgctgggccaggaccaggacagcctgggcggcggcttctctgtgagacatgccctgagcggcaacctgacagacttccacctgtgggcccgggccctgagccctgcccagctgcaccgggcccgggcctgtgcccctccttctgagggcctgctcttccgctgggaccccggggccctggatgtgacccccagcctgctgcccaccgtgtgggtgcggctgctgtgccctgtgcccagtgaagaatgtcccacctggaaccctggccccaggtctgagggcagcgagctgtgcctggagccccagcccttcctgtgctgctacagaacagagccctacagaaggctgcaggatgcccagagctggccaggccaggatgtgatcagccgggtgaatgccctggccaatgacatcgtgctgctgcctgaccccctgtctgaggtgcacggggccctgagccctgctgaggccagcagcttcctgggcctgctggagcacgtgctggccatggagatggcccccctgggccctgctgccctgctggccgtggtgcgcttcctgaagagggtggtggccctgggcgctggggaccctgagctgctgctgaccggcccctgggagcagctgagccagggcgtggtgtctgtggccagcctggtgctggaggagcaggtggccgacacctggctgagcctgcgggaggtgattggaggccccatggccctggtggcctctgtgcagaggctggcccccctgctgagcacctccatgaccagcgagcggcccaggatgaggatccagcacagacatgctggcctgtctggagtgaccgtcatccacagctggttcaccagcagggtcttccagcacaccctggagggccctgacctggagccccaggccccagccagcagcgaggaggccaacagagtgcagcgcttcctgagcacccaggtgggcagcgccatcatcagcagcgaggtgtgggatgtgactggagaggtgaatgtggccatgaccttccacctgcagcaccgggcccagagccccctcttccccccccacccccccagcccctacacaggaggagcctgggccaccaccggctgcagcgtggccgccctgtacctggacagcacagcctgcttctgcaaccacagcaccagctttgccatcctgctgcagatctatgaggtgcagaggggccctgaggaggagagcctgctgcggaccctgagctttgtgggctgcggcgtgtccttctgtgccctgaccaccaccttcctgctcttcctggtggccggcgtgcccaagtctgagaggaccaccgtgcacaagaacctgaccttcagcctggccagcgctgagggcttcctgatgaccagcgagtgggccaaggccaatgaggtggcctgtgtggccgtgacagtggccatgcacttcctgttcctggtggccttctcctggatgctggtggagggcctgctgctgtggaggaaggtggtggccgtgtccatgcaccctggccctggcatgaggctgtaccacgccaccggctggggcgtgcctgtgggcatcgtggccgtgaccctggccatgctgccccatgactatgtggcccctggccactgctggctgaatgtgcacaccaatgccatctgggcctttgtgggccctgtgctgtttgtgctgacagccaacacctgcatcctggcccgggtggtgatgatcaccgtgagcagcgccaggagaagagccaggatgctgagcccccagccctgcctgcagcagcagatctggacccagatctgggccaccgtgaagcctgtgctggtgctgctgcctgtgctgggcctgacctggctggccggcatcctggtgcacctgagccctgcctgggcctatgctgctgtgggcctgaacagcatccagggcctgtacatcttcctggtgtatgctgcctgcaatgaggaggtgcgcagcgccctgcagaggatggccgagaagaaggtggccgaggtgctgcgggccctgggcgtgtggggcggggccgccaaggagcacagcctgcccttctctgtgctgcccctcttcctgccccccaagcccagcacccccaggcaccccctgaaggccccagcctag

SEQ ID NO: 34479 - DNA, 1104 bp, Artificial Sequence
  Description of Artificial Sequence: Synthetic coding sequence
ctgacagacttccacctgtgggcccgggccctgagccctgcccagctgcaccgggcccgggcctgtgccccacccagcgagggcctgctcttccgctgggaccccggggccctggatgtgacccccagcctgctgcccaccgtgtgggtgcggctgctgtgcccagagccctacagaaggctgcaggatgcccagagctggccaggccaggatgtgatcagccgggtgaatgccctggccaatgacatcgtgctgctgcctgaccccctgtctgaggtgcacggggccctgagccctgctgaggccagcagcttcctgggcctgctggagcacgtgctggccatggagatggcccccctgggccctgctgccctgctggccgtggtgcgcttcctgaagagggtggtggccctgggcgctggggaccctgagctgctgctgaccggcccctgggagcagctgagccagggcgtggtgtctgtggccagcctggtgctggaggagcaggtgattggaggccccatggccctggtggcctctgtgcagaggctggcccccctgctgagcacctccatgaccagcgagcggcccaggatgaggatccagcacagacatgctggcctggaggtgcgcagcctgcggctgcgggaggccagcacccggggctgcctcttcaccatgcctgggggccggcctgagggccctggccacatccacatcccagccagcgaggtgcggcggctgctgaggaagggcctgagcggcgtgaccgtcatccacagctggttcaccagcagggtcttccagcacaccctggagggccctgacctggagccccaggccccagccagcagcgaggaggccaacagagtgcagcgcttcctgagcacccaggtgggcagcgccatcatcagcagcgaggtgtgggatgtgactggagaggtgaatgtggccatgaccttccacctgcagcaccgggcccagcccatctaccggggctgcctgggccaccaccggctgctgcggggctgccctgtgcccggcctgcaccggctgctgctgcagccccagcaccagctgtgccaccctgctgccaacctgtag

SEQ ID NO: 34480 - DNA, 393 bp, Artificial Sequence
  Description of Artificial Sequence: Synthetic coding sequence
tctgggggcatcctgctggatgctgggggcggcgctgctgctgtggaggagggcggcagctgtgaacatgcccctggccccaggcatgctgccctgcccaggcaccggctgggcgccaccgtgaagcctgtgctggtgctgctgcctgtgctgggcctgacctggctggccggcatcctggtgcacctgagccctgcctgggcctatgctgctgtgggcctgaacagcatccagggcctgtacatcttcctggtgtatgctgcctgcaatgaggaggtgcgcagcgccctgcagaggatggccgagaagaaggtggccgagggccccatggccctggagctgccccagcacagcccccccctgcagacccggcgggaccggctgtggaactag

SEQ ID NO: 34481 - DNA, 105 bp, Artificial Sequence
  Description of Artificial Sequence: Synthetic coding sequence
atgcaccccccacccagcctgctgtccttcctggcccctgtggccgccggggaggtggtgaagacagctggaggagtgtgcaagttcagcggccagaggctgtag

SEQ ID NO: 34482 - DNA, 1002 bp, Artificial Sequence
  Description of Artificial Sequence: Synthetic coding sequence
atgtggagctgctcctggttcaacggcaccggcctggtggaggagctgcctgcctgccaggacctgcagctgggcctgagcctgctgagcctgctgggcctggtggtgggcgtgcctgtgggcctgtgctacaatgccctgctggtgctggccaacctgcacagcaaggcctccatgaccatgccagatgtgtactttgtgaacatggctgtggccggcctggtgctgagcgccctggcccctgtgcacctgctgggcccccccagcagccgctgggccctgtggagcgtgggcggggaggtgcacgtggccctgcagatccccttcaacgtgagcagcctggtggccatgtacagcacagccctgctgagcctggaccactacatcgagcgggccctgcccaggacctacatggcctctgtgtacaacaccaggcatgtgtgtggctttgtgtggggcggggccctgctgaccagcttcagcagcctgctcttctacatctgcagccacgtgtccacccgggccctggagtgtgccaagatgcagaatgctgaggccgcagatgccaccctggtgttcatcggctacgtggtgcctgccctggccaccctgtatgccctggtgctgctgagccgggtgcggcgggaggacacccccctggaccgggacaccggccgcctggagcccagcgcccaccggctgctggtggccaccgtgtgcacccagtttggcctgtggaccccccactacctgatcctgctgggccacacagtcatcatcagccggggcaagcctgtggatgcccactacctgggcctgctgcactttgtgaaggacttcagcaagctgctggccttcagcagcagctttgtgacccccctgctgtaccgctacatgaaccagagcttccccagcaagctgcagaggctgatgaagaagctgccctgtggggacagacactgcagcccagaccacatgggcgtgcagcaggtgctggcctag

SEQ ID NO: 34483 - DNA, 1002 bp, Artificial Sequence; identical to SEQ ID NO: 34482
  Description of Artificial Sequence: Synthetic coding sequence

SEQ ID NO: 34484 - DNA, 948 bp, Artificial Sequence
  Description of Artificial Sequence: Synthetic coding sequence
atgtggagctgctcctggttcaacggcaccggcctggtggaggagctgcctgcctgccaggacctgcagctgggcctgagcctgctgagcctgctgggcctggtggtgggcgtgcctgtgggcctgtgctacaatgccctgctggtgctggccaacctgcacagcaaggcctccatgaccatgccagatgtgtactttgtgaacatggctgtggccggcctggtgctgagcgccctggcccctgtgcacctgctgggcccccccagcagccgctgggccctgtggagcgtgggcggggaggtgcacgtggccctgcagatccccttcaacgtgagcagcctggtggccatgtacagcacagccctgctgagcctggaccactacatcgagcgggccctgcccaggacctacatggcctctgtgtacaacaccaggcatgtgtgtggctttgtgtggggcggggccctgctgaccagcttcagcagcctgctcttctacatctgcagccacgtgtccacccgggccctggagtgtgccaagatgcagaatgctgaggccgcagatgccaccctggtgttcatcggctacgtggtgcctgccctggccaccctgtatgccctggtgctgctgagccgggtgcggcgggaggacacccccctggaccgggacaccggccgcctggagcccagcgcccaccggctgctggtggccaccgtgtgcacccagtttggcctgtggaccccccactacctgatcctgctgggccacacagtcatcatcagccggggcaagcctgtggatgcccactacctgggcctgctgcactttgtgaaggacttcagcaagctgctggccttcagcagcagctttgtgacccccctgctgtaccgctacatgaaccagagcttccccagcaagctgcagaggctgatgaagaagctgccctag

SEQ ID NO: 34485 - DNA, 756 bp, Artificial Sequence
  Description of Artificial Sequence: Synthetic coding sequence
atgctgctgggcccccccagcagccgctgggccctgtggagcgtgggcggggaggtgcacgtggccctgcagatccccttcaacgtgagcagcctggtggccatgtacagcacagccctgctgagcctggaccactacatcgagcgggccctgcccaggacctacatggcctctgtgtacaacaccaggcatgtgtgtggctttgtgtggggcggggccctgctgaccagcttcagcagcctgctcttctacatctgcagccacgtgtccacccgggccctggagtgtgccaagatgcagaatgctgaggccgcagatgccaccctggtgttcatcggctacgtggtgcctgccctggccaccctgtatgccctggtgctgctgagccgggtgcggcgggaggacacccccctggaccgggacaccggccgcctggagcccagcgcccaccggctgctggtggccaccgtgtgcacccagtttggcctgtggaccccccactacctgatcctgctgggccacacagtcatcatcagccggggcaagcctgtggatgcccactacctgggcctgctgcactttgtgaaggacttcagcaagctgctggccttcagcagcagctttgtgacccccctgctgtaccgctacatgaaccagagcttccccagcaagctgcagaggctgatgaagaagctgccctgtggggacagacactgcagcccagaccacatgggcgtgcagcaggtgctggcctag

SEQ ID NO: 34486 - DNA, 1044 bp, Artificial Sequence
  Description of Artificial Sequence: Synthetic coding sequence
atgggagatgagctggccccctgccctgtgggcaccacagcctggccagccctgatccagctgatcagcaagaccccctgcatgccccaggccgccagcaacaccagcctgggcctgggggacctgcgggtgcccagctccatgctgtactggctgttcctgcccagcagcctgctggccgccgccaccctggccgtgagccccctgctgctggtgaccatcctgaggaaccagaggctgcggcaggagccccactacctgctgcctgccaacatcctgctgagtgacctggcctacatcctgctgcacatgctgatcagcagcagcagcctgggcggctgggagctgggccgcatggcctgtggcatcctgacagatgctgtgtttgctgcctgcaccagcaccatcctgtccttcaccgccatcgtgctgcacacctacctggccgtcatccaccccctgcgctacctgtccttcatgagccacggggccgcctggaaggctgtggccctgatctggctggtggcctgctgcttccccaccttcctgatctggctgagcaagtggcaggatgcccagctggaggagcagggcgccagctacatcctgccccccagcatgggcacccagcccggctgcggcctgctggtgattgtgacctacaccagcatcctgtgtgtgctcttcctgtgcacagccctgattgccaactgcttctggaggatctatgcagaggccaagaccagcggcatctggggccagggctacagccgggcccggggcaccctgctgatccacagcgtgctgatcaccctgtatgtgtccactggagtggtgttcagcctggacatggtgctgacccgctaccaccacatcgacagcggcacccacacctggctgctggccgccaacagcgaggtgctgatgatgctgccccgggccatgctgacctacctgtacctgctgcgctaccggcagctgctgggcatggtgcggggccacctgcccagccgccgccaccaggccatcttcaccatctcctag

SEQ ID NO: 34487 - DNA, 2196 bp, Artificial Sequence
  Description of Artificial Sequence: Synthetic coding sequence
atgagcctcttcctgagcaacctgagcaccaatgacagcagcctgtggaaggagaaccacaacagcacagacctgctgaaccccccaggcaccctgaacatctacctgttctgcctgacctgcctgatgacctttgctgccctggtgggcagcatctacagcctcatcagcctgctgaagatgcagaacagaacagtggtgtccatgctggtggcctcctggagcgtggatgacctgatgtctgtgctgtctgtgaccatcttcatgttcctgcagtggcccaatgaggtgcccggctacttccagttcctgtgcaccaccagcgccctgatgtacctgtgccagggcctgagcagcaacctgaaggccaccctgctggtgtcctacaacttctacaccatgcacagaggagtgggcagccagacagccagcagaagaagtggccaggtgctgggcgtggtgctgactgtgtgggccgccagcctgctgctgagcgccctgcccctgtgtggctggggcgcctttgtgaggaccccctggggctgcctggtggactgcagcagcagctatgtgctcttcctgagcatcgtgtatgccctggccttcggcctgctggtgggcctgtctgtgcccctgacccaccggctgctgtgcagcgaggagcccccccggctgcacagcaactaccaggagatcagcagaggagccagcatccctggcaccccacccacagctggccgggtggtgtccctgagcccagaagatgcccctggccccagcctgcggcgcagcggcggctgcagccccagcagtgacacagtgtttggacctggggccccagctgctgctggagctgaggcctgcagaagagaaaatagaggcaccctgtatggcaccaggagcttcaccgtgtctgtggcccagaagagatttgccctgatcctggccctgaccaaggtggtgctgtggctgcccatgatgatgcacatggtggtgcagaatgtggtgggcttccagagcctgcccctggagaccttctccttcctgctgaccctgctggccaccaccgtgacccctgtgtttgtgctgagcaagcgctggacccacctgccctgtggctgcatcatcaactgccggcagaatgcctatgctgtggccagtgatggcaagaagatcaagaggaaaggatttgagttcaacctgtccttccagaagagctatggcatctacaagatcgcccacgaggactactatgatgatgatgagaacagcatcttctaccacaacctgatgaacagtgaatgtgagaccaccaaggacccccagagggacaacagaaacatcttcaatgccatcaaggtggagatcagcaccacccccagcctggacagcagcacccagaggggcatcaacaagtgcaccaacacagacatcacagaggccaagcaggacagcaacaacaagaaggatgccttcagtgacaagacaggaggagacatcaactatgaggagaccaccttcagcgagggccctgagcggcggctgagccatgaggagagccagaagccagacctgagtgactgggagtggtgccgcagcaagtctgagaggaccccccggcagaggagcggctacgccctggccatccccctgtgtgccttccagggcaccgtgtccctgcacgcccccaccgggaagaccctgagcctgagcacctatgaggtgtctgctgagggccagaagatcaccccagccagcaagaagattgaggtgtaccgcagcaagtctgtgggccacgagcccaacagcgaggacagcagcagcacctttgtggacacctctgtgaagatccacctggaggtgctggagatctgtgacaatgaggaggccctggacacagtgtccatcatcagcaacatcagccagagcagcacccaggtgcgcagccccagcctgcgctacagcaggaaggagaacagatttgtgtcctgtgacctgggggagacagccagctacagcctcttcctgcccaccagcaacccagatggagacatcaacatcagcatcccagacacagtggaggcccaccggcagaacagcaagaggcagcaccaggagagagatggctaccaggaggagatccagctgctgaacaaggcctacaggaagcgggaggaggagagcaagggcagctag

SEQ ID NO: 34488 - DNA, 1305 bp, Artificial Sequence
  Description of Artificial Sequence: Synthetic coding sequence
atggaggacctcttcagccccagcatcctgcccccagcccccaacatctctgtgcccatcctgctgggctggggcctgaacctgaccctgggccagggcgccccagccagcggcccccccagccggcgggtgcggctggtgttcctgggcgtcatcctggtggtggccgtggccggcaacaccaccgtgctgtgccgcctgtgtggcggcggcggcccctgggccggccccaagaggaggaagatggacttcctgctggtgcagctggccctggccgacctgtatgcctgtggcggcacagccctgagccagctggcctgggagctgctgggggagcccagggctgccactggagacctggcctgccgcttcctgcagctgctgcaggccagcggccgcggggccagcgcccacctggtggtgctgattgccctggagcggcggcgggctgtgcggctgccccacggccggcccctgcctgcccgggccctggccgccctgggctggctgctggccctgctgctggccctgcccccagcctttgtggtgcggggggacagccccagccccctgcccccacctcctccacccaccagcctgcagcccggggcccctcctgctgcccgggcctggccaggagagcggcgctgccacggcatctttgcccccctgccccgctggcacctgcaggtgtatgccttctatgaagctgtggccggctttgtggcccctgtgacagtgctgggcgtggcctgtggccacctgctgtctgtgtggtggaggcaccggccccaggccccagctgctgctgccccctggagcgccagccctggccgggccccagcccccagcgccctgccccgggccaaggtgcagagcctgaagatgagcctgctgctggccctgctgtttgtgggctgtgagctgccctactttgctgcccggctggccgccgcctggagcagcggccctgctggggactgggagggggagggcctgtctgctgccctgcgggtggtggccatggccaacagcgccctgaacccctttgtgtacctgttcttccaggccggggactgccgcctgcggcggcagctgaggaagaggctgggcagcctgtgctgtgccccccagggcggcgcagaagatgaggagggcccccggggccaccaggccctgtaccggcagcgctggccccacccccactaccaccacgcccggcgggagcccctggatgagggcggcctgcggcccccaccaccccggccccggcccctgccctgcagctgtgagagcgccttctag

SEQ ID NO: 34489 - DNA, 1260 bp, Artificial Sequence
  Description of Artificial Sequence: Synthetic coding sequence
atgctggccgccgcctttgctgacagcaacagcagctccatgaatgtgtcctttgcccacctgcactttgctgggggctacctgcccagcgacagccaggactggaggaccatcatcccagccctgctggtggccgtgtgcctggtgggctttgtgggcaacctgtgtgtgattggcatcctgctgcacaatgcctggaagggcaagcccagcatgatccacagcctcatcctgaacctgagcctggccgacctgagcctgctgctcttcagcgcccccatccgggccacagcctacagcaagtctgtgtgggacctgggctggtttgtgtgcaagagcagtgactggttcatccacacctgcatggccgccaagagcctgaccatcgtggtggtggccaaggtgtgcttcatgtatgccagtgaccctgccaagcaggtgtccatccacaactacaccatctggagcgtgctggtggccatctggacagtggccagcctgctgcccctgcctgagtggttcttcagcaccatccgccaccatgaaggagtggagatgtgcctggtggatgtgcctgctgtggccgaggagttcatgtccatgtttgggaagctgtaccccctgctggccttcggcctgcccctcttctttgccagcttctacttctggagggcctatgaccagtgcaagaagaggggcaccaagacccagaacctgaggaaccagatccgcagcaagcaggtgacagtgatgctgctgagcatcgccatcatcagcgccctgctgtggctgcctgagtgggtggcctggctgtgggtgtggcacctgaaggctgctggccctgccccaccccagggcttcatcgccctgagccaggtgctgatgttcagcatcagcagcgccaaccccctcatcttcctggtgatgtctgaggagttccgggagggcctgaagggcgtgtggaagtggatgatcaccaagaagcccccaacagtgtctgagagccaggagaccccagctggcaacagcgagggcctgcctgacaaggtgcccagccctgagagccctgccagcatccctgagaaggagaagcccagcagccccagcagcggcaagggcaagacagagaaggccgagatccccatcctgcctgatgtggagcagttctggcatgagcgggacacagtgcccagcgtgcaggacaatgaccccatcccctgggagcacgaggaccaggagaccggggagggcgtgaagtag

SEQ ID NO: 34490 - DNA, 1413 bp, Artificial Sequence
  Description of Artificial Sequence: Synthetic coding sequence
atggacaccaccatggaggccgacctgggcgccaccggccaccggcccaggacagagctggatgatgaagattcctacccccagggcggctgggacacagtgttcctggtggccctgctgctgctgggcctgcctgccaacggcctgatggcctggctggccggcagccaggcccggcacggggccggcacccggctggccctgctgctgctgagcctggccctgagtgacttcctgttcctggccgccgccgccttccagatcctggagatcagacatggaggccactggcccctgggcacagctgcctgccgcttctactacttcctgtggggcgtgtcctacagcagcggcctcttcctgctggccgccctgagcctggaccgctgcctgctggccctgtgcccccactggtacccaggccacaggcctgtgcggctgcccctgtgggtgtgtgccggcgtgtgggtgctggccaccctcttctctgtgccctggctggtgtttcctgaggccgctgtgtggtggtatgacctggtgatctgcctggacttctgggacagcgaggagctgagcctgaggatgctggaggtgctgggcggcttcctgcccttcctgctgctgctggtgtgccacgtgctgacccaggccacagcctgcaggacctgccaccggcagcagcagcctgctgcctgccggggctttgcccgggtggcccggaccatcctgagcgcctacgtggtgctgcggctgccctaccagctggcccagctgctgtacctggccttcctgtgggatgtgtacagcggctacctgctgtgggaggccctggtgtacagcgactacctgatcctgctgaacagctgcctgagccccttcctgtgcctgatggccagcgctgacctgcggaccctgctgcggtctgtgctgagcagctttgctgctgccctgtgtgaggagcggcccggcagcttcacccccacagagccccagacccagctggacagcgagggccccaccctgcctgagcccatggccgaggcccagagccagatggaccctgtggcccagccccaggtgaaccccaccctgcagcccaggagtgaccccacagcccagccccagctgaaccccacagcccagccccagagcgaccccacagcccagccccagctgaacctgatggcccagccccagagcgacagcgtggcccagccccaggccgacaccaacgtgcagaccccagccccagctgccagctctgtgcccagcccctgtgatgaggccagccccacccccagcagccaccccacccctggggccctggaggaccctgccaccccaccagccagcgagggggagagccccagcagcaccccacctgaggccgcccctggagctggccccacctag

SEQ ID NO: 34491 - DNA, 2613 bp, Artificial Sequence
  Description of Artificial Sequence: Synthetic coding sequence
atgaacagcaacctgcctgctgagaacctgaccatcgctgtgaacatgaccaagaccctgcccacagctgtgacccacggcttcaacagcaccaatgacccccccagcatgagcatcaccaggctcttccctgccctgctggagtgcttcggcatcgtgctgtgtggctacatcgccggccgggccaacgtcatcaccagcacccaggccaagggcctgggcaactttgtgtccagatttgccctgcctgccctgctcttcaagaacatggtggtgctgaacttcagcaatgtggactggagcttcctgtacagcatcctgattgccaaggccagcgtcttcttcatcgtgtgtgtgctgaccctgctggtggccagcccagacagccgcttcagcaaggccggcctcttccccatctttgccacccagagcaatgactttgccctgggctaccccatcgtggaggccctgtaccagaccacctacccagagtacctgcagtacatctacctggtggcccccatcagcctgatgatgctgaaccccatcggcttcatcttctgtgagatccagaagtggaaggacacccagaatgccagccagaacaagatcaagatcgtgggcctgggcctgctgcgggtgctgcagaaccccatcgtgttcatggtgttcatcggcatcgccttcaacttcatcctggacaggaaggtgcctgtgtatgtggagaacttcctggatggcctgggcaacagcttcagcggcagcgccctcttctacctgggcctgaccatggtgggcaagatcaagaggctgaagaagagcgcctttgtggtgctgatcctgctgatcacagccaagctgctggtgctgcccctgctgtgccgggagatggtggagctgctggacaagggggacagcgtggtgaaccacaccagcctgagcaactatgccttcctgtatggagtcttccctgtggcccctggggtggccatctttgccacccagttcaacatggaggtggagatcatcaccagcggcatggtgatcagcacctttgtgtctgcccccatcatgtatgtgtctgcctggctgctgaccttccccaccatggaccccaagcccctggcctatgccatccagaatgtgtcctttgacatcagcatcgtgtccctcatcagcctcatctggagcctggccatcctgctgctgagcaagaagtacaagcagctgccccacatgctgaccaccaacctgctgattgcccagagcatcgtgtgtgccggcatgatgatctggaactttgtgaaggagaagaactttgtgggccagatcctggtgtttgtgctgctgtacagcagcctgtacagcacctacctgtggacaggcctgctggccatcagcctcttcctgctgaagaagcgggagcgggtgcagatccctgtgggcatcatcatcatcagcggctggggcatcccagccctgctggtgggcgtgctgctgatcaccgggaagcacaacggggacagcattgacagcgccttcttctacggcaaggagcagatgatcaccacagctgtgaccctcttctgcagcatcctgattgctggcatcagcctgatgtgcatgaaccagacagcccaggccggcagctatgagggctttgaccagagccagagccacaaggtggtggagcccggcaacacagcctttgaggagagccctgcccctgtgaatgaacctgagctgttcaccagcagcatccctgagaccagctgctgcagctgcagcatgggaaatggagagctgcactgccccagcattgagcccatcgccaacaccagcaccagcgagcccgtcatccccagctttgagaagaacaaccactgtgtgagccgctgcaacagccagagctgcatcctggcccaggaggaggagcagtacctgcagagcggggaccagcagctgaccaggcatgtgctgctgtgcctgctgctgatcatcggcctgtttgccaacctgagcagctgcctgtggtggctgttcaaccaggagcccggccgcctgtatgtggagctgcagttcttctgtgctgtgttcaactttggccagggcttcatcagctttggcatcttcggcctggacaagcacctgatcatcctgcccttcaagaggcggctggagttcctgtggaacaacaaggacacagcagaaaatagagacagccctgtgtctgaggagatcaagatgacctgccagcagttcatccactaccaccgggacctgtgcatccggaacatcgtgaaggagcggcgctgtggggccaagaccagcgctggcaccttctgtggctgtgacctggtgtcctggctgattgaggtgggcctggccagtgacagaggagaggccgtcatctatggagaccggctggtgcagggcggcgtcatccagcacatcaccaatgaatatgagttcagagatgagtacctgttctaccgcttcctgcagaagagccctgagcagagccccccagccatcaatgccaacaccctgcagcaggagcgctacaaggagattgagcacagcagcccccccagccacagccccaagacctag

SEQ ID NO: 34492 - DNA, 2613 bp, Artificial Sequence; identical to SEQ ID NO: 34491
  Description of Artificial Sequence: Synthetic coding sequence

SEQ ID NO: 34493 - DNA, 2613 bp, Artificial Sequence; identical to SEQ ID NO: 34491
  Description of Artificial Sequence: Synthetic coding sequence

SEQ ID NO: 34494 - DNA, 795 bp, Artificial Sequence
  Description of Artificial Sequence: Synthetic coding sequence
atgatcaccacagctgtgaccctcttctgcagcatcctgattgctggcatcagcctgatgtgcatgaaccagacagcccaggccggcagctatgagggctttgaccagagccagagccacaaggtggtggagcccggcaacacagcctttgaggagagccctgcccctgtgaatgaacctgagctgttcaccagcagcatccctgagaccagctgctgcagctgcagcatgggaaatggagagctgcactgccccagcattgagcccatcgccaacaccagcaccagcgagcccgtcatccccagctttgagaagaacaaccactgtgtgagccgctgcaacagccagagctgcatcctggcccaggaggaggagcagtacctgcagagcggggaccagcagctgaccaggcatgtgctgctgtgcctgctgctgatcatcggcctgtttgccaacctgagcagctgcctgtggtggctgttcaaccaggagcccggccgcctgtatgtggagctgcagttcttctgtgctgtgttcaactttggccagggcttcatcagctttggcatcttcggcctggacaagcacctgatcatcctgcccttcaagaggcggctggagttcctgtggaacaacaaggacacagcagaaaatagagacagccctgtgtctgaggagatcaagatgacctgccagcagttcatccactaccaccgggacctgtgcatccggaacatcgtgaaggagcggcgctgtggggccaagaccagcgctggcaccttctgtggctgctag

SEQ ID NO: 34495 - DNA, 417 bp, Artificial Sequence
  Description of Artificial Sequence: Synthetic coding sequence
ttccgggcccggggcccagatggccggggcagcggccgcacccgggccggccgggcccctggccgggagccccgggccccccgctgcccagatggcggcggcgtggccgcccgggccgcccggctgctgagcagccgccgcagcggctcctggccacccacccacgccctgtggccagacctgcggagccgggcccggcggctgctgctcttcctgagcctggccgacctgctgagcgcccgctgcccccccagccccaccccagcccccagcagcggcccctggcccctgcggagcacctgcaccagcgccagcagcgccccccgggccggcctggcccagatcgcctgcttcggccccagcatgagcagcgctgggggcagccgctggagcagcctgtggcagcccagcccctag

SEQ ID NO: 34496 - DNA, 1008 bp, Artificial Sequence
  Description of Artificial Sequence: Synthetic coding sequence
atgcagcccagccccccacccacagagctggtgcccagcgagagagctgtggtgctgctgagctgtgccctgagcgccctgggcagcggcctgctggtggccacccacgccctgtggccagacctgcggagccgggcccggcggctgctgctcttcctgagcctggccgacctgctgtctgctgccagctacttctacggcgtgctgcagaactttgctggccccagctgggactgtgtgctgcagggcgccctgagcacctttgccaacaccagcagcttcttctggacagtggccatcgccctgtacctgtacctgagcatcgtgcgggccgcccggggccccaggacagaccggctgctgtgggccttccacgtggtgtcctggggcgtgcccctggtgatcaccgtggccgctgtggccctgaagaagattggctatgatgccagtgatgtgtctgtgggctggtgctggattgacctggaggccaaggaccacgtgctgtggatgctgctgaccgggaagctgtgggagatgctggcctacgtgctgctgcccctgctgtacctgctggtgaggaagcacatcaacagagcccacacagccctgtctgagtaccggcccatcctgagccaggagcaccggctgctgcggcacagctccatggctgacaagaagctggtgctgatccccctcatcttcatcggcctgcgggtgtggagcacagtgcgctttgtgctgaccctgtgtggcagccctgctgtgcagacccctgtgctggtggtgctgcacggcatcggcaacaccttccagggcggggccaactgcatcatgtttgtgctgtgcaccagggctgtgaggaccaggctcttcagcctgtgctgctgctgctgcagcagccagccccccaccaagagccctgctggcacccccaaggccccagcccccagcaagccaggagagagccaggagagccagggcaccccaggagagctgcccagcacctag

SEQ ID NO: 34497 - DNA, 813 bp, Artificial Sequence
  Description of Artificial Sequence: Synthetic coding sequence
atgcagcccagccccccacccacagagctggtgcccagcgagagagctgtggtgctgctgagctgtgccctgagcgccctgggcagcggcctgctggtggccacccacgccctgtggccagacctgcggagccgggcccggcggctgctgctcttcctgagcctggccgacctgctgtctgctgccagctacttctacggcgtgctgcagaactttgctggccccagctgggactgtgtgctgcagggcgccctgagcacctttgccaacaccagcagcttcttctggacagtggccatcgccctgtacctgtacctgagcatcgtgcgggccgcccggggccccaggacagaccggctgctgtgggccttccacgtggtgtcctggggcgtgcccctggtgatcaccgtggccgctgtggccctgaagaagattggctatgatgccagtgatgtgtctgtgggctggtgctggattgacctggaggccaaggaccacgtgctgtggatgctgctgaccgggaagctgtgggagatgctggcctacgtgctgctgcccctgctgtacctgctggtgaggaagcacatcaacagagctggcatcggcaacaccttccagggcggggccaactgcatcatgtttgtgctgtgcaccagggctgtgaggaccaggctcttcagcctgtgctgctgctgctgcagcagccagccccccaccaagagccctgctggcacccccaaggccccagcccccagcaagccaggagagagccaggagagccagggcaccccaggagagctgcccagcacctag

SEQ ID NO: 34498 - DNA, 3648 bp, Artificial Sequence
  Description of Artificial Sequence: Synthetic coding sequence
atgggcgccatggcctaccccctgctgctgtgcctgctgctggcccagctgggcctgggcgctgtgggcgccagccgggacccccagggccgcccagacagcccccgggagaggacccccaagggcaagccccacgcccagcagcccggccgggccagcgccagtgacagcagcgccccctggagccgcagcacagatggcaccatcctggcccagaagctggccgaggaggtgcccatggatgtggccagctacctgtacaccggggacagccaccagctgaagagggccaactgcagcggccgctatgagctggccggcctgcccgggaagtggccagccctggccagcgcccaccccagcctgcaccgggccctggacaccctgacccacgccaccaacttcctgaatgtgatgctgcagagcaacaagagccgggagcagaacctgcaggatgacctggactggtaccaggccctggtgtggagcctgctggagggggagcccagcatcagccgggccgccatcaccttcagcacagacagcctgagcgccccagccccccaggtgttcctgcaggccacccgggaggagagccgcatcctgctgcaggacctgagcagcagcgccccccacctggccaatgccaccctggagacagagtggttccacggcctgcggaggaagtggaggccccacctgcaccggcggggccccaaccagggcccccggggcctgggccacagctggaggaggaaggatggcctgggcggggacaagagccacttcaagtggagccccccctacctggagtgtgaaaatggcagctacaagccaggctggctggtgaccctgagcagcgccatctacggcctgcagcccaacctggtgcctgagttccggggcgtgatgaaggtggacatcaacctgcagaaggtggacatcgaccagtgcagcagtgatggctggttcagcggcacccacaagtgccacctgaacaacagcgagtgcatgcccatcaagggcctgggctttgtgctgggcgcctatgagtgcatctgcaaggccggcttctaccaccctggggtgctgcctgtgaacaacttcagaagaagaggccctgaccagcacatcagcggcagcaccaaggatgtgtctgaggaggcctacgtgtgcctgccctgccgggagggctgccccttctgtgctgatgacagcccctgctttgtgcaggaggacaagtacctgcggctggccatcatctccttccaggccctgtgcatgctgctggactttgtgtccatgctggtggtgtaccacttcaggaaggccaagagcatccgggccagcggcctcatcctgctggagaccatcctgtttggcagcctgctgctgtacttccctgtggtgatcctgtactttgagcccagcaccttccgctgcatcctgctgcgctgggcccggctgctgggctttgccaccgtgtatggcaccgtgaccctgaagctgcaccgggtgctgaaggtgttcctgagcaggacagcccagaggatcccctacatgactggaggccgggtgatgaggatgctggccgtcatcctgctggtggtgttctggttcctgattggctggaccagctctgtgtgccagaacctggagaagcagatcagcctgattggccagggcaagaccagtgaccacctgatcttcaacatgtgcctgattgaccgctgggactacatgacagctgtggccgagttcctgttcctgctgtggggcgtgtacctgtgctatgctgtgaggacagtgcccagcgccttccacgagccccgctacatggctgtggccgtgcacaatgaactcatcatcagcgccatcttccacaccatccgctttgtgctggccagccggctgcagagcgactggatgctgatgctgtactttgcccacacccacctgactgtgacagtgaccatcggcctgctgctgatccccaagttcagccacagcagcaacaaccccagagatgacatcgccacagaggcctatgaagatgagctggacatgggccgcagcggcagctacctgaacagcagcatcaacagcgcctggagcgagcacagcctggaccctgaggacatcagagatgagctgaagaagctgtatgcccagctggagatctacaagaggaagaagatgatcaccaacaacccccacctgcagaagaagcgctgcagcaagaagggcctgggccgcagcatcatgaggcgcatcacagagatccctgagaccgtgtcccggcagtgcagcaaggaggacaaggagggcgctgaccatggaacagccaagggcacagccctgatcaggaagaaccccccagagagcagcggcaacacaggcaagagcaaggaggagaccctgaagaacagagtcttcagcctgaagaagagccacagcacctatgaccacgtgcgggaccagacagaggagagcagcagcctgcccacagagagccaggaggaggagaccacagagaacagcaccctggagagcctgagcggcaagaagctgacccagaagctgaaggaggacagcgaggccgagagcacagagagcgtgcccctggtgtgcaagagcgccagcgcccacaacctgagcagcgagaagaagacaggccaccccaggacctccatgctgcagaagagcctgagcgtcatcgccagcgccaaggagaagaccctgggcctggccggcaagacccagacagctggggtggaggagaggaccaagagccagaagcccctgcccaaggacaaggagaccaacagaaaccacagcaacagcgacaacacagagaccaaggaccctgccccccagaacagcaacccagctgaggagcccaggaagccccagaagagcggcatcatgaagcagcagagggtgaaccccaccacagccaacagcgacctgaaccctggcaccacccagatgaaggacaactttgatattggagaggtgtgcccctgggaggtgtatgacctgaccccaggccctgtgcccagcgagagcaaggtgcagaagcacgtgtccatcgtggccagcgagatggagaagaaccccaccttcagcctgaaggagaagagccaccacaagcccaaggctgctgaggtgtgccagcagagcaaccagaagagaattgacaaggccgaggtgtgcctgtgggagagccagggccagagcatcctggaggatgagaagctgctgatcagcaagacccctgtgctgcctgagcgggccaaggaggagaatggaggccagcccagggctgccaacgtgtgtgccggccagagcgaggagctgccccccaaggctgtggccagcaagacagaaaatgaaaacctgaaccagatcggccaccaggagaagaagaccagcagcagtgaagaaaatgtgcggggcagctacaacagcagcaacaacttccagcagcccctgaccagcagagctgaggtgtgcccctgggagtttgagaccccagcccagcccaatgccggccgctctgtggccctgcctgccagcagcgccctgagcgccaacaagattgctggccccaggaaggaggagatctgggacagcttcaaggtgtag

SEQ ID NO: 34499 - DNA, 1017 bp, Artificial Sequence
  Description of Artificial Sequence: Synthetic coding sequence
atgacagccctgagcagcgagaactgcagcttccagtaccagctgcggcagaccaaccagcccctggatgtgaactacctgctcttcctgatcatcctgggcaagatcctgctgaacatcctgaccctgggcatgaggaggaagaacacctgccagaacttcatggagtacttctgcatcagcctggcctttgtggacctgctgctgctggtgaacatcagcatcatcctgtacttccgggactttgtgctgctgagcatccgcttcaccaagtaccacatctgcctcttcacccagatcatctccttcacctacggcttcctgcactaccctgtgttcctgacagcctgcatcgactactgcctgaacttcagcaagaccaccaagctgtccttcaagtgccagaagctgttctacttcttcaccgtcatcctgatctggatctctgtgctggcctacgtgctgggggaccctgccatctaccagagcctgaaggcccagaatgcctacagccgccactgccccttctacgtgtccatccagagctactggctgtccttcttcatggtgatgatcctgtttgtggccttcatcacctgctgggaggaggtgaccaccctggtgcaggccatccgcatcaccagctacatgaatgagaccatcctgtacttccccttcagcagccacagcagctacacagtgcgcagcaagaagatcttcctgagcaagctgattgtgtgcttcctgagcacctggctgccctttgtgctgctgcaggtgatcatcgtgctgctgaaggtgcagatcccagcctacatcgagatgaacatcccctggctgtactttgtgaacagcttcctgattgccaccgtgtactggttcaactgccacaagctgaacctgaaggacatcggcctgcccctggacccctttgtgaactggaagtgctgcttcatccccctgaccatccccaacctggagcagatcgagaagcccatcagcatcatgatctgctag

SEQ ID NO: 34500 - DNA, 432 bp, Artificial Sequence
  Description of Artificial Sequence: Synthetic coding sequence
atgacagccctgagcagcgagaactgcagcttccagtaccagctgcggcagaccaaccagcccctggatgtgaactacctgctcttcctgatcatcctgggcaagatcctgctgaacatcctgaccctgggcatgaggaggaagaacacctgccagaacttcatggagtacttctgcatcagcctggcctttgtggacctgctgctgctggtgaacatcagcatcatcctgtacttccgggactttgtgctgctgagcatccgcttcaccaagtaccacatctgcctcttcacccagatcatctccttcacctacggcttcctgcactaccctgtgttcctgacagcctgcatcgactactgcctgaacttcagcaagaccaccaagctgtccttcaagtgccagaagctgttctacttcttcaccgtgtag

SEQ ID NO: 34501 - DNA, 267 bp, Artificial Sequence
  Description of Artificial Sequence: Synthetic coding sequence
atgacagccctgagcagcgagaactgcagcttccagtaccagctgcggcagaccaaccagcccctggatgtgaactacctgctcttcctgatcatcctgggcaagatcctgctgaacatcctgaccctgggcatgaggaggaagaacacctgccagaacttcatggagtacttctgcatcagcctggcctttgtggacctgctgctgctggtgaacatcagcatcatcctgtacttccgggactttgtgctgctgagcatcagatag

SEQ ID NO: 34502 - DNA, 102 bp, Artificial Sequence
  Description of Artificial Sequence: Synthetic coding sequence
atgacagccctgagcagcgagaactgcagcttccagtaccagctgcggcagaccaaccagcccctggatgtgaactacctgctcttcctgatcatcctgtag

SEQ ID NO: 34503 - DNA, 1767 bp, Artificial Sequence
  Description of Artificial Sequence: Synthetic coding sequence
atggcccggggcggggccggggctgaggaggccagcctgcggagcaatgccctgtcctggctggcctgtggcctgctggccctgctggccaatgcctggatcatcctgagcatcagcgccaagcagcagaagcacaagcccctggagctgctgctgtgcttcctggccggcacccacatcctgatggctgctgtgcccctgaccacctttgctgtggtgcagctgcggcggcaggccagcagtgactatgactggaatgaaagcatctgcaaggtgtttgtgtccacctactacaccctggccctggccacctgcttcaccgtggccagcctgagctaccacaggatgtggatggtgcgctggcctgtgaactaccgcctgagcaatgccaagaagcaggccctgcatgctgtgatgggcatctggatggtgtccttcatcctgagcaccctgcccagcatcggctggcacaacaatggagagcgctactatgcccggggctgccagttcatcgtgtccaagattggcctgggctttggagtgtgcttcagcctgctgctgctgggcggcatcgtgatgggcctggtgtgtgtggccatcaccttctaccagaccctgtgggcccggccccggcgggcccggcaggccaggagagtgggcggcggcggcggcaccaaggccggcggccctggggccctgggcaccaggcctgcctttgaggtgcctgccatcgtggtggaggatgcccggggcaagagaagaagcagcctggatggcagcgagagcgccaagaccagcctgcaggtgaccaacctggtgtctgccatcgtgttcctgtatgacagcctgactggagtgcccatcctggtggtgtccttcttcagcctgaagagtgacagcgccccaccctggatggtgctggccgtgctgtggtgcagcatggcccagaccctgctgctgcccagcttcatctggagctgtgagcgctacagagcagatgtgaggacagtgtgggagcagtgtgtggccatcatgtctgaggaggatggagatgatgatggcggctgtgatgattatgcagagggccgggtgtgcaaggtgcgctttgatgccaacggggccactggacctggcagccgggaccctgcccaggtgaagctgctgcccggccgccacatgctgttcccccccctggagcgggtgcactacctgcaggtgcccctgagccggcggctgagccatgatgagaccaacatcttcagcaccccccgggagcccggcagcttcctgcacaagtggagcagcagtgatgacatccgggtgctgcctgcccagagccgggccctgggcggccccccagagtacctgggccagaggcaccggctggaggatgaggaggatgaggaggaggccgagggcggcggcctggccagcctgcggcagttcctggagagcggcgtgctgggcagcggcggcggccccccccggggccctggcttcttccgggaggagatcaccaccttcattgatgagacccccctgcccagccccacagccagccctggccacagcccccggcggccccggcccctgggcctgagcccccggcggctgagcctgggcagccctgagagcagagctgtgggcctgcccctgggcctgtctgctggccgccgctgcagcctgactggaggagaggagagcgcccgggcctggggcggctcctggggccctggcaaccccatcttcccccagctgaccctgtag

SEQ ID NO: 34504 - DNA, 915 bp, Artificial Sequence
  Description of Artificial Sequence: Synthetic coding sequence
atgctgagcactggagtggtgtccttcttcagcctgaagagtgacagcgccccaccctggatggtgctggccgtgctgtggtgcagcatggcccagaccctgctgctgcccagcttcatctggagctgtgagcgctacagagcagatgtgaggacagtgtgggagcagtgtgtggccatcatgtctgaggaggatggagatgatgatggcggctgtgatgattatgcagagggccgggtgtgcaaggtgcgctttgatgccaacggggccactggacctggcagccgggaccctgcccaggtgaagctgctgcccggccgccacatgctgttcccccccctggagcgggtgcactacctgcaggtgcccctgagccggcggctgagccatgatgagaccaacatcttcagcaccccccgggagcccggcagcttcctgcacaagtggagcagcagtgatgacatccgggtgctgcctgcccagagccgggccctgggcggccccccagagtacctgggccagaggcaccggctggaggatgaggaggatgaggaggaggccgagggcggcggcctggccagcctgcggcagttcctggagagcggcgtgctgggcagcggcggcggccccccccggggccctggcttcttccgggaggagatcaccaccttcattgatgagacccccctgcccagccccacagccagccctggccacagcccccggcggccccggcccctgggcctgagcccccggcggctgagcctgggcagccctgagagcagagctgtgggcctgcccctgggcctgtctgctggccgccgctgcagcctgactggaggagaggagagcgcccgggcctggggcggctcctggggccctggcaaccccatcttcccccagctgaccctgtag

SEQ ID NO: 34505 - DNA, 960 bp, Artificial Sequence
  Description of Artificial Sequence: Synthetic coding sequence
atgaccaacagcagcttcttctgccctgtgtacaaggacctggagcccttcacctacttcttctacctggtgttcctggtgggcatcatcggcagctgctttgccacctgggccttcatccagaagaacaccaaccaccgctgtgtgtccatctacctgatcaacctgctgacagctgacttcctgctgaccctggccctgcctgtgaagatcgtggtggacctgggcgtggccccctggaagctgaagatcttccactgccaggtgacagcctgcctgatctacatcaacatgtacctgagcatcatcttcctggcctttgtgtccattgaccgctgcctgcagctgacccacagctgcaagatctaccgcatccaggagcccggctttgccaagatgatcagcacagtggtgtggctgatggtgctgctgatcatggtgcccaacatgatgatccccatcaaggacatcaaggagaagagcaatgtgggctgcatggagttcaagaaggagtttggaagaaactggcacctgctgaccaacttcatctgtgtggccatcttcctgaacttcagcgccatcatcctgatcagcaactgcctggtgatccggcagctgtacagaaacaaggacaatgaaaactacccaaatgtgaagaaggccctgatcaacatcctgctggtgaccaccggctacatcatctgctttgtgccctaccacatcgtgcgcatcccctacaccctgagccagacagaggtgatcacagactgcagcacccgcatcagcctcttcaaggccaaggaggccaccctgctgctggccgtgagcaacctgtgctttgaccccatcctgtactaccacctgagcaaggccttccgcagcaaggtgacagagacctttgccagccccaaggagaccaaggcccagaaggagaagctgcgctgtgagaacaatgcctag

SEQ ID NO: 34506 - DNA, 57 bp, Artificial Sequence
  Description of Artificial Sequence: Synthetic coding sequence
atgaccaacagcagcttcttctgccctgtgtacaaggacctggagcccttcacctag

SEQ ID NO: 34507 - DNA, 1122 bp, Artificial Sequence
  Description of Artificial Sequence: Synthetic coding sequence
atggccaacaccactggagagcctgaggaggtgtctggggccctgagccccccatctgccagcgcctacgtgaagctggtgctgctgggcctcatcatgtgtgtgtccctggccggaaatgccatcctgagcctgctggtgctgaaggagcgggccctgcacaaggccccctactacttcctgctggacctgtgcctggctgatggcatccgctctgctgtgtgcttcccctttgtgctggcctctgtgagacatggcagctcctggaccttcagcgccctgagctgcaagatcgtggccttcatggctgtgctcttctgcttccacgccgccttcatgctgttctgcatctctgtgacccgctacatggccatcgcccaccaccgcttctacgccaagaggatgaccctgtggacctgtgccgccgtcatctgcatggcctggaccctgtctgtggccatggccttcccccctgtgtttgatgtgggcacctacaagttcatccgggaggaggaccagtgcatctttgagcaccgctacttcaaggccaatgacaccctgggcttcatgctgatgctggccgtgctgatggccgccacccatgctgtgtatggcaagctgctgctgtttgagtaccgccacaggaagatgaagcctgtgcagatggtgcctgccatcagccagaactggaccttccacggccctggggccaccggccaggccgccgccaactggattgctggcttcggccggggccccatgccacccaccctgctgggcatccggcagaatggacatgctgccagccggcggctgctgggcatggatgaggtgaagggggagaagcagctgggccgcatgttttatgccatcaccctgctcttcctgctgctgtggagcccctacatcgtggcctgctactggagggtgtttgtgaaggcctgtgctgtgccccaccgctacctggccacagctgtgtggatgagctttgcccaggccgctgtgaaccccatcgtgtgcttcctgctgaacaaggacctgaagaagtgcctgcggacccacgccccctgctggggcaccggcggggccccagccccccgggagccctactgtgtgatgtag

SEQ ID NO: 34508 - DNA, 159 bp, Artificial Sequence
  Description of Artificial Sequence: Synthetic coding sequence
atggccaacaccactggagagcctgaggaggtgtctggggccctgagccccccatctgccagcgcctacgtgaagctggtgctgctgggcctcatcatgtgtgtgtccctggccggaaatgccatcctgagcctgctggtgctgaaggagcgggcctag

SEQ ID NO: 34509 - DNA, 1002 bp, Artificial Sequence
  Description of Artificial Sequence: Synthetic coding sequence
atgcctgccaactacacctgcaccaggccagatggagacaacacagacttccgctacttcatctatgctgtgacctacaccgtcatcctggtgcccggcctgattggcaacatcctggccctgtgggtgttctacggctacatgaaggagaccaagagagctgtgatcttcatgatcaacctggccatcgctgacctgctgcaggtgctgagcctgcccctgcgcatcttctactacctgaaccacgactggcccttcggccctggcctgtgcatgttctgcttctacctgaagtatgtgaacatgtatgccagcatctacttcctggtgtgcatctctgtgcggcgcttctggttcctgatgtaccccttccgcttccatgactgcaagcagaagtatgacctgtacatcagcattgctggctggctgatcatctgcctggcctgtgtgctcttccccctgctgcggaccagtgatgacaccagcggcaacagaaccaagtgctttgtggacctgcccaccagaaatgtgaacctggcccagagcgtggtgatgatgaccatcggggagctgattggatttgtgacccccctgctgattgtgctgtactgcacctggaagacagtgctgagcctgcaggacaagtaccccatggcccaggacctgggggagaagcagaaggccctgaagatgatcctgacctgtgccggggtcttcctgatctgctttgccccctaccacttctccttccccctggacttcctggtgaagagcaatgagatcaagagctgcctggcccggcgggtcatcctgatcttccacagcgtggccctgtgcctggccagcctgaacagctgcctggaccctgtgatctactacttcagcaccaatgagttcagaagaaggctgagccggcaggacctgcatgacagcatccagctgcacgccaagagctttgtgagcaaccacacagccagcaccatgaccccagagctgtgctag

SEQ ID NO: 34510 - DNA, 7104 bp, Artificial Sequence
  Description of Artificial Sequence: Synthetic coding sequence
atgggcaccagaggagctgtgatgcccccacccatgtggggcctgctgggctgctgctttgtgtgtgcctgggccctgggcggcccccggcccatccgcagcctgccccccctgagcagccaggtgaagccaggctctgtgcccatgcaggtgcccctggagggcgctgaggccgccctggcctacctgtacagcggagatgcccagcagctgagccaggtgaactgcagcgagagatatgaggcccggggagctggggccatgcctggcctgccccccagcctgcagggcgctgctggcaccctggcccaggccgccaacttcctgaacatgctgctgcaggccaatgacatccgggagagctctgtggaggaggatgtggagtggtaccaggccctggtgcgctctgtggccgagggggacccccgggtgtaccgggccctgctgaccttcaaccccccacctggggccagccacctgcagctggccctgcaggccaccaggactggagaggagaccatcctgcaggacctgagcggcaactgggtgcaggaggagaaccccccaggggacctggacaccccagccctgaagaagagggtgctgaccaatgacctgggcagcctgggcagccccaagtggccccaggctgatggctacgtgggggacacccagcaggtgcggctgagcccccccttcctggagtgccaggagggccgcctgcggcccggctggctgatcaccctgagcgccaccttctacggcctgaagccagacctgagccctgaggtgcggggccaggtgcagatggatgtggacctgcagagcgtggacatcaaccagtgtgccagcggccctggctggtacagcaacacccacctgtgtgacctgaacagcacccagtgtgtgcccctggagagccagggctttgtgctgggccgctacctgtgccgctgcaggcctggcttctacggggccagccccagcggcggcctggaggagagtgacttccagaccaccggccagtttggcttccctgagggccgcagcggccgcctgctgcagtgcctgccctgcccagagggctgcaccagctgcatggatgccaccccctgcctggtggaggaggccgctgtgctgcgggctgctgtgctggcctgccaggcctgctgcatgctggccatcttcctgtccatgctggtgtcctaccgctgcagaagaaacaagaggatctgggccagcggcgtggtgctgctggagaccgtgctgtttggcttcctgctgctgtacttccctgtgttcatcctgtacttcaagcccagcgtcttccgctgcatcgccctgcgctgggtgcggctgctgggctttgccatcgtgtatggcaccatcatcctgaagctgtacagagtgctgcagctgttcctgagcaggacagcccagaggtctgccctgctgagcagcggccgcctgctgcggcggctgggcctgctgctgctgcctgtgctgggcttcctggccgtgtggacagtgggcgccctggagcggggcatccagcacgcccccctggtgatccggggccacacccccagcggccgccacttctacctgtgccaccacgaccgctgggactacatcatggtggtggccgagctgctgctgctgtgctggggcagcttcctgtgctacgccaccagggctgtgctgagcgccttccacgagccccgctacatgggcatcgccctgcacaatgagctgctgctgtctgctgccttccacacagccaggtttgtgctggtgcccagcctgcacccagactggaccctgctgctcttcttcttccacacccacagcacagtgaccaccaccctggccctgatcttcatccccaagttctggaagctgggcgccccaccccgggaggagatggtggatgaggtgtgtgaagatgagctggacctgcagcacagcggcagctacctgggcagcagcatcgccagcgcctggagcgagcacagcctggaccccggggacatcagagatgagctgaagaagctgtatgcccagctggaggtgcacaagaccaaggagatggccgccaacaacccccacctgcccaagaagaggggcagcagctgccagggcctgggccgctccttcatgagatacctggccgagttccctgaggccctggcccggcagcacagccgggacagcggcagccctggccacggcagcctgcccggcagcagcagaagaaggctgctgagcagcagcctgcaggagcctgagggcaccccagccctgcacaagagccgcagcacctatgaccagaggcgggagcaggacccccccctgctggacagcctgctgcggaggaagctggccaagaaggccagcaggacagagagccgggagagcgtggagggccccccagccctgggcttccgcagcgccagcgcccacaacctgactgtgggggagcggctgccccgggcccggcctgccagcctgcagaagagcctgtctgtggccagcagccgggagaaggccctgctgatggccagccaggcctacctggaggagacctaccggcaggccaaggagcgggaggagaggaagaaggccaaggccgccatggccagcctggtgcggcggcccagcgcccggcggctggagcggcccaggggggcccccctgagcgccccacccagccctgccaagagcagctctgtggacagcagccacaccagcggccgcctgcacgaggaggcccggcggcggctgccccacccccccatccgccaccaggtgtccacccccatcctggccctgagcggcggcctgggggagcccaggatgctgagccccaccagcaccctggccccagccctgctgcctgccctggcccccaccccagccccagccctggcccctgtgcctgtgagcccccagagccccaacctgctgacctacatctgcccctgggagaatgctgagctgcctgccaagcaggagaatgtgccccaggagggccccagcggccctgagcggggccaccacagccctgccccagcccgggcccggctgtggagggccctgtctgtggccgtggagaagagccgggccggggagaatgagatggatgctgaagatgcccaccaccagcgggaggccaatgatgtggatgaagatcggcccaagatcttccccaagagccacagcctgaaggcccctgtgcagcagggctccatgaggagcctgggcctggccatcaaggccctgaccaggagccgcagcacctaccgggagaaggagagcgtggaggagagccctgagggccagaacagcggcacagctggggagagcatgggcgcccccagccgcagcccccggctgggccggcccaaggctgtgtccaagcaggccgccctgatccccagtgatgacaaggagagcctgcagaaccagcagaatgcccacaccagcaggatgctgcaggtgtgccagcgggagggcagccgggagcaggaggaccggggccgcaggatgacccagggcctgggggagaggaaggccgagagagctgggaagacaggcctggccatgctgcggcaggtgtcccgggacaagaacatcaagcagagcaaggagacccctgtgggctggcaggagctgcccaaggccggcctgcagagcctgggcagcgctgaccaccgggtggccgaggtgtgcccctgggaggtgacagaaagtgagacccggcagcctgacagcggcaacaaggccgagatctgcccctgggagaccagcgagggcgcccctgagagccgggccctgcggcaggaccccggggacagccagaagaagagaggagaggcccggggcaagtctgagcccattgatgtggtgcccatgatgaggaagaagccagagcggctggtgcgggagcaggaggccgtgtgcccctgggagagcgctgacagaggaggcctgagccctggcagcgccccccaggaccccggccgcatccgggacaagtctgaggccggggacagcgtggaggccaggaaggtggagaagccaggctgggaggccgccggccctgaggcccacaccccagacatcaccaaggccgagccctgcccctgggaggccagcgagggcggggaggatggcaagccagcccaggaggccgtgaaggacctgccccaggagaagcagaagaccaggaaggccaccttctggaaggagcagaagccaggaggagacctggagagcctgtgcccctgggagagcacagacttccggggccccagcgctgtgtccatccaggcccctggcagcagcgagtgcagcggcagcctgggcagcggcattgctgaggtgtgcctgtgggaggccggagatgccccagccatccagaaggccgagatctgcccctgggagctggatgacaacgtgatgggccaggagatgctgagcctgggcaccggccgggagagcctgcaggagaaggagaaggccagcaggaagggcagctttggagagatgggagagcagacagtgaaggctgtgcagaagctgagccagcagcaggagagcgtgtgcccccgggagagcacagtgcccggccacagcagcccctgcctggacaacagcagcagcaaggccggcagccagttcctgtgcaatggaggcagccgggccacccaggtgtgcccccaggaggacctgcggcctgaggcccaggaggccaccccagccaagacagagatctgcccctgggaggtgaatgaaagaacccgggaggagtggaccagcgcccaggtgccccggggcggggagagccagaaggacaaggagaagatgcctgggaagtcagaaattgaagatgtgacagcctgggagaagccagagggccagatccagaagcaggaggccgtgggcccctgggagagcgtggaccccggcagcttcagcccccagccccggccccaggacacagagcggccccagaccctgctgcagatgagcggctctgtgggcagcaaggctgctgacatctgccccctggatgtggaggagaacctgacagctgggaaggccgagatctgcccctgggaggtgggcgctggggccggggaggagcgggccctgggcgctgaggccatcaggaagagccccaatgacaccgggaaggtgtctgctgacctgggcccccgggagagagctgtgacagcccctgagaagccccagaagcccaccccagagtgggaggtggcctgcccctggggctctgtgggccctggggcctgcagccagcaccctggcaccctggatgctgatggccccaaggccggcttccaggagctggaccacatgggctgcaggcctggagaggtgtgcccctgggaggcccaggaggccgccaccagcgagaaggccaagatctgcccctgggaggtgtctgagggcaccaccgggaagggcctggaccagaaggccggcagcgagagcgctgagcagcgggagaaggccctggagaagggccgcctgaccagcctgggagaagatgtgtccaagggcatggccaagctgtgccagcagcaggagaccatctgcatctgggagaacaaggacctgcgggagagccctgcccaggcccccaagatcagtgacctgcccagctccatgagcagcgaggtggccgagggccacagcctggaggccacagagaagggggacctgcggcaggaccccaagacaggcagcttccctgagcacatcacccaggagaaggccccagctgctgacacagaggagttcaccacagaagatggagagaagaccagccatgagctgcagagcgtgtgcccctgggagaccacagccccagctgacagcgtgagccacctggaccggcagaggccagaccagcccaaggccagcagccagaggctggtgtccactggaggccgggctgctgatgtgtgcccctgggatgtgcctgatgctggggtgtacaagagtgacagcagcgccaaggccgagacctgcccctgggaggtgacagagcgcatccctgtgaagggcgtgtcccggcaggacggcaagggggacagccaggaggagaagggccgggcccctgagaagtctgagcccaagggcgtgcctgtgcagaagaagccagagatggctgacttccggcagcaggaggccgtgtgcccctgggagagccaggacggcaagggcctgagcccccagcctgccccagatgccagtgacaggagccggggcagcagcgaggccgccggctctgtggagaccagggtggccgaggtgtgcctgtgggaggtggtggaggcccccagcgccaagaaggccgagatctgcccctgggaggccggcggcggcgctgctgaggagggggagcaggagcgggagagccagggccagggcgagatgttcctgcagaaggccggccctgggggcacagaggagcacttcagcaaggctgctgccaagccccgggagcaggaggccgtgtgccctggagagggcaccggcagcggcggcctgctgccccagagcggggccctggaccctgagctgaaggtgagccccaaggaggccggctccatgggcagcaggatggccgagctgtgccagtgggagatcacagatcctgagggcaacaagatcaagggcaccatggctgacatctgccctggagaggagactggagtgcccagcgaggagagcggcctgctggccctgacagccacccggcgggagttcttccccacagcccctgagaagcccctgtgcctgctggtgcacggccccctggaccacttcttccctgagagcaagatcccctgccccaaggtgtccaggcctgccagcaccttcaccctggagggcgtgcgggagctgcagggccccagcggcctggagcccaggaccagcctggcccctgagcccagcctgcaggaggccgagagccagagcagcagcctgacagaggacagcggccaggtggcctttgaggcccagtatgaggagttcaccccacccaccgtgtacccctgggactgggagtag

SEQ ID NO: 34511 - DNA, 1323 bp, Artificial Sequence
  Description of Artificial Sequence: Synthetic coding sequence
atgggcggcctgcggctgctggccgtggccctgacctgctgctggtggccccagggcagccagggcaagaccctgcggggcagcttcagcagcacagctgcccaggatgcccagggccagagaattggccactttgagttccacggggaccacgccctgctgtgtgtgcgcatcaacaacattgctgtggccgtgggcaaggaggccaagctgtacctgttccaggcccaggagtggctgaagctgcagcagagcagccacggctacagctgcagcgagaagctgagcaaggcccagctgaccatgaccatgaaccagacagagcacaacctgactgtgtcccagatccccagcccccagacctggcacgtgttctatgctgacaagtacacctgccaggatgacaaggagaacagccaggtggaggacatcccctttgagatggtgctgctgaacccagatgctgagggcaacccctttgaccacttctctgctggggagagcggcctgcacgagttcttcttcctgctggtgctggtgtacttcgtcatcgcctgcatctatgcccagagcctgtggcaggccatcaagaagggcggccccatgcacatgatcctgaaggtgctgaccacagccctgctgctgcaggccggcagcgccctggccaactacatccacttcagcagctacagcaaggatggcattggagtgcccttcatgggcagcctggccgagttctttgatattgccagccagatccagatgctgtacctgctgctgagcctgtgcatgggctggaccatcgtgaggatgaagaagagccagagccggcccctgcagtgggacagcaccccagccagcactggaattgctgtgttcatcgtgatgacccagagcgtgctgctgctgtgggagcagtttgaggacatcagccaccacagctaccacagccaccacaacctggccggcatcctgctgattgtgctgcgcatctgcctggccctgagcctgggctgcggcctgtaccagatcatcaccgtggagaggagcaccctgaagcgggagttctacatcacctttgccaagggctgcatcctgtggttcctgtgccaccctgtgctggcctgcatcagcgtcatcttcagtgactaccagagggacaaggtgatcaccatcggggtcatcctgtgccagagcgtgtccatggtgatcctgtaccgcctcttcctgagccacagcctgtactgggaggtgagcagcctgagctctgtgaccctgcccctgaccatcagcagcggccacaagagccggccccacttctag

SEQ ID NO: 34512 - DNA, 1215 bp, Artificial Sequence
  Description of Artificial Sequence: Synthetic coding sequence
atgtctgtgaagcccagctggggccctggccccagcgagggcgtgacagctgtgcccaccagtgacctgggggagatccacaactggacagagctgctggacctcttcaaccacaccctgtctgagtgccacgtggagctgagccagagcaccaagagggtggtgctgtttgccctgtacctggccatgtttgtggtgggcctggtggagaacctgctggtgatctgtgtgaactggaggggcagcggccgggccggcctgatgaacctgtacatcctgaacatggccatcgctgacctgggcatcgtgctgagcctgcctgtgtggatgctggaggtgaccctggactacacctggctgtggggcagcttcagctgccgcttcacccactacttctactttgtgaacatgtacagcagcatcttcttcctggtgtgcctgtctgtggaccgctacgtgaccctgaccagcgccagccccagctggcagcgctaccagcaccgggtgcggcgggccatgtgtgccggcatctgggtgctgagcgccatcatccccctgcctgaggtggtgcacatccagctggtggagggccctgagcccatgtgcctcttcatggccccctttgagacctacagcacctgggccctggccgtggccctgagcaccaccatcctgggcttcctgctgcccttccccctcatcaccgtcttcaacgtgctgacagcctgccgcctgcggcagcccggccagcccaagagccgccgccactgcctgctgctgtgtgcctacgtggccgtgtttgtgatgtgctggctgccctaccacgtgaccctgctgctgctgaccctgcacggcacccacatcagcctgcactgccacctggtgcacctgctgtacttcttctatgatgtgattgactgcttctccatgctgcactgtgtgatcaaccccatcctgtacaacttcctgagcccccacttccggggccgcctgctgaatgctgtggtgcactacctgcccaaggaccagaccaaggccggcacctgtgccagcagcagcagctgcagcacccagcacagcatcatcatcaccaagggggacagccagcctgctgctgctgccccccaccctgagcccagcctgtccttccaggcccaccacctgctgcccaacaccagccccatcagccccacccagcccctgacccccagctag

SEQ ID NO: 34513 - DNA, 1446 bp, Artificial Sequence
  Description of Artificial Sequence: Synthetic coding sequence
atgcgctggctgtggcccctggccgtgtccctggccgtcatcctggccgtgggcctgagccgggtgtctggaggagcccccctgcacctgggccgccacagagctgagacccaggagcagcagagccgcagcaagaggggcacagaagatgaggaggccaagggcgtgcagcagtatgtgcctgaggagtgggccgagtacccccggcccatccaccctgctggcctgcagcccaccaagcccctggtggccaccagccccaaccctgggaaggatggcggcaccccagacagcggccaggagctgcggggcaacctgactggagcccctggccagaggctgcagatccagaaccccctgtaccctgtgacagagagcagctacagcgcctatgccatcatgctgctggccctggtggtgtttgctgtgggcatcgtgggcaacctgtctgtgatgtgcatcgtgtggcacagctactacctgaagagcgcctggaacagcatcctggccagcctggccctgtgggacttcctggtgctcttcttctgcctgcccatcgtcatcttcaatgagatcaccaagcagaggctgctgggagatgtgtcctgcagagctgtgcccttcatggaggtgagcagcctgggcgtgaccaccttcagcctgtgtgccctgggcatcgaccgcttccacgtggccaccagcaccctgcccaaggtgcggcccatcgagcgctgccagagcatcctggccaagctggccgtcatctgggtgggctccatgaccctggccgtgcctgagctgctgctgtggcagctggcccaggagcccgcccccaccatgggcaccctggacagctgcatcatgaagcccagcgccagcctgcctgagagcctgtacagcctggtgatgacctaccagaatgccaggatgtggtggtacttcggctgctacttctgcctgcccatcctcttcaccgtgacctgccagctggtgacctggagggtgcggggccccccaggcaggaagtctgagtgccgggccagcaagcatgagcagtgtgagagccagctgaacagcacagtggtgggcctgactgtggtgtatgccttctgcaccctgcctgaaaatgtgtgcaacatcgtggtggcctacctgagcacagagctgacccggcagaccctggacctgctgggcctcatcaaccagttcagcaccttcttcaagggggccatcacccctgtgctgctgctgtgcatctgccggcccctgggccaggccttcctggactgctgctgctgctgctgctgtgaggagtgtggcggggccagcgaggccagcgctgccaatggaagtgacaacaagctgaagacagaggtgagcagcagcatctacttccacaagccccgggagagcccccccctgctgcccctgggcaccccctgctag

SEQ ID NO: 34514 - DNA, 1047 bp, Artificial Sequence
  Description of Artificial Sequence: Synthetic coding sequence
atgctgctggccctggtggtgtttgctgtgggcatcgtgggcaacctgtctgtgatgtgcatcgtgtggcacagctactacctgaagagcgcctggaacagcatcctggccagcctggccctgtgggacttcctggtgctcttcttctgcctgcccatcgtcatcttcaatgagatcaccaagcagaggctgctgggagatgtgtcctgcagagctgtgcccttcatggaggtgagcagcctgggcgtgaccaccttcagcctgtgtgccctgggcatcgaccgcttccacgtggccaccagcaccctgcccaaggtgcggcccatcgagcgctgccagagcatcctggccaagctggccgtcatctgggtgggctccatgaccctggccgtgcctgagctgctgctgtggcagctggcccaggagcccgcccccaccatgggcaccctggacagctgcatcatgaagcccagcgccagcctgcctgagagcctgtacagcctggtgatgacctaccagaatgccaggatgtggtggtacttcggctgctacttctgcctgcccatcctcttcaccgtgacctgccagctggtgacctggagggtgcggggccccccaggcaggaagtcagaatgtcgggccagcaagcatgagcagtgtgagagccagctgaacagcacagtggtgggcctgactgtggtgtatgccttctgcaccctgcctgaaaatgtgtgcaacatcgtggtggcctacctgagcacagagctgacccggcagaccctggacctgctgggcctcatcaaccagttcagcaccttcttcaagggggccatcacccctgtgctgctgctgtgcatctgccggcccctgggccaggccttcctggactgctgctgctgctgctgctgtgaagaatgtggcggggccagcgaggccagcgctgccaacggcagtgacaacaagctgaagacagaggtgagcagcagcatctacttccacaagccccgggagagcccccccctgctgcccctgggcaccccctgctag

SEQ ID NO: 34515 - DNA, 1014 bp, Artificial Sequence
  Description of Artificial Sequence: Synthetic coding sequence
atgggaaatgattctgtgtcctatgaatatggagactacagcgacctgagtgacaggcctgtggactgcctggatggagcctgcctggccatcgaccccctgcgggtggcccccctgcccctgtatgctgccatcttcctggtgggcgtgcctggaaatgccatggtggcctgggtggccggcaaggtggcccggcggcgggtgggcgccacctggctgctgcacctggccgtggccgacctgctgtgctgcctgagcctgcccatcctggccgtgcccatcgcccggggcggccactggccctacggggctgtgggctgccgggccctgcccagcatcatcctgctgaccatgtatgcctctgtgctgctgctggccgccctgtctgctgacctgtgcttcctggccctgggccctgcctggtggagcacagtgcagagggcctgtggggtgcaggtggcctgtggggccgcctggaccctggccctgctgctgactgtgcccagcgccatctacagaaggctgcaccaggagcacttccctgcccggctgcagtgtgtggtggactatggaggcagcagcagcacagaaaatgctgtgacagccatccgcttcctgtttggcttcctgggccccctggtggccgtggccagctgccacagcgccctgctgtgctgggccgcccggcgctgccggcccctgggcacagccatcgtggtgggcttctttgtgtgctgggccccctaccacctgctgggcctggtgctgactgtggccgcccccaacagcgccctgctggcccgggccctgcgggcagagcccctcatcgtgggcctggccctggcccacagctgcctgaaccccatgctgttcctgtacttcggccgggcccagctgcggcgcagcctgcctgctgcctgccactgggccctgcgggagagccagggccaggatgagagcgtggacagcaagaagagcaccagccatgacctggtgtctgagatggaggtgtag

SEQ ID NO: 34516 - DNA, 1014 bp, Artificial Sequence; identical to SEQ ID NO: 34515
  Description of Artificial Sequence: Synthetic coding sequence

SEQ ID NO: 34517 - DNA, 1155 bp, Artificial Sequence
  Description of Artificial Sequence: Synthetic coding sequence
atgaccaacagcagcagcaccagcaccagcagcaccactggaggcagcctgctgctgctgtgtgaggaggaggagagctgggccggccgccgcatccctgtgtccctgctgtacagcggcctggccatcggcggcaccctggccaacggcatggtgatctacctggtgagcagcttcaggaagctgcagaccaccagcaatgccttcatcgtgaatggctgtgccgctgacctgtctgtgtgtgccctgtggatgccccaggaggccgtgctgggcctgctgcccaccggcagcgctgagcccccagctgactgggatggagctgggggcagctaccgcctgctgcggggcggcctgctgggcctgggcctgactgtgtccctgctgagccactgcctggtggccctgaaccgctacctgctgatcacccgggccccagccacctaccaggccctgtaccagaggaggcacacagctggcatgctggccctgtcctgggccctggccctgggcctggtgctgctgctgcccccctgggcccccaggcctggagctgccccaccccgggtgcactacccagccctgctggccgctgctgccctgctggcccagacagccctgctgctgcactgctacctgggcatcgtgagaagagtgcgggtgtctgtgaagagggtgtctgtgctgaacttccacctgctgcaccagctgcccggctgtgccgctgctgctgctgccttccctggggcccagcacgcccctggccctgggggcgccgcccacccagcccaggcccagcccctgcccccagccctgcacccccggcgggcccagaggcggctgagcggcctgtctgtgctgctgctgtgctgcgtgttcctgctggccacccagcccctggtgtgggtgtccctggccagcggcttcagcctgcctgtgccctggggcgtgcaggccgcctcctggctgctgtgctgtgccctgagcgccctgaaccccctgctgtacacctggagaaatgaggagttccgccgctctgtgcgctctgtgctgcccggggtgggagatgctgctgctgctgctgtggccgccacagctgtgcctgctgtgtcccaggcccagctgggcaccagggctgctggccagcactggtag

SEQ ID NO: 34518 - DNA, 963 bp, Artificial Sequence
  Description of Artificial Sequence: Synthetic coding sequence
atgttcctgggcatcctgagcattgagcagctgatcagccgggtgggcgtcatcggcgtgaccctgatggccctgctgagcggctttggagctgtgaactgcccctacacctacatgagctacttcctgagaaatgtgacagacacagacatcctggccctggagcggcggctgctgcagaccatggacatgatcatcagcaagaagaagaggatggccatggcccggaggaccatgttccagaagggggaggtgcacaacaagcccagcggcttctggggcatgatcaagtctgtgaccaccagcgccagcggcagcgagaacctgaccctcatccagcaggaggtggatgccctggaggagctgagccggcagctgttcctggagacagctgacctgtatgccaccaaggagcgcatcgagtacagcaagaccttcaagggcaagtacttcaacttcctgggctacttcttcagcatctactgtgtgtggaagatcttcatggccaccatcaacatcgtgtttgacagagtgggcaagacagatcctgtgacccggggcatcgagatcaccgtgaactacctgggcatccagtttgatgtgaagttctggagccagcacatctccttcatcctggtgggcatcatcatcgtgaccagcatccggggcctgctgatcaccctgaccaagttcttctacgccatcagcagcagcaagagcagcaatgtcatcgtgctgctgctggcccagatcatgggcatgtactttgtgtcctctgtgctgctgatccgcatgtccatgcccctggagtaccgcaccatcatcacagaggtgctgggggagctgcagttcaacttctaccaccgctggtttgatgtgatcttcctggtgtctgccctgagcagcatcctcttcctgtacctggcccacaagcaggcccctgagaagcagatggccccctag

SEQ ID NO: 34519 - DNA, 1173 bp, Artificial Sequence
  Description of Artificial Sequence: Synthetic coding sequence
atgaccctgacctgtgtgttctgggatgtgaccaagggcaccactggagactggagcagcgagggctgcagcacagaggtgcggcctgagggcaccgtgtgctgctgtgaccacctgaccttctttgccctgctgctgcggcccaccctggaccagagcacagtgcacatcctgacccgcatcagccaggccggctgcggcgtgtccatgatcttcctggccttcaccatcatcctgtatgccttcctgcggctgagccgggagcgcttcaagtcagaagatgcccccaagatccacgtggccctgggcggcagcctcttcctgctgaacctggccttcctggtgaatgtgggcagcggcagcaagggcagtgatgctgcctgctgggcccggggagctgtgttccactacttcctgctgtgtgccttcacctggatgggcctggaggccttccacctgtacctgctggccgtgcgggtcttcaacacctacttcggccactacttcctgaagctgagcctggtgggctggggcctgcctgccctgatggtgattggaactggaagtgccaacagctatggcctgtacaccatccgggaccgggagaacagaaccagcctggagctgtgctggttccgggagggcaccaccatgtatgccctgtacatcaccgtgcacggctacttcctgatcaccttcctgtttggcatggtggtgctggccctggtggtgtggaagatcttcaccctgagccgggccacagctgtgaaggagcggggcaagaacaggaagaaggtgctgaccctgctgggcctgagcagcctggtgggcgtgacctggggcctggccatcttcacccccctgggcctgagcacagtgtacatctttgccctcttcaacagcctgcagggcagctctgtggactgccaggccctgtctgctggggagaagctgctgagcctgctgggcctgccccagcagccctggaagctgcgggccgccgcccacctgcctgtgaggatgctgggcgcagatgtggactgcaagtggatgagatttgccagcccccccagcccccaggccgtggagcggcaggagggcggccccagcctgtatgcccggcgctgtgtgcccggccgggagatcctgggccggggccactgcatcatctag

SEQ ID NO: 34520 - DNA, 1650 bp, Artificial Sequence
  Description of Artificial Sequence: Synthetic coding sequence
atggccaccccccggggcctgggcgccctgctgctgctgctgctgctgcccaccagcggccaggagaagcccacagagggccccaggaacacctgcctgggcagcaacaacatgtatgacatcttcaacctgaatgacaaggccctgtgcttcaccaagtgccggcagagcggcagtgacagctgcaatgtggagaacctgcagcgctactggctgaactatgaggcccacctgatgaaggagggcctgacccagaaggtgaacacccccttcctgaaggccctggtgcagaacctgagcaccaacacagctgaggacttctacttcagcctggagcccagccaggtgccccggcaggtgatgaaggatgaggacaagcccccagacagagtgcggctgcccaagagcctcttccgcagcctgcccggcaacagatctgtggtgcggctggccgtgaccatcctggacatcggccctggcaccctcttcaagggcccccggctgggcctgggagatggcagcggcgtgctgaacaaccggctggtgggcctgtctgtgggccagatgcacgtgaccaagctggccgagcccctggagatcgtgttcagccaccagaggcccccacccaacatgaccctgacctgtgtgttctgggatgtgaccaagggcaccactggagactggagcagcgagggctgcagcacagaggtgcggcctgagggcaccgtgtgctgctgtgaccacctgaccttctttgccctgctgctgcggcccaccctggaccagagcacagtgcacatcctgacccgcatcagccaggccggctgcggcgtgtccatgatcttcctggccttcaccatcatcctgtatgccttcctgcggctgagccgggagcgcttcaagtcagaagatgcccccaagatccacgtggccctgggcggcagcctcttcctgctgaacctggccttcctggtgaatgtgggcagcggcagcaagggcagtgatgctgcctgctgggcccggggagctgtgttccactacttcctgctgtgtgccttcacctggatgggcctggaggccttccacctgtacctgctggccgtgcgggtcttcaacacctacttcggccactacttcctgaagctgagcctggtgggctggggcctgcctgccctgatggtgattggaactggaagtgccaacagctatggcctgtacaccatccgggaccgggagaacagaaccagcctggagctgtgctggttccgggagggcaccaccatgtatgccctgtacatcaccgtgcacggctacttcctgatcaccttcctgtttggcatggtggtgctggccctggtggtgtggaagatcttcaccctgagccgggccacagctgtgaaggagcggggcaagaacaggaagaaggtgctgaccctgctgggcctgagcagcctggtgggcgtgacctggggcctggccatcttcacccccctgggcctgagcacagtgtacatctttgccctcttcaacagcctgcagggcgtcttcatctgctgctggttcaccatcctgtacctgcccagccagagcaccaccgtgagcagcagcacagcccggctggaccaggcccacagcgccagccaggagtag

SEQ ID NO: 34521 - DNA, 1290 bp, Artificial Sequence
  Description of Artificial Sequence: Synthetic coding sequence
atgaaggatgaggacaagcccccagacagagtgcggctgcccaagagcctcttccgcagcctgcccggcaacagatctgtggtgcggctggccgtgaccatcctggacatcggccctggcaccctcttcaagggcccccggctgggcctgggagatggcagcggcgtgctgaacaaccggctggtgggcctgtctgtgggccagatgcacgtgaccaagctggccgagcccctggagatcgtgttcagccaccagaggcccccacccaacatgaccctgacctgtgtgttctgggatgtgaccaagggcaccactggagactggagcagcgagggctgcagcacagaggtgcggcctgagggcaccgtgtgctgctgtgaccacctgaccttctttgccctgctgctgcggcccaccctggaccagagcacagtgcacatcctgacccgcatcagccaggccggctgcggcgtgtccatgatcttcctggccttcaccatcatcctgtatgccttcctgcggctgagccgggagcgcttcaagtcagaagatgcccccaagatccacgtggccctgggcggcagcctcttcctgctgaacctggccttcctggtgaatgtgggcagcggcagcaagggcagtgatgctgcctgctgggcccggggagctgtgttccactacttcctgctgtgtgccttcacctggatgggcctggaggccttccacctgtacctgctggccgtgcgggtcttcaacacctacttcggccactacttcctgaagctgagcctggtgggctggggcctgcctgccctgatggtgattggaactggaagtgccaacagctatggcctgtacaccatccgggaccgggagaacagaaccagcctggagctgtgctggttccgggagggcaccaccatgtatgccctgtacatcaccgtgcacggctacttcctgatcaccttcctgtttggcatggtggtgctggccctggtggtgtggaagatcttcaccctgagccgggccacagctgtgaaggagcggggcaagaacaggaagaaggtgctgaccctgctgggcctgagcagcctggtgggcgtgacctggggcctggccatcttcacccccctgggcctgagcacagtgtacatctttgccctcttcaacagcctgcagggcgtcttcatctgctgctggttcaccatcctgtacctgcccagccagagcaccaccgtgagcagcagcacagcccggctggaccaggcccacagcgccagccaggagtag

SEQ ID NO: 34522 - DNA, 1074 bp, Artificial Sequence
  Description of Artificial Sequence: Synthetic coding sequence
atggccaccaccgtgcctgatggctgcagaaatggcctgaagagcaagtactaccgcctgtgtgacaaggccgaggcctggggcatcgtgctggagaccgtggccacagctggggtggtgacctctgtggccttcatgctgaccctgcccatcctggtgtgcaaggtgcaggacagcaacagaaggaagatgctgcccacccagttcctgttcctgctgggcgtgctgggcatcttcggcctgacctttgccttcatcatcggcctggatggcagcacaggccccacccgcttcttcctgtttggcatcctcttcagcatctgcttcagctgcctgctggcccatgctgtgtccctgaccaagctggtgcggggcaggaagcccctgagcctgctggtgatcctgggcctggccgtgggcttcagcctggtgcaggacgtcatcgccatcgagtacatcgtgctgaccatgaacagaacaaatgtgaatgtgttcagcgagctgagcgcccccaggagaaatgaagattttgtgctgctgctgacctacgtgctcttcctgatggccctgaccttcctgatgagcagcttcaccttctgtggcagcttcaccggctggaagagacatggagcccacatctacctgaccatgctgctgagcatcgccatctgggtggcctggatcaccctgctgatgctgcctgactttgaccggcgctgggatgacaccatcctgagcagcgccctggccgccaacggctgggtgttcctgctggcctacgtgtccccagagttctggctgctgaccaagcagaggaaccccatggactaccctgtggaggatgccttctgcaagccccagctggtgaagaagagctatggagtggagaacagagcctacagccaggaggagatcacccagggctttgaggagaccggggacaccctgtatgccccctacagcacccacttccagctgcagaaccagcccccccagaaggagttcagcatcccccgggcccacgcctggcccagcccctacaaggactatgaggtgaagaaggagggcagctag

SEQ ID NO: 34523 - DNA, 825 bp, Artificial Sequence
  Description of Artificial Sequence: Synthetic coding sequence
atggccaccaccgtgcctgatggctgcagaaatggcctgaagagcaagtactaccgcctgtgtgacaaggccgaggcctggggcatcgtgctggagaccgtggccacagctggggtggtgacctctgtggccttcatgctgaccctgcccatcctggtgtgcaaggtgcaggacagcaacagaaggaagatgctgcccacccagttcctgttcctgctgggcgtgctgggcatcttcggcctgacctttgccttcatcatcggcctggatggcagcacaggccccacccgcttcttcctgtttggcatcctcttcagcatctgcttcagctgcctgctggcccatgctgtgtccctgaccaagctggtgcggggcaggaagcccctgagcctgctggtgatcctgggcctggccgtgggcttcagcctggtgcaggacgtcatcgccatcgagtacatcgtgctgaccatgaacagaacaaatgtgaatgtgttcagcgagctgagcgcccccaggagaaatgaagattttgtgctgctgctgacctacgtgctcttcctgatggccctgaccttcctgatgagcagcttcaccttctgtggcagcttcaccggctggaagagacatggagcccacatctacctgaccatgctgctgagcatcgccatctgggtggcctggatcaccctgctgatgctgcctgactttgaccggcgctgggatgacaccatcctgagcagcgccctggccgccaacggctgggtgttcctgctggcctacgtgtccccagagttctggctgctgaccaagcagaggaacccctag

SEQ ID NO: 34524 - DNA, 2781 bp, Artificial Sequence
  Description of Artificial Sequence: Synthetic coding sequence
atggccttcctgatcatcctgatcacctgctttgtgatcatcctggccaccagccagccctgccagaccccagatgactttgtggccgccaccagccctggccacatcatcatcggcggcctgtttgccatccacgagaagatgctgagcagcgaggacagcccccggcggccccagatccaggagtgtgtgggctttgagatctctgtgttcctgcagaccctggccatgatccacagcattgagatgatcaacaacagcaccctgctgcccggggtgaagctgggctatgagatctatgacacctgcacagaggtgacagtggccatggccgccaccctgcgcttcctgagcaagttcaactgcagccgggagaccgtggagttcaagtgtgactacagcagctacatgccccgggtgaaggccgtcatcggcagcggctacagcgagatcaccatggctgtgtccaggatgctgaacctgcagctgatgccccaggtgggctatgagagcacagctgagatcctgagtgacaagatccgcttccccagcttcctgaggacagtgcccagcgacttccaccagatcaaggccatggcccacctgatccagaagagcggctggaactggattggcatcatcaccacagatgatgattatggccgcctggccctgaacaccttcatcatccaggccgaggccaacaacgtgtgcatcgccttcaaggaggtgctgcctgccttcctgagtgacaacaccatcgaggtgcgcatcaacagaaccctgaagaagatcatcctggaggcccaggtgaatgtcatcgtggtgttcctgcggcagttccacgtgtttgacctcttcaacaaggccatcgagatgaacatcaacaagatgtggatcgccagtgacaactggagcacagccaccaagatcaccaccatccccaacgtgaagaagattggcaaggtggtgggctttgccttcagaagaggcaacatcagcagcttccacagcttcctgcagaacctgcacctgctgcccagcgacagccacaagctgctgcatgaatatgccatgcacctgagcgcctgtgcctacgtgaaggacacagacctgagccagtgcatcttcaaccacagccagaggaccctggcctacaaggccaacaaggccatcgagaggaactttgtgatgagaaatgacttcctgtgggactatgcagagcccggcctcatccacagcatccagctggccgtgtttgccctgggctacgccatccgggacctgtgccaggcccgggactgccagaaccccaatgccttccagccctgggagctgctgggcgtgctgaagaatgtgaccttcacagatggctggaacagcttccactttgatgcccatggagacctgaacacaggctatgatgtggtgctgtggaaggagatcaatggccacatgacagtgaccaagatggccgagtatgacctgcagaatgatgtgttcatcatcccagaccaggagaccaagaatgagttcaggaacctgaagcagatccagagcaagtgcagcaaagaatgttctcctggccagatgaagaagaccaccaggagccagcacatctgctgctatgagtgccagaactgcccagagaaccactacaccaaccagacagacatgccccactgcctgctgtgcaacaacaagacccactgggcccctgtgcgcagcaccatgtgctttgagaaggaggtggagtacctgaactggaatgacagcctggccatcctgctgctgatcctgagcctgctgggcatcatctttgtgctggtggtgggcatcatcttcaccaggaacctgaacacccctgtggtgaagagcagcggcggcctgcgggtgtgctacgtgatcctgctgtgccacttcctgaactttgccagcaccagcttcttcatcggggagccccaggacttcacctgcaagacccggcagaccatgtttggagtgtccttcaccctgtgcatcagctgcatcctgaccaagagcctgaagatcctgctggccttctcctttgaccccaagctgcagaagttcctgaagtgcctgtaccggcccatcctgatcatcttcacctgcaccggcatccaggtggtgatctgcaccctgtggctgatctttgctgcccccaccgtggaggtgaatgtgtccctgcccagggtcatcatcctggagtgtgaggagggcagcatcctggccttcggcaccatgctgggctacatcgccatcctggccttcatctgcttcatctttgccttcaagggcaagtatgagaactacaatgaggccaagttcatcaccttcggcatgctgatctacttcatcgcctggatcaccttcatccccatctatgccaccaccttcggcaagtatgtgcctgctgtggagatcatcgtcatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccctgccagcctggacagcatgtctggaaatgtgaccatgaccaaccccagcagcagcggcaagagcgccacctggcagaagagcaaggacctgcaggcccaggcctttgcccacatctgcagagaaaatgccacctctgtgtccaagaccctgcccaggaagaggatgagcagcatctag

SEQ ID NO: 34525 - DNA, 2568 bp, Artificial Sequence
  Description of Artificial Sequence: Synthetic coding sequence
atggccttcctgatcatcctgatcacctgctttgtgatcatcctggccaccagccagccctgccagaccccagatgactttgtggccgccaccagccctggccacatcatcatcggcggcctgtttgccatccacgagaagatgctgagcagcgaggacagcccccggcggccccagatccaggagtgtgtgggctttgagatctctgtgttcctgcagaccctggccatgatccacagcattgagatgatcaacaacagcaccctgctgcccggggtgaagctgggctatgagatctatgacacctgcacagaggtgacagtggccatggccgccaccctgcgcttcctgagcaagttcaactgcagccgggagaccgtggagttcaagtgtgactacagcagctacatgccccgggtgaaggccgtcatcggcagcggctacagcgagatcaccatggctgtgtccaggatgctgaacctgcagctgatgccccaggtgggctatgagagcacagctgagatcctgagtgacaagatccgcttccccagcttcctgaggacagtgcccagcgacttccaccagatcaaggccatggcccacctgatccagaagagcggctggaactggattggcatcatcaccacagatgatgattatggccgcctggccctgaacaccttcatcatccaggccgaggccaacaacgtgtgcatcgccttcaaggaggtgctgcctgccttcctgagtgacaacaccatcgaggtgcgcatcaacagaaccctgaagaagatcatcctggaggcccaggtgaatgtcatcgtggtgttcctgcggcagttccacgtgtttgacctcttcaacaaggccatcgagatgaacatcaacaagatgtggatcgccagtgacaactggagcacagccaccaagatcaccaccatccccaacgtgaagaagattggcaaggtggtgggctttgccttcagaagaggcaacatcagcagcttccacagcttcctgcagaacctgcacctgctgcccagcgacagccacaagctgctgcatgaatatgccatgcacctgagcgcctgtgcctacgtgaaggacacagacctgagccagtgcatcttcaaccacagccagaggaccctggcctacaaggccaacaaggccatcgagaggaactttgtgatgagaaatgacttcctgtgggactatgcagagcccggcctcatccacagcatccagctggccgtgtttgccctgggctacgccatccgggacctgtgccaggcccgggactgccagaaccccaatgccttccagccctgggagcagatccagagcaagtgcagcaaggagtgcagccctggccagatgaagaagaccaccaggagccagcacatctgctgctatgagtgccagaactgcccagagaaccactacaccaaccagacagacatgccccactgcctgctgtgcaacaacaagacccactgggcccctgtgcgcagcaccatgtgctttgagaaggaggtggagtacctgaactggaatgacagcctggccatcctgctgctgatcctgagcctgctgggcatcatctttgtgctggtggtgggcatcatcttcaccaggaacctgaacacccctgtggtgaagagcagcggcggcctgcgggtgtgctacgtgatcctgctgtgccacttcctgaactttgccagcaccagcttcttcatcggggagccccaggacttcacctgcaagacccggcagaccatgtttggagtgtccttcaccctgtgcatcagctgcatcctgaccaagagcctgaagatcctgctggccttctcctttgaccccaagctgcagaagttcctgaagtgcctgtaccggcccatcctgatcatcttcacctgcaccggcatccaggtggtgatctgcaccctgtggctgatctttgctgcccccaccgtggaggtgaatgtgtccctgcccagggtcatcatcctggagtgtgaggagggcagcatcctggccttcggcaccatgctgggctacatcgccatcctggccttcatctgcttcatctttgccttcaagggcaagtatgagaactacaatgaggccaagttcatcaccttcggcatgctgatctacttcatcgcctggatcaccttcatccccatctatgccaccaccttcggcaagtatgtgcctgctgtggagatcatcgtcatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccctgccagcctggacagcatgtctggaaatgtgaccatgaccaaccccagcagcagcggcaagagcgccacctggcagaagagcaaggacctgcaggcccaggcctttgcccacatctgccgggagaatgccacctctgtgtccaagaccctgcccaggaagaggatgagcagcatctag

SEQ ID NO: 34526 - DNA, 2256 bp, Artificial Sequence
  Description of Artificial Sequence: Synthetic coding sequence
atggccttcctgatcatcctgatcacctgctttgtgatcatcctggccaccagccagccctgccagaccccagatgactttgtggccgccaccagccctggccacatcatcatcggcggcctgtttgccatccacgagaagatgctgagcagcgaggacagcccccggcggccccagatccaggagtgtgtgggctttgagatctctgtgttcctgcagaccctggccatgatccacagcattgagatgatcaacaacagcaccctgctgcccggggtgaagctgggctatgagatctatgacacctgcacagaggtgacagtggccatggccgccaccctgcgcttcctgagcaagttcaactgcagccgggagaccgtggagttcaagtgtgactacagcagctacatgccccgggtgaaggccgtcatcggcagcggctacagcgagatcaccatggctgtgtccaggatgctgaacctgcagctgatgccccaggtgggctatgagagcacagctgagatcctgagtgacaagatccgcttccccagcttcctgaggacagtgcccagcgacttccaccagatcaaggccatggcccacctgatccagaagagcggctggaactggattggcatcatcaccacagatgatgattatggccgcctggccctgaacaccttcatcatccaggccgaggccaacaacgtgtgcatcgccttcaaggaggtgctgcctgccttcctgagtgacaacaccatcgaggtgcgcatcaacagaaccctgaagaagatcatcctggaggcccagctgctgggcgtgctgaagaatgtgaccttcacagatggctggaacagcttccactttgatgcccacggggacctgaacacaggctatgatgtggtgctgtggaaggagatcaatggccacatgacagtgaccaagatggccgagtatgacctgcagaatgatgtgttcatcatcccagaccaggagaccaagaatgagttcaggaacctgaagcagatccagagcaagtgcagcaaggagtgcagccctggccagatgaagaagaccaccaggagccagcacatctgctgctatgagtgccagaactgcccagagaaccactacaccaaccagacagacatgccccactgcctgctgtgcaacaacaagacccactgggcccctgtgcgcagcaccatgtgctttgagaaggaggtggagtacctgaactggaatgacagcctggccatcctgctgctgatcctgagcctgctgggcatcatctttgtgctggtggtgggcatcatcttcaccaggaacctgaacacccctgtggtgaagagcagcggcggcctgcgggtgtgctacgtgatcctgctgtgccacttcctgaactttgccagcaccagcttcttcatcggggagccccaggacttcacctgcaagacccggcagaccatgtttggagtgtccttcaccctgtgcatcagctgcatcctgaccaagagcctgaagatcctgctggccttctcctttgaccccaagctgcagaagttcctgaagtgcctgtaccggcccatcctgatcatcttcacctgcaccggcatccaggtggtgatctgcaccctgtggctgatctttgctgcccccaccgtggaggtgaatgtgtccctgcccagggtcatcatcctggagtgtgaggagggcagcatcctggccttcggcaccatgctgggctacatcgccatcctggccttcatctgcttcatctttgccttcaagggcaagtatgagaactacaatgaggccaagttcatcaccttcggcatgctgatctacttcatcgcctggatcaccttcatccccatctatgccaccaccttcggcaagtatgtgcctgctgtggagatcatcgtcatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccctgccagcctggacagcatgtctggaaatgtgaccatgaccaaccccagcagcagcggcaagagcgccacctggcagaagagcaaggacctgcaggcccaggcctttgcccacatctgccgggagaatgccacctctgtgtccaagaccctgcccaggaagaggatgagcagcatctag

SEQ ID NO: 34527 - DNA, 330 bp, Artificial Sequence
  Description of Artificial Sequence: Synthetic coding sequence
atgaaggaggaggacagcagcttcaagctgtgtgtgcccggcatcgtggccctgcagagcccccccaacaaggccttccgcagcacagacacagtgggcttcctggagagcgagctgaagaagctgctgggcatgcagcaggagagccggctgtggaagctgggcagccaggagggccgggagctgctgaccaggcctgagatcaccgtggtggagggggagggctatgaggtgcagaggcggctgcggcacctgcccagccccatctctgtggcccagtgcctgctgctggaggagaagggggagatgggcaactggcccccagagtag

SEQ ID NO: 34528 - DNA, 2886 bp, Artificial Sequence
  Description of Artificial Sequence: Synthetic coding sequence
atgctgctgctgctgctgctggcccccctcttcctgcggcccccaggagctggaggagtgcagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgcgcatctgcagcaagagctacctgaccctggagaatggcaaggtgttcctgactggaggagacctgcctgccctggatggagcccgggtggacttccgctgtgaccctgacttccacctggtgggcagcagccgcagcatctgcagccagggccagtggagcacccccaagccccactgccaggtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgaggaggctcatcaccagaggagagtggcagagcgaggcccaggacaccatgaagacaggcagcagcaccaacaacaatgaggaggagaagagccggctgctggagaaggagaaccgggagctggagaagatcatcgccgagaaggaggagcgggtgtctgagctgcggcaccagctgcagagccggcagcagctgcggagcagaagacacccccccaccccacctgagcccagcggcggcctgccccggggccccccagagcccccagaccggctgagctgtgatggcagccgggtgcacctgctgtacaagtag

SEQ ID NO: 34529 - DNA, 2700 bp, Artificial Sequence
  Description of Artificial Sequence: Synthetic coding sequence
atgctgctgctgctgctgctggcccccctcttcctgcggcccccaggagctggaggagtgcagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgaggaggctcatcaccagaggagagtggcagagcgaggcccaggacaccatgaagacaggcagcagcaccaacaacaatgaggaggagaagagccggctgctggagaaggagaaccgggagctggagaagatcatcgccgagaaggaggagcgggtgtctgagctgcggcaccagctgcagagccggcagcagctgcggagcagaagacacccccccaccccacctgagcccagcggcggcctgccccggggccccccagagcccccagaccggctgagctgtgatggcagccgggtgcacctgctgtacaagtag

SEQ ID NO: 34530 - DNA, 2535 bp, Artificial Sequence
  Description of Artificial Sequence: Synthetic coding sequence
atgggccctggggccccctttgcccgggtgggctggcccctgcccctgctggtggtgatggccgccggcgtggcccctgtgtgggccagccacagcccccacctgccccggccccacagccgggtgcccccccaccccagcagcgagcggcgggctgtgtacatcggggccctcttccccatgtctgggggctggccaggcggccaggcctgccagcctgctgtggagatggccctggaggatgtgaacagcagaagagacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtacgccgacaactggttcaagatctatgaccccagcatcaactgcaccgtggatgagatgacagaagctgtggagggccacatcaccacagagatcgtgatgctgaacccagccaacaccaggagcatcagcaacatgaccagccaggagtttgtggagaagctgaccaagaggctgaagaggcaccctgaggagaccggcggcttccaggaggcccccctggcctatgatgccatctgggccctggccctggccctgaacaagaccagcggcggcggcggccgcagcggcgtgcggctggaggacttcaactacaacaaccagaccatcacagaccagatctaccgggccatgaacagcagcagctttgaaggagtgtctggccacgtggtgtttgatgccagcggcagcaggatggcctggaccctcatcgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgagaagactcatcaccagaggagagtggcagagcgaggcccaggacaccatgaagacaggcagcagcaccaacaacaatgaggaggagaagagccggctgctggagaaggaaaatcgggagctggagaagatcatcgccgagaaggaggagcgggtgtctgagctgcggcaccagctgcagagccggcagcagctgcggagccgccgccacccccccaccccacctgagcccagcggcggcctgccccggggccccccagagcccccagaccggctgagctgtgatggcagccgggtgcacctgctgtacaagtag

SEQ ID NO: 34531 - DNA, 2535 bp, Artificial Sequence; identical to SEQ ID NO: 34530
  Description of Artificial Sequence: Synthetic coding sequence

SEQ ID NO: 34532 - DNA, 1737 bp, Artificial Sequence
  Description of Artificial Sequence: Synthetic coding sequence
atgctgctgctgctgctgctggcccccctcttcctgcggcccccaggagctggaggagtgcagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgcgcatctgcagcaagagctacctgaccctggagaatggcaaggtgttcctgactggaggagacctgcctgccctggatggagcccgggtggacttccgctgtgaccctgacttccacctggtgggcagcagccgcagcatctgcagccagggccagtggagcacccccaagccccactgccaggtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggatcgtcatcagcaggacccacagccccacctag

SEQ ID NO: 34533 - DNA, 1989 bp, Artificial Sequence
  Description of Artificial Sequence: Synthetic coding sequence
atggctgctgaaaatgaggccagccaggagagcgccctgggcgcctacagccctgtggactacatgagcatcaccagcttcccccggctgcctgaagatgagcccgccccagctgcccccctgcggggcaggaaggatgaagatgccttcctgggggaccctgacacagatcctgacagcttcctgaagagcgcccggctgcagaggctgcccagcagcagcagcgagatgggcagccaggacggcagccccctgcgggagaccaggaaggaccccttctctgctgctgctgctgaatgtagctgccggcaggacggcctgaccgtcatcgtgacagcctgcctgacctttgccactggagtgacagtggccctggtgatgcagatctactttggagacccccagatcttccagcagggcgctgtggtgacagatgctgcccgctgcaccagcctgggcatcgaggtgctgagcaagcagggcagctctgtggatgctgctgtggccgccgccctgtgcctgggcatcgtggccccccacagcagcggcctgggcggcggcggcgtgatgctggtgcatgacatcagaagaaatgaaagccacctgattgacttccgggagagcgcccctggggccctgcgggaggagaccctgcagaggtcctgggagaccaagccaggcctgctggtgggcgtgcccggcatggtgaagggcctgcacgaggcccaccagctgtatggccgcctgccctggagccaggtgctggcctttgctgctgctgtggcccaggacggcttcaacgtgacccatgacctggcccgggccctggccgagcagctgccccccaacatgtctgagcgcttccgggagaccttcctgcccagcggccggccccccctgcccggcagcctgctgcacaggccagacctggccgaggtgctggatgtgctgggcaccagcggccctgctgccttctacgccggcggcaacctgaccctggagatggtggccgaggcccagcacgccggcggcgtcatcacagaggaggacttcagcaactacagcgccctggtggagaagcctgtgtgtggggtgtaccggggccacctggtgctgagccccccaccaccccacactggacctgccctgatcagcgccctgaacatcctggagggcttcaacctgaccagcctggtgtcccgggagcaggccctgcactgggtggccgagaccctgaagatcgccctggccctggccagccggctgggggaccctgtgtatgacagcaccatcacagagagcatggatgacatgctgagcaaggtggaggccgcctacctgcggggccacatcaatgacagccaggccgccccagcccccctgctgcctgtgtatgagctggatggagcccccacagctgcccaggtgctgatcatgggcccagatgacttcatcgtggccatggtgagcagcctgaaccagcccttcggcagcggcctcatcacccccagcggcatcctgctgaacagccagatgctggacttctcctggcccaacagaacagccaaccacagcgcccccagcctggagaacagcgtgcagcccgggaagaggcccctgtccttcctgctgcccaccgtggtgcggcctgctgagggcctgtgtggcacctacctggccctgggcgccaacggggccgcccggggcctgagcggcctgacccaggtgctgctgaatgtgctgaccctgaacagaaacctgagtgacagcctggcccggggccgcctgcacccagacctgcagagcaacctgctgcaggtggacagcgagttcacagaggaggagattgagttcctggaggcccggggccaccacgtggagaaggtggatgtgctgtcctgggtgcacggcagcaggaggaccaacaacttcatcatcgctgtgaaggaccccaggagcccagatgctgctggggccaccatcctgtag

SEQ ID NO: 34534 - DNA, 1185 bp, Artificial Sequence
  Description of Artificial Sequence: Synthetic coding sequence
atgattgtgttcatcttcctggccatgggcctgagcctggagaatgagtacaccagccagaccaacaactgcacctacctgcgggagcagtgcctgagagatgccaacggctgcaagcacgcctggagggtgatggaggatgcctgcaatgacagcgaccccggggacccctgcaagatgaggaacagcagctactgcaacctgagcatccagtacctggtggagagcaacttccagttcaaggagtgcctgtgcacagatgacttctactgcaccgtgaacaagctgctgggcaagaagtgcatcaacaagagtgacaacgtgaaggaggacaagttcaagtggaacctgaccaccaggagccaccacggcttcaagggcatgtggagctgcctggaggtggccgaggcctgtgtgggagatgtggtgtgcaatgcccagctggccagctacctgaaggcctgcagcgccaacggcaacccctgtgacctgaagcagtgccaggccgccatccgcttcttctaccagaacatccccttcaacatcgcccagatgctggccttctgtgactgtgcccagagcgacatcccctgccagcagagcaaggaggccctgcacagcaagacctgtgctgtgaacatggtgcccccacccacctgcctgagcgtcatccgcagctgccagaatgatgagctgtgccgccgccactaccgcaccttccagagcaagtgctggcagagggtgaccaggaaatgtcatgaagatgagaactgcatcagcaccctgagcaagcaggacctgacctgcagcggcagtgatgactgcaaggccgcctacatcgacatcctgggcaccgtgctgcaggtgcagtgcacctgcaggaccatcacccagagcgaggagagcctgtgcaagatcttccagcacatgctgcacaggaagagctgcttcaactaccccaccctgagcaatgtgaagggcatggccctgtacaccaggaagcacgccaacaagatcaccctgaccggcttccacagccccttcaatggagaggtgatctatgctgccatgtgcatgacagtgacctgtggcatcctgctgctggtgatggtgaagctgcggaccagccgcatcagcagcaaggcccgggaccccagcagcatccagatccctggagagctgtag

SEQ ID NO: 34535 - DNA, 1593 bp, Artificial Sequence
  Description of Artificial Sequence: Synthetic coding sequence
atgctgctgtggcccctgctgctgctgctgctgctgctgcccaccctggccctgctgcggcagcagaggagccaggatgcccggctgtcctggctggccggcctgcagcaccgggtggcctggggcgccctggtgtgggccgccacctggcagaggcggcggctggagcagagcaccctgcacgtgcaccagagccagcagcaggccctgcgctggtgcctgcagggcgcccagaggccccactgcagcctgcggcgcagcacagacatcagcaccttcaggaaccacctgcccctgaccaaggccagccagacccagcaggaggacagcggggagcagcccctgccccccaccagcaaccaggacctgggggaggccagcctgcaggccaccctgctgggcctggccgccctgaacaaggcctacccagaggtgctggcccagggccgcacagcccgggtgaccctgaccagcccctggccccggcccctgccctggccaggcaacaccctgggccaggtgggcaccccaggcaccaaggacccccgggccctgctgctggatgccctgcggagccctggcctgcgggccctggaggccggcacagctgtggagctgctggatgtgttcctgggcctggagacagatggagaggagctggccggggccatcgccgccggcaaccctggggcccccctgcgggagagagctgctgagctgcgggaggccctggagcagggcccccggggcctggccctgcggctgtggcccaagctgcaggtggtggtgaccctggatgctgggggccaggccgaggccgtggccgccctgggcgccctgtggtgccagggcctggccttcttcagccctgcctatgctgccagcggaggagtgctgggcctgaacctgcagcctgagcagccccacggcctgtacctgctgcccccaggggcccccttcatcgagctgctgcctgtgaaggagggcacccaggaggaggccgccagcaccctgctgctggccgaggcccagcagggcaaggagtatgagctggtgctgacagaccgggccagcctgacccgctgccgcctgggagatgtggtgcgggtggtgggcgcctacaaccagtgccctgtggtgcgcttcatctgccgcctggaccagaccctgtctgtgagaggagaagatattggagaagatctcttcagcgaggccctgggccgggctgtgggccagtgggccggggccaagctgctggaccacggctgtgtggagagcagcatcctggacagcagcgctggcagcgccccccactatgaggtgtttgtggccctgcggggcctgaggaacctgtctgaggagaacagagacaagctggaccactgcctgcaggaggccagcccccgctacaagagcctgcgcttctggggctctgtgggccctgcccgggtgcacctggtgggccagggcgccttccgggccctgcgggccgccctggccgcctgccccagcagccccttccccccagccatgccccgggtgctgcggcaccgccacctggcccagtgcctgcaggagcgggtggtgtcctag

SEQ ID NO: 34536 - DNA, 1425 bp, Artificial Sequence
  Description of Artificial Sequence: Synthetic coding sequence
atgctgctgtggcccctgctgctgctgctgctgctgctgcccaccctggccctgctgcggcagcagaggccccactgcagcctgcggcgcagcacagacatcagcaccttcaggaaccacctgcccctgaccaaggccagccagacccagcaggaggacagcggggagcagcccctgccccccaccagcaaccaggacctgggggaggccagcctgcaggccaccctgctgggcctggccgccctgaacaaggcctacccagaggtgctggcccagggccgcacagcccgggtgaccctgaccagcccctggccccggcccctgccctggccaggcaacaccctgggccaggtgggcaccccaggcaccaaggacccccgggccctgctgctggatgccctgcggagccctggcctgcgggccctggaggccggcacagctgtggagctgctggatgtgttcctgggcctggagacagatggagaggagctggccggggccatcgccgccggcaaccctggggcccccctgcgggagagagctgctgagctgcgggaggccctggagcagggcccccggggcctggccctgcggctgtggcccaagctgcaggtggtggtgaccctggatgctgggggccaggccgaggccgtggccgccctgggcgccctgtggtgccagggcctggccttcttcagccctgcctatgctgccagcggaggagtgctgggcctgaacctgcagcctgagcagccccacggcctgtacctgctgcccccaggggcccccttcatcgagctgctgcctgtgaaggagggcacccaggaggaggccgccagcaccctgctgctggccgaggcccagcagggcaaggagtatgagctggtgctgacagaccgggccagcctgacccgctgccgcctgggagatgtggtgcgggtggtgggcgcctacaaccagtgccctgtggtgcgcttcatctgccgcctggaccagaccctgtctgtgagaggagaagatattggagaagatctcttcagcgaggccctgggccgggctgtgggccagtgggccggggccaagctgctggaccacggctgtgtggagagcagcatcctggacagcagcgctggcagcgccccccactatgaggtgtttgtggccctgcggggcctgaggaacctgtctgaggagaacagagacaagctggaccactgcctgcaggaggccagcccccgctacaagagcctgcgcttctggggctctgtgggccctgcccgggtgcacctggtgggccagggcgccttccgggccctgcgggccgccctggccgcctgccccagcagccccttccccccagccatgccccgggtgctgcggcaccgccacctggcccagtgcctgcaggagcgggtggtgtcctag

SEQ ID NO: 34537 - DNA, 1425 bp, Artificial Sequence
  Description of Artificial Sequence: Synthetic coding sequence
atgctgctgtggcccctgctgctgctgctgctgctgctgcccaccctggccctgctgcggcagcagaggagccaggatgcccggctgtcctggctggccggcctgcagcaccgggtggcctggggcgccctggtgtgggccgccacctggcagaggcggcggctggagcagagcaccctgcacgtgcaccagagccagcagcaggccctgcgctggtgcctgcagggcgcccagaggccccactgcagcctgcggcgcagcacagacatcagcaccttcaggaaccacctgcccctgaccaaggccagccagacccagcaggaggacagcggggagcagcccctgccccccaccagcaaccaggacctgggggaggccagcctgcaggccaccctgctgggcctggccgccctgaacaaggcctacccagaggtgctggcccagggccgcacagcccgggtgaccctgaccagcccctggccccggcccctgccctggccaggcaacaccctgggccaggtgggcaccccaggcaccaaggacccccgggccctgctgctggatgccctgcggagccctggcctgcgggccctggaggccggcacagctgtggagctgctggatgtgttcctgggcctggagacagatggagaggagctggccggggccatcgccgccggcaaccctggggcccccctgcgggagagagctgctgagctgcgggaggccctggagcagggcccccggggcctggccctgcggctgtggcccaagctgcaggtggtggtgaccctggatgctgggggccaggccgaggccgtggccgccctgggcgccctgtggtgccagggcctggccttcttcagccctgcctatgctgccagcggaggagtgctgggcctgaacctgcagcctgagcagccccacggcctgtacctgctgcccccaggggcccccttcatcgagctgctgcctgtgaaggagggcacccaggaggaggccgccagcaccctgctgctggccgaggcccagcagggcaaggagtatgagctggtgctgacagaccgggccagcctgacccgctgccgcctgggagatgtggtgcgggtggtgggcgcctacaaccagtgccctgtggtgcgcttcatctgccgcctggaccagaccctgtctgtgagaggagaagatattggagaagatctcttcagcgaggccctgggccgggctgtgggccagtgggccggggccaagctgctggaccacggctgtgtggagagcagcatcctggagtggggccgcacagacagagctgaggacacccggctgggcagctgccccttcaccggctccatgtgtgcccacggcgtgtacagccagatccccctgcgggccctgctgcccaccacccgctgcctgtggaggtag

SEQ ID NO: 34538 - DNA, 1476 bp, Artificial Sequence
  Description of Artificial Sequence: Synthetic coding sequence
atgctgctgtggcccctgctgctgctgctgctgctgctgcccaccctggccctgctgcggcagcagaggagccaggatgcccggctgtcctggctggccggcctgcagcaccgggtggcctggggcgccctggtgtgggccgccacctggcagaggcggcggctggagcagagcaccctgcacgtgcaccagagccagcagcaggccctgcgctggtgcctgcagggcgcccagaggccccactgcagcctgcggcgcagcacagacatcagcaccttcaggaaccacctgcccctgaccaaggcctacccagaggtgctggcccagggccgcacagcccgggtgaccctgaccagcccctggccccggcccctgccctggccaggcaacaccctgggccaggtgggcaccccaggcaccaaggacccccgggccctgctgctggatgccctgcggagccctggcctgcgggccctggaggccggcacagctgtggagctgctggatgtgttcctgggcctggagacagatggagaggagctggccggggccatcgctgctggcaaccctggggcccccctgcgggagagagctgctgagctgcgggaggccctggagcagggcccccggggcctggccctgcggctgtggcccaagctgcaggtggtggtgaccctggatgctgggggccaggccgaggccgtggccgccctgggcgccctgtggtgccagggcctggccttcttctccccagcctatgctgccagcggcggcgtgctgggcctgaacctgcagcctgagcagccccacggcctgtacctgctgcccccaggggcccccttcatcgagctgctgcctgtgaaggagggcacccaggaggaggccgccagcaccctgctgctggccgaggcccagcagggcaaggagtatgagctggtgctgacagaccgggccagcctgacccgctgccgcctgggagatgtggtgcgggtggtgggcgcctacaaccagtgccctgtggtgcgcttcatctgccgcctggaccagaccctgtctgtgcggggggaggacatcggggaggacctcttcagcgaggccctgggccgggctgtgggccagtgggccggggccaagctgctggaccacggctgtgtggagagcagcatcctggacagcagcgctggcagcgccccccactatgaggtgtttgtggccctgcggggcctgaggaacctgtctgaagaaaatagagacaagctggaccactgcctgcaggaggccagcccccgctacaagagcctgcgcttctggggctctgtgggccctgcccgggtgcacctggtgggccagggcgccttccgggccctgcgggccgccctggccgcctgccccagcagccccttccccccagccatgccccgggtgctgcggcaccgccacctggcccagtgcctgcaggagcgggtggtgtcctag

SEQ ID NO: 34539 - DNA, 1425 bp, Artificial Sequence; identical to SEQ ID NO: 34537
  Description of Artificial Sequence: Synthetic coding sequence

SEQ ID NO: 34540 - DNA, 1593 bp, Artificial Sequence; identical to SEQ ID NO: 34535
  Description of Artificial Sequence: Synthetic coding sequence

SEQ ID NO: 34541 - DNA, 1002 bp, Artificial Sequence
  Description of Artificial Sequence: Synthetic coding sequence
atgcccctgggcctgggccgcaggaagaaggccccacccctggtggagaatgaggaggccgagcccggccggggcggcctgggcgtgggggagcccggccccctgggcggcggcggcagcggcggcccccagatgggcctgcccccacctcctccagccctgcggccccggctggtgttccacacccagctggcccacggcagccccaccggcagaattgagggcttcaccaacgtgaaggagctgtatggcaagattgctgaggccttccggctgcccacagctgaggtgatgttctgcaccctgaacacccacaaggtggacatggacaagctgctgggcggccagatcggcctggaggacttcatctttgcccacgtgaagggccagaggaaggaggtggaggtgttcaagtcagaagatgccctgggcctgaccatcacagacaacggggccggctacgccttcatcaagaggatcaaggagggcagcgtcatcgaccacatccacctgatctctgtgggggacatgattgaggccatcaatggccagagcctgctgggctgccgccactatgaggtggcccggctgctgaaggagctgccccggggccgcaccttcaccctgaagctgacagagcccaggaaggcctttgacatgatcagccagaggtctgctgggggccggcccggcagcggcccccagctgggcaccggccggggcaccctgcggctgcggagccggggccctgccaccgtggaggacctgcccagcgcctttgaggagaaggccatcgagaaggtggatgacctgctggagagctacatgggcatccgggacacagagctggccgccaccatggtggagctgggcaaggacaagagaaatccagatgagctggccgaggccctggatgagcggctgggggactttgccttcccagatgaatttgtgtttgatgtgtggggcgccatcggagatgccaaggtgggccgctactag

SEQ ID NO: 34542 - DNA, 1002 bp, Artificial Sequence; identical to SEQ ID NO: 34541
  Description of Artificial Sequence: Synthetic coding sequence

SEQ ID NO: 34543 - DNA, 711 bp, Artificial Sequence
  Description of Artificial Sequence: Synthetic coding sequence
atgttctgcaccctgaacacccacaaggtggacatggacaagctgctgggcggccagatcggcctggaggacttcatctttgcccacgtgaagggccagaggaaggaggtggaggtgttcaagtcagaagatgccctgggcctgaccatcacagacaatggagctggctacgccttcatcaagaggatcaaggagggctctgtgattgaccacatccacctgatctctgtgggggacatgattgaggccatcaatggccagagcctgctgggctgccgccactatgaggtggcccggctgctgaaggagctgccccggggccgcaccttcaccctgaagctgacagagcccaggaaggcctttgacatgatcagccagaggtctgctgggggccggcccggcagcggcccccagctgggcaccggccggggcaccctgcggctgcggagccggggccctgccaccgtggaggacctgcccagcgcctttgaggagaaggccatcgagaaggtggatgacctgctggagagctacatgggcatccgggacacagagctggccgccaccatggtggagctgggcaaggacaagaggaacccagatgagctggccgaggccctggatgagcggctgggggactttgccttcccagatgaatttgtgtttgatgtgtggggcgccatcggagatgccaaggtgggccgctactag

SEQ ID NO: 34544 - DNA, 711 bp, Artificial Sequence; identical to SEQ ID NO: 34543
  Description of Artificial Sequence: Synthetic coding sequence

SEQ ID NO: 34545 - DNA, 1002 bp, Artificial Sequence; identical to SEQ ID NO: 34541
  Description of Artificial Sequence: Synthetic coding sequence

SEQ ID NO: 34546 - DNA, 762 bp, Artificial Sequence
  Description of Artificial Sequence: Synthetic coding sequence
atggaggccgcccggccctttgcccgggagtggagggcccagagcctgcccctggccgtgggcggcgtgctgaagctgcggctgtgtgagctgtggctgctgctgctgggcagcagcctgaatgcccgcttcctgcctgatgaagaagatgtggacttcatcaatgaatatgtgaacctgcacaatgagctgcggggagatgtgatcccccggggcagcaacctgcgcttcatgacctgggatgtggccctgagcaggacagcccgggcctggggcaagaagtgcctcttcacccacaacatctacctgcaggatgtgcagatggtgcaccccaagttctacggcatcggggagaacatgtgggtgggcccagaaaatgagttcaccgccagcatcgccatccgctcctggcatgctgagaagaagatgtacaactttgaaaatggcagctgcagcggggactgcagcaactacatccagctggtgtgggaccacagctacaaggtgggctgtgctgtgaccccctgcagcaagattggccacatcatccatgctgccatcttcatctgcaactatgcccctgggggcaccctgacccggcggccctatgagcccggcatcttctgcacccgctgtggccggcgggacaagtgcacagacttcctgtgcagcaagatcaagaagatcaacatgaagaagatgcacaacggcctggacaagaagaacaagaggctgaacaccagcttcctgtggagctgctag

SEQ ID NO: 34547 - DNA, 321 bp, Artificial Sequence
  Description of Artificial Sequence: Synthetic coding sequence
atggaggccgcccggccctttgcccgggagtggagggcccagagcctgcccctggccgtgggcggcgtgctgaagctgcggctgtgtgagctgtggctgctgctgctgggcagcagcctgaatgcccgcttcctgcctgatgaagaagatgtggacttcatcaatgaatatgtgaacctgcacaatgagctgcggggagatgtgatcccccggggcagcaacctgcgcttcatgctgtggtactgctgtgacagtgatggcagccgcttcatcatcggcttccccaacctgagccccaggaccccatctgcccccctgtag

SEQ ID NO: 34548 - DNA, 714 bp, Artificial Sequence
  Description of Artificial Sequence: Synthetic coding sequence
atggtgcaccccaagttctatggaattggagagaacatgtgggtgggcccagaaaatgagttcaccgccagcatcgccatccgctcctggcacgccgagaagaagatgtacaactttgaaaatggcagctgcagcggggactgcagcaactacatccagctggtgtgggaccacagctacaaggtgggctgtgctgtgaccccctgcagcaagattggccacatcatccacgccgccatcttcatctgcaactatgcccctgggggcaccctgacccggcggccctatgagcccggcatcttctgcacccgctgtggcagaagagacaagtgcacagacttcctgtgcagcaatgctgaccgggaccaggccacctactaccgcttctggtaccccaagtgggagatgcccaggcctgtggtgtgtgaccccctgtgcaccttcatcctgctgctgcgcatcctgtgcttcatcctgtgtgtgatcaccgtgctgattgtgcagagccagttccccaacatcctgctggagcagcagatgatcttcaccccagaggagagcgaggccggaaatgaggaggaggagaaggaggaggagaagaaggagaaggaggagatggagatggagatcatggagatggaggaggagaaggaggagcgggaggaggaggaggaggagacccagaaggagaagatggaggaggaggagaagtag

SEQ ID NO: 34549 - DNA, 507 bp, Artificial Sequence
  Description of Artificial Sequence: Synthetic coding sequence
atggaggccgcccggccctttgcccgggagtggagggcccagagcctgcccctggccgtgggcggcgtgctgaagctgcggctgtgtgagctgtggctgctgctgctgggcagcagcctgaatgcccgcttcctgcctgatgaagaagatgtggacttcatcaatgaatatgtgaacctgcacaatgagctgcggggagatgtgatcccccggggcagcaacctgcgcttcatgacctgggatgtggccctgagcaggacagcccgggcctggggcaagaagtgcctcttcacccacaacatctacctgcaggatgtgcagatggtgcaccccaagttctacggcatcggggagaacatgtgggtgggcccagaaaatgagttcaccgccagcatcgccatccgctcctggcatgctgagaagaagatgtacaactttgaaaatggcagctgcagcggggactgcagcaactacatccagaggaacacagatgagaagaccctgtag

SEQ ID NO: 34550 - DNA, 840 bp, Artificial Sequence
  Description of Artificial Sequence: Synthetic coding sequence
atgctgatcaccatgatcctgcaccgggcccggaccaagacctgggatgtggccctgagcaggacagcccgggcctggggcaagaagtgcctcttcacccacaacatctacctgcaggatgtgcagatggtgcaccccaagttctatggaattggagagaacatgtgggtgggcccagaaaatgagttcaccgccagcatcgccatccgctcctggcacgccgagaagaagatgtacaactttgaaaatggcagctgcagcggggactgcagcaactacatccagctggtgtgggaccacagctacaaggtgggctgtgctgtgaccccctgcagcaagattggccacatcatccacgccgccatcttcatctgcaactatgcccctgggggcaccctgacccggcggccctatgagcccggcatcttctgcacccgctgtggcagaagagacaagtgcacagacttcctgtgcagcaatgctgaccgggaccaggccacctactaccgcttctggtaccccaagtgggagatgcccaggcctgtggtgtgtgaccccctgtgcaccttcatcctgctgctgcgcatcctgtgcttcatcctgtgtgtgatcaccgtgctgattgtgcagagccagttccccaacatcctgctggagcagcagatgatcttcaccccagaggagagcgaggccggaaatgaggaggaggagaaggaggaggagaagaaggagaaggaggagatggagatggagatcatggagatggaggaggagaaggaggagcgggaggaggaggaggaggagacccagaaggagaagatggaggaggaggagaagtag

SEQ ID NO: 34551 - DNA, 1035 bp, Artificial Sequence
  Description of Artificial Sequence: Synthetic coding sequence
atggaggccgcccggccctttgcccgggagtggagggcccagagcctgcccctggccgtgggcggcgtgctgaagctgcggctgtgtgagctgtggctgctgctgctgggcagcagcctgaatgcccgcttcctgcctgatgaagaagatgtggacttcatcaatgaatatgtgaacctgcacaatgagctgcggggagatgtgatcccccggggcagcaacctgcgcttcatgacctgggatgtggccctgagcaggacagcccgggcctggggcaagaagtgcctcttcacccacaacatctacctgcaggatgtgcagatggtgcaccccaagttctacggcatcggggagaacatgtgggtgggcccagaaaatgagttcaccgccagcatcgccatccgctcctggcatgctgagaagaagatgtacaactttgaaaatggcagctgcagcggggactgcagcaactacatccagctggtgtgggaccacagctacaaggtgggctgtgctgtgaccccctgcagcaagattggccacatcatccatgctgccatcttcatctgcaactatgcccctgggggcaccctgacccggcggccctatgagcccggcatcttctgcacccgctgtggccggcgggacaagtgcacagacttcctgtgcagcaatgctgaccgggaccaggccacctactaccgcttctggtaccccaagtgggagatgcccaggcctgtggtgtgtgaccccctgtgcaccttcatcctgctgctgcgcatcctgtgcttcatcctgtgtgtgatcaccgtgctgattgtgcagagccagttccccaacatcctgctggagcagcagatgatcttcaccccagaggagagcgaggccggaaatgaggaggaggagaaggaggaggagaagaaggagaaggaggagatggagatggagatcatggagatggaggaggagaaggaggagcgggaggaggaggaggaggagacccagaaggagaagatggaggaggaggagaagtag

SEQ ID NO: 34552 - DNA, 2544 bp, Artificial Sequence
  Description of Artificial Sequence: Synthetic coding sequence
atggccaagcccctgacagaccaggagaagaggcggcagatcagcatccggggcatcgtgggcgtggagaatgtggccgagctgaagaagagcttcaacagacacctgcacttcaccctggtgaaggacagaaatgtggccaccacccgggactactactttgccctggcccacacagtgcgggaccacctggtgggccgctggatccgcacccagcagcactactatgacaagtgccccaagagggtgtactacctgagcctggagttctacatgggccgcaccctgcagaacaccatgatcaacctgggcctgcagaatgcctgtgatgaggccatctaccagctgggcctggacatcgaggagctggaggagattgaggaggatgctggcctgggcaatggaggcctgggccgcctggccgcctgcttcctggacagcatggccaccctgggcctggccgcctacggctacggcatccgctatgaatatggcatcttcaaccagaagatcagagatggctggcaggtggaggaggctgatgactggctgcgctatggcaacccctgggagaagagcaggcctgagttcatgctgcctgtgcacttctacggcaaggtggagcacaccaacacaggcaccaagtggattgacacccaggtggtgctggccctgccctatgacacccctgtgcccggctacatgaacaacacagtgaacaccatgaggctgtggagcgcccgggccccaaatgacttcaacctgcgggacttcaacgtgggggactacatccaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaaggccagcaagtttggcagcaccagaggagctggcaccgtgtttgatgccttcccagaccaggtggccatccagctgaatgacacccacccagccctggccatccctgagctgatgaggatctttgtggacatcgagaagctgccctggagcaaggcctgggagctgacccagaagacctttgcctacaccaaccacacagtgctgcctgaggccctggagcgctggcctgtggacctggtggagaagctgctgcccaggcacctggagatcatctatgagatcaaccagaagcacctggacagaattgtggccctcttccccaaggatgtggaccggctgcggaggatgagcctcatcgaggaggagggcagcaagaggatcaacatggcccacctgtgcatcgtgggcagccatgctgtgaatggagtggccaagatccacagcgacatcgtgaagaccaaggtgttcaaggacttcagcgagctggagccagacaagttccagaacaagaccaacggcatcaccccccggcgctggctgctgctgtgcaaccctggcctggccgagctgattgctgagaagatcggggaggactatgtgaaggacctgagccagctgaccaagctgcacagcttcctgggagatgatgtgttcctgcgggagctggccaaggtgaagcaggagaacaagctgaagttcagccagttcctggagacagagtacaaggtgaagatcaaccccagctccatgtttgatgtgcaggtgaagaggatccacgagtacaagaggcagctgctgaactgcctgcacgtgatcaccatgtacaaccgcatcaagaaggaccccaagaagctgtttgtgcccaggacagtcatcatcggcggcaaggccgcccctggctaccacatggccaagatgatcatcaagctgatcacctctgtggctgatgtggtgaacaatgaccccatggtgggcagcaagctgaaggtgatcttcctggagaactacagagtgtccctggccgagaaggtgatcccagccacagacctgtctgagcagatcagcacagctggaacagaggccagcggcactggaaacatgaagttcatgctgaatggagccctgaccatcggcaccatggatggagccaacgtggagatggccgaggaggccggggaggagaacctcttcatcttcggcatgagaattgatgatgtggccgccctggacaagaagggctatgaggccaaggagtactatgaggccctgcctgagctgaagctggtgattgaccagattgacaatggcttcttcagccccaagcagcctgacctcttcaaggacatcatcaacatgctgttctaccatgaccgcttcaaggtgtttgctgactatgaggcctacgtgaagtgccaggacaaggtgtcccagctgtacatgaaccccaaggcctggaacaccatggtgctgaagaacattgctgccagcggcaagttcagcagtgacaggaccatcaaggagtatgcccagaacatctggaatgtggagcccagcgacctgaagatcagcctgagcaatgaaagcaacaaggtgaatggaaattag

SEQ ID NO: 34553 - DNA, 492 bp, Artificial Sequence
  Description of Artificial Sequence: Synthetic coding sequence
atgaagccagatgagacccccatgtttgaccccagcctgctgaaggaggtggactggagccagaacacagccaccttcagccctgccatcagccccacccaccctggagagggcctggtgctgcggcccctgtgcacagctgacctgaacagaggcttcttcaaggtgctgggccagctgacagaaacaggagtggtgtccccagagcagttcatgaagagctttgagcacatgaagaagagcggggactactacgtgacagtggtggaggatgtgaccctgggccagatcgtggccacagccaccctcatcatcgagcacaagttcatccacagctgtgccaagaggggccgggtggaggatgtggtggtgtctgatgaatgtcggggcaagcagctgggcaagctgctgctgagcaccctgaccctgctgagcaagaagctgaactgctacaagatcaccctggagtgcctgccccagaatgtgggctag

SEQ ID NO: 34554 - DNA, 1362 bp, Artificial Sequence
  Description of Artificial Sequence: Synthetic coding sequence
atgaagatcttcaagtgctacttcaagcacaccctgcagcagaaggtgttcatcctcttcctgaccctgtggctgctgagcctgctgaagctgctgaatgtgagaagactcttcccccagaaggacatctacctggtggagtacagcctgagcaccagcccctttgtgaggaaccgctacacccacgtgaaggatgaggtgcgctatgaggtgaactgcagcggcatctatgagcaggagcccctggagatcggcaagagcctggagatcagaagaagagacatcatcgacctggaggatgatgatgtggtggccatgaccagtgactgtgacatctaccagaccctgcggggctacgcccagaagctggtgtccaaggaggagaagagcttccccatcgcctacagcctggtggtgcacaaggatgccatcatggtggagcggctcatccacgccatctacaaccagcacaacatctactgcatccactatgacaggaaggccccagacaccttcaaggtggccatgaacaacctggccaagtgcttcagcaacatcttcatcgccagcaagctggaggccgtggagtatgcccacatcagccggctgcaggccgacctgaactgcctgagtgacctgctgaagagcagcatccagtggaagtatgtgatcaacctgtgtggccaggacttccccctgaagagcaactttgagctggtgtctgagctgaagaagctgaatggagccaacatgctggagaccgtgaagccacccaacagcaagctggagcgcttcacctaccaccacgagctgcggcgggtgccctatgaatatgtgaagctgcccatccgcaccaacatcagcaaggaggccccaccccacaacatccagatctttgtgggcagcgcctactttgtgctgagccaggcctttgtgaagtacatcttcaacaacagcatcgtgcaggacttctttgcctggagcaaggacacctacagcccagatgagcacttctgggccaccctcatccgggtgcccggcatccctggagagatcagccgcagcgcccaggatgtgtctgacctgcagagcaagacccggctggtgaagtggaactactatgagggcttcttctaccccagctgcaccggcagccacctgcggtctgtgtgcatctatggagctgctgagctgcgctggctgatcaaggatggccactggtttgccaacaagtttgacagcaaggtggaccccatcctgatcaagtgcctggccgagaagctggaggagcagcagagggactggatcaccctgcccagcgagaagctgttcatggacaggaacctgaccaccaccagctag

SEQ ID NO: 34555 - DNA, 927 bp, Artificial Sequence
  Description of Artificial Sequence: Synthetic coding sequence
atgtttgtgcagctgctgcgggccatctacgtgccccagaatgtgtactgcatccacgtggatgagaaggcccccatgaagtacaagacagctgtgcagaccctggtgaactgctttgaaaatgtgttcatcagcagcaagacagagaaggtggcctatgccggcttcacccggctgcaggccgacatcaactgcatgaaggtgctggtgcacagcaagttccagtggaactacgtgatcaacctgtgtggccaggacttccccatcaagaccaaccgggagatcatccactacatccgcagcaagtggagcgacaagaacatcaccccaggagtcatccagcccctgcacatcaagagcaagaccagccagagccacctggagtttgtgcccaagggcagcatctatgccccacccaacaaccgcttcaaggacaagccaccccacaacctgaccatctactttggaagtgcctactacgtgctgaccaggaagtttgtggagttcatcctgacagacatccacgccaaggacatgctgcagtggagcaaggacatccgcagccctgagcagcactactgggtgaccctgaaccggctgaaggatgcccctggggccaccccaaatgccggctgggagggcaatgtgcgggccatcaagaggaagtctgaggagggcaatgtgcatgatggctgcaagggccgctacgtggaggacatctgtgtgtatggccctggggacctgccctggctgatccagagccccagcctgtttgccaacaagtttgagcccagcacagaccccctggtggtgacctgcctggagcggcggcaccggctgcaggtgctgcggcaggccgaggtgcccatcgagccccactggcacttccagcagcagagccacttcaacatgaggctgaacagatag

SEQ ID NO: 34556 - DNA, 519 bp, Artificial Sequence
  Description of Artificial Sequence: Synthetic coding sequence
atgagggactgctgcggcatggtgagcagcggcagcctgagcagcctgaaggctgctgagaggacccctggggccctcttcttcagcagcagcaccccaggccgctactacaactatgacagcagcagccggccccagagccgctctgtgatgtctgaccagtgtgccggccagtggttcctgaaggcctgtggcctgggggagggggacacagaggtgttccccacccagcacgtggtgcgggccctgcagaccatctttgagctgaatgtgcaggcctttgctggaggagccatgggcgctgtgaatggcatgcagccccacggcgtgcctgacaagagctctgtgcagagtgatgaggtgtgggtgggcgtggtgtatggcctggccgccaccatgatccaggaggtgatgcacagcttcagccacctgagcaccatctgcatcctggcccagaagaccagcagcaccaccaagttcctgcagggcatcacccagtgccacctggtgcggctgtag

SEQ ID NO: 34557 - DNA, 2634 bp, Artificial Sequence
  Description of Artificial Sequence: Synthetic coding sequence
atgggcacccaggaccccggcaacatgggcactggagtgcctgccagcgagcagatcagctgtgccaaggaggacccccaggtgtactgcccagaggagaccggcggcaccaaggatgtgcaggtgacagactgcaagagccctgaggacagcaggcctcccaaggagacagactgctgcaacccagaagattctggccagctgatggtgtcctatgagggcaaggccatgggctaccaggtgccccccttcggctggaggatctgcctggcccacgagttcacagagaagaggaagcccttccaggccaacaacgtgtccctgagcaacatgatcaagcacatcggcatgggcctgcgctacctgcagtggtggtacaggaagacccacgtggagaagaagacccccttcatcgacatgatcaacagcgtgcccctgcggcagatctacggctgccccctgggcggcattggaggcggcaccatcacccggggctggaggggccagttctgccgctggcagctgaaccctggcatgtaccagcacaggacagtgattgctgaccagttcaccgtgtgcctgcggcgggagggccagacagtgtaccagcaggtgctgagcctggagcggcccagcgtgctgcgctcctggaactggggcctgtgtggctactttgccttctaccacgccctgtacccccgggcctggacagtgtaccagctgcccggccagaatgtgaccctgacctgccggcagatcacccccatcctgccccatgactaccaggacagcagcctgcctgtgggcgtgtttgtgtgggatgtggagaatgaaggagatgaggccctggatgtgtccatcatgttctccatgagaaatggcctgggcggcggagatgatgcccctgggggcctgtggaatgagcccttctgcctggagaggtctggagagaccgtgcggggcctgctgctgcaccaccccaccctgcccaacccctacaccatggctgtggccgcccgggtgacagctgccaccaccgtgacccacatcacagcctttgatcctgacagcacaggccagcaggtgtggcaggacctgctgcaggacggccagctggacagccccaccggccagagcacccccacccagaagggcgtgggcattgctggagctgtgtgtgtgagcagcaagctgcggccccggggccagtgccgcctggagttcagcctggcctgggacatgccccgcatcatgtttggagccaagggccaggtgcactaccgccgctacacccgcttcttcggccaggatggagatgctgccccagccctgagccactacgccctgtgccgctatgcagagtgggaggagcgcatcagcgcctggcagagccctgtgctggatgacaggagcctgcctgcctggtacaagagcgccctcttcaatgagctgtacttcctggctgatggcggcaccgtgtggctggaggtgctggaggacagcctgcctgaggagctgggcaggaacatgtgccacctgcggcccaccctgcgggactatggccgcttcggctacctggagggccaggagtacaggatgtacaacacctatgatgtgcacttctacgccagctttgccctgatcatgctgtggcccaagctggagctgagcctgcagtatgacatggccctggccaccctgcgggaggacctgacccggcggcgctacctgatgtctggagtgatggcccctgtgaagagaagaaatgtcatcccccatgacattggagaccctgatgatgagccctggctgcgggtgaatgcctacctgattcatgacacagctgactggaaggacctgaacctgaagtttgtgctgcaggtgtacagagactactacctgactggagaccagaacttcctgaaggacatgtggcctgtgtgcctggccgtgatggagagcgagatgaagtttgacaaggaccatgatggcctgattgaaaatggaggctacgccgaccagacctatgatggctgggtgaccaccggccccagcgcctactgcggcggcctgtggctggccgctgtggccgtgatggtgcagatggccgccctgtgtggggcccaggacatccaggacaagttcagcagcatcctgagccggggccaggaggcctatgaaaggctgctgtggaatggccgctactacaactatgacagcagcagccggccccagagccgctctgtgatgtctgaccagtgtgccggccagtggttcctgaaggcctgtggcctgggggagggggacacagaggtgttccccacccagcacgtggtgcgggccctgcagaccatctttgagctgaatgtgcaggcctttgctgggggcgccatgggcgctgtgaatggcatgcagccccatggagtgcctgacaagagctctgtgcagagtgatgaggtgtgggtgggcgtggtgtatggcctggccgccaccatgatccaggagctgctgcccagcggcttctgcctgtgggtgattgtcatcagcagcacctgctgggagctgctggagggcaaggacagcacagccagcatctaccctgtggaggtggccctgcagagggtgcccagctag

SEQ ID NO: 34558 - DNA, 2784 bp, Artificial Sequence
  Description of Artificial Sequence: Synthetic coding sequence
atgggcacccaggaccccggcaacatgggcactggagtgcctgccagcgagcagatcagctgtgccaaggaggacccccaggtgtactgcccagaggagaccggcggcaccaaggatgtgcaggtgacagactgcaagagccctgaggacagcaggcctcccaaggagacagactgctgcaacccagaagattctggccagctgatggtgtcctatgagggcaaggccatgggctaccaggtgccccccttcggctggaggatctgcctggcccacgagttcacagagaagaggaagcccttccaggccaacaacgtgtccctgagcaacatgatcaagcacatcggcatgggcctgcgctacctgcagtggtggtacaggaagacccacgtggagaagaagacccccttcatcgacatgatcaacagcgtgcccctgcggcagatctacggctgccccctgggcggcattggaggcggcaccatcacccggggctggaggggccagttctgccgctggcagctgaaccctggcatgtaccagcacaggacagtgattgctgaccagttcaccgtgtgcctgcggcgggagggccagacagtgtaccagcaggtgctgagcctggagcggcccagcgtgctgcgctcctggaactggggcctgtgtggctactttgccttctaccacgccctgtacccccgggcctggacagtgtaccagctgcccggccagaatgtgaccctgacctgccggcagatcacccccatcctgccccatgactaccaggacagcagcctgcctgtgggcgtgtttgtgtgggatgtggagaatgaaggagatgaggccctggatgtgtccatcatgttctccatgagaaatggcctgggcggcggagatgatgcccctgggggcctgtggaatgagcccttctgcctggagaggtctggagagaccgtgcggggcctgctgctgcaccaccccaccctgcccaacccctacaccatggctgtggccgcccgggtgacagctgccaccaccgtgacccacatcacagcctttgatcctgacagcacaggccagcaggtgtggcaggacctgctgcaggacggccagctggacagccccaccggccagagcacccccacccagaagggcgtgggcattgctggagctgtgtgtgtgagcagcaagctgcggccccggggccagtgccgcctggagttcagcctggcctgggacatgccccgcatcatgtttggagccaagggccaggtgcactaccgccgctacacccgcttcttcggccaggatggagatgctgccccagccctgagccactacgccctgtgccgctatgcagagtgggaggagcgcatcagcgcctggcagagccctgtgctggatgacaggagcctgcctgcctggtacaagagcgccctcttcaatgagctgtacttcctggctgatggcggcaccgtgtggctggaggtgctggaggacagcctgcctgaggagctgggcaggaacatgtgccacctgcggcccaccctgcgggactatggccgcttcggctacctggagggccaggagtacaggatgtacaacacctatgatgtgcacttctacgccagctttgccctgatcatgctgtggcccaagctggagctgagcctgcagtatgacatggccctggccaccctgcgggaggacctgacccggcggcgctacctgatgtctggagtgatggcccctgtgaagagaagaaatgtcatcccccatgacattggagaccctgatgatgagccctggctgcgggtgaatgcctacctgattcatgacacagctgactggaaggacctgaacctgaagtttgtgctgcaggtgtacagagactactacctgactggagaccagaacttcctgaaggacatgtggcctgtgtgcctggccgtgatggagagcgagatgaagtttgacaaggaccatgatggcctgattgaaaatggaggctacgccgaccagacctatgatggctgggtgaccaccggccccagcgcctactgcggcggcctgtggctggccgctgtggccgtgatggtgcagatggccgccctgtgtggggcccaggacatccaggacaagttcagcagcatcctgagccggggccaggaggcctatgaaaggctgctgtggaatggccgctactacaactatgacagcagcagccggccccagagccgctctgtgatgtctgaccagtgtgccggccagtggttcctgaaggcctgtggcctgggggagggggacacagaggtgttccccacccagcacgtggtgcgggccctgcagaccatctttgagctgaatgtgcaggcctttgctgggggcgccatgggcgctgtgaatggcatgcagccccatggagtgcctgacaagagctctgtgcagagtgatgaggtgtgggtgggcgtggtgtatggcctggccgccaccatgatccaggagggcctgacctgggagggcttccagacagctgagggctgctacagaacagtgtgggagcggctgggcctggccttccagaccccagaggcctactgccagcagagggtcttccgcagcctggcctacatgaggcccctgagcatctgggccatgcagctggccctgcagcagcagcagcacaagaaggcctcctggcccaaggtgaagcagggcaccggcctgaggacaggccccatgtttggccccaaggaggccatggccaacctgagccctgagtag

SEQ ID NO: 34559 - DNA, 2802 bp, Artificial Sequence
  Description of Artificial Sequence: Synthetic coding sequence
atgggcacccaggaccccggcaacatgggcactggagtgcctgccagcgagcagatcagctgtgccaaggaggacccccaggtgtactgcccagaggagaccggcggcaccaaggatgtgcaggtgacagactgcaagagccctgaggacagcaggcctcccaaggagacagactgctgcaacccagaagattctggccagctgatggtgtcctatgagggcaaggccatgggctaccaggtgccccccttcggctggaggatctgcctggcccacgagttcacagagaagaggaagcccttccaggccaacaacgtgtccctgagcaacatgatcaagcacatcggcatgggcctgcgctacctgcagtggtggtacaggaagacccacgtggagaagaagacccccttcatcgacatgatcaacagcgtgcccctgcggcagatctacggctgccccctgggcggcattggaggcggcaccatcacccggggctggaggggccagttctgccgctggcagctgaaccctggcatgtaccagcacaggacagtgattgctgaccagcccatctgccccctgaagttcaccgtgtgcctgcggcgggagggccagacagtgtaccagcaggtgctgagcctggagcggcccagcgtgctgcgctcctggaactggggcctgtgtggctactttgccttctaccacgccctgtacccccgggcctggacagtgtaccagctgcccggccagaatgtgaccctgacctgccggcagatcacccccatcctgccccatgactaccaggacagcagcctgcctgtgggcgtgtttgtgtgggatgtggagaatgaaggagatgaggccctggatgtgtccatcatgttctccatgagaaatggcctgggcggcggagatgatgcccctgggggcctgtggaatgagcccttctgcctggagaggtctggagagaccgtgcggggcctgctgctgcaccaccccaccctgcccaacccctacaccatggctgtggccgcccgggtgacagctgccaccaccgtgacccacatcacagcctttgatcctgacagcacaggccagcaggtgtggcaggacctgctgcaggacggccagctggacagccccaccggccagagcacccccacccagaagggcgtgggcattgctggagctgtgtgtgtgagcagcaagctgcggccccggggccagtgccgcctggagttcagcctggcctgggacatgccccgcatcatgtttggagccaagggccaggtgcactaccgccgctacacccgcttcttcggccaggatggagatgctgccccagccctgagccactacgccctgtgccgctatgcagagtgggaggagcgcatcagcgcctggcagagccctgtgctggatgacaggagcctgcctgcctggtacaagagcgccctcttcaatgagctgtacttcctggctgatggcggcaccgtgtggctggaggtgctggaggacagcctgcctgaggagctgggcaggaacatgtgccacctgcggcccaccctgcgggactatggccgcttcggctacctggagggccaggagtacaggatgtacaacacctatgatgtgcacttctacgccagctttgccctgatcatgctgtggcccaagctggagctgagcctgcagtatgacatggccctggccaccctgcgggaggacctgacccggcggcgctacctgatgtctggagtgatggcccctgtgaagagaagaaatgtcatcccccatgacattggagaccctgatgatgagccctggctgcgggtgaatgcctacctgattcatgacacagctgactggaaggacctgaacctgaagtttgtgctgcaggtgtacagagactactacctgactggagaccagaacttcctgaaggacatgtggcctgtgtgcctggccgtgatggagagcgagatgaagtttgacaaggaccatgatggcctgattgaaaatggaggctacgccgaccagacctatgatggctgggtgaccaccggccccagcgcctactgcggcggcctgtggctggccgctgtggccgtgatggtgcagatggccgccctgtgtggggcccaggacatccaggacaagttcagcagcatcctgagccggggccaggaggcctatgaaaggctgctgtggaatggccgctactacaactatgacagcagcagccggccccagagccgctctgtgatgtctgaccagtgtgccggccagtggttcctgaaggcctgtggcctgggggagggggacacagaggtgttccccacccagcacgtggtgcgggccctgcagaccatctttgagctgaatgtgcaggcctttgctgggggcgccatgggcgctgtgaatggcatgcagccccatggagtgcctgacaagagctctgtgcagagtgatgaggtgtgggtgggcgtggtgtatggcctggccgccaccatgatccaggagggcctgacctgggagggcttccagacagctgagggctgctacagaacagtgtgggagcggctgggcctggccttccagaccccagaggcctactgccagcagagggtcttccgcagcctggcctacatgaggcccctgagcatctgggccatgcagctggccctgcagcagcagcagcacaagaaggcctcctggcccaaggtgaagcagggcaccggcctgaggacaggccccatgtttggccccaaggaggccatggccaacctgagccctgagtag

SEQ ID NO: 34560 - DNA, 3636 bp, Artificial Sequence
  Description of Artificial Sequence: Synthetic coding sequence
atggccaccacagccaccccagccaccaaccagggctggccagaagattttggcttccggctgggcggcagcggcccctgctttgtgctggaggtggccaagggcagcagcgcccacgccggcggcctgcggcctggggaccagatcctggaggtggagggcctggccgtgggcggcctgagccgggagcggctggtgcggctggcccggcgctgcccccgggtgccccccagcctgggcgtgctgcctgccccagatggcggccctggccctggcagcggccctgctgcccccaccaccgtgctgcgggccccccgctgtggccggggcctggccctgggccgggagctgctgcggctggccggcaggaagaggccagatgctgtgcaccgggagaggaggaggaaggcccaggagttcagcaggaaggtggatgagatcctgggggaccagcccacagccaaggagcaggtgtttgctgccctgaagcagtttgctgctgagcagagggtggatgacctggtgtggaccctgaccctggccctgccccgggaggcctgtggccccctgctggacaacctgcgcatcttcatccccaagaagcaccgggccaggtttgatgaggtggtgtcccagggcctgctgggcaagctgtgccgggcccggcgggcccagggcgcccagaggctgcggcgcagccgctctgaggagaggcctgagcggctgctggtgtccacccgggccagcgcccccccaagaagaccagatgagcccccaccaagaagagccagcctgctggtgggcggcctggccggccctggaggagccaggagaacagtgcgggtgtacaagggcaacaagagctttggcttcaccctgcggggccacggccctgtgtggattgaatctgtgctgcccggcagccctgctgacaatgctgccctgaagagcggggaccgcatcctcttcctgaatggcctggacatgaggaactgcagccatgacaaggtggtgtccatgctgcagggcagcggggccatgcccaccctggtggtggaggagggcctggtgccctttgccagtgacagcgacagcctggacagccccaaccccagcagcgccctgaccagcctgcagtgggtggccgagatcctgcccagcagcatccgggtgcagggccgcaccttcagccagcagctggagcacctgctgaccccacctgagagatatggagtgtgccgggccctggagagcttcttccagcacagaaatattgacaccctgattgtggatgtgtaccctgtgctggacaccccagccaagcaggtgctgtggcagttcatctaccagctgctgacctatgaggagcaggagctgtgccaggagaagatcgcctgcttcctgggctacacagccatgacagctgagcctgagcctgagctggacctggagagcgagcccaccccagagccccagcccaggagcagcctgcgggccagctccatgtgccgccgcagcctgcggagccagggcctggaggccggcctgagctgtggccccagcgagtgcccagagatgcccctgcccctcatccctggagagcggcaggccggagatggcaccagcctgcctgagacccccaaccccaagatgatgtctgctgtgtatgcagagctggagagccggctgaacagcagcttcaagggcaagatgggcaccgtgtccaagagccgggccagccccccaggccccagccctgctgtgaccaccggccccaggaccctgagcggcgtgtcctggcccagcgagcggctgctgcccagcccctgctaccaccccctgtgcagcggcggcctggccagccccagcagcagcgagagccacccctatgccagcctggacagcagccgggcccccagcccccagcccggccctggccccatctgcccagacagcccccccagcccagaccccaccaggcctcccagcaggaggaagctgttcaccttcagccaccctgtgcgcagccgggacacagaccgcttcctggatgtgctgtctgagcagctgggcccccgggtgaccatcgtggatgacttcctgaccccagaaaatgactatgaggagatgtccttccatgatgaccagggcagctttgtgaccaatgaaagaagcagcgccagtgactgcatcagcagcagcgaggagggcagcagcctgacctacagcagcatcagtgaccacatccccccaccacccctgagccccccacctcctccacccctgcccttccatgatgccaagcccagcagccgcagcagtgatggcagccggggccctgcccaggccctggccaagcccctgacccagctgagccaccctgtgcccccacctcctcctccacccctgcccccacctgtgccctgtgccccacccatgctgagccggggcctgggccacagaagaagtgagaccagccacatgtctgtgaagaggctgcgctgggagcaggtggagaacagcgagggcaccatctggggccagctgggagaagattctgactatgacaagctgagtgacatggtgaagtacctggacctggagctgcacttcggcacccagaagccagccaagcctgtgcccggccctgagcccttcaggaagaaggaggtggtggagatcctgagccacaagaaggcctacaacaccagcatcctgctggcccacctgaagctgagccctgctgagctgcggcaggtgctgatgtccatggagccccggcggctggagcccgcccacctggcccagctgctgctgtttgccccagatgctgatgaggagcagcgctaccaggccttccgggaggcccctggccgcctgtctgagccagaccagtttgtgctgcagatgctgtctgtgcctgagtacaagacccggctgcggagcctgcacttccaggccaccctgcaggagaagacagaggagatccggggcagcctggagtgcctgcggcaggccagcctggagctgaagaacagcaggaagctggccaagatcctggagtttgtgctggccatgggcaactacctgaatgatggccagcccaagaccaacaagaccaccggcttcaagatcaacttcctgacagagctgaacagcaccaagacagtggatggcaagagcaccttcctgcacatcctggccaagagcctgagccagcacttccctgagctgctgggctttgcccaggacctgcccaccgtgcccctggccgccaaggtgaaccagagggccctgaccagtgacctggccgacctgcacggcaccatcagcgagatccaggatgcctgccagagcatcagccccagcagcgaggacaagtttgccatggtgatgagcagcttcctggagacagcccagcctgccctgcgggccctggatggcctgcagcgggaggccatggaggagctgggcaaggccctggccttcttcggggaggacagcaaggccaccaccagcgaggccttcttcggcatctttgctgagttcatgagcaagtttgagcgggccctgagtgacctgcaggccggggagggcctgcggagcagcggcatggtgagccccctggcctggtag

SEQ ID NO: 34561 - DNA, 1197 bp, Artificial Sequence
  Description of Artificial Sequence: Synthetic coding sequence
atgcacacagtggccaccagcggccccaatgcctcctggggcgccccagccaatgccagcggctgccccggctgtggggccaatgccagtgatggccctgtgcccagccccagggctgtggatgcctggctggtgcccctcttctttgctgccctgatgctgctgggcctggtgggcaacagcctggtgatctacgtgatctgccgccacaagcccatgaggacagtgaccaacttctacatcgccaacctggccgccacagatgtgaccttcctgctgtgctgcgtgcccttcaccgccctgctgtaccccctgcccggctgggtgctgggggacttcatgtgcaagtttgtgaactacatccagcaggtgtctgtgcaggccacctgtgccaccctgacagccatgtctgtggaccgctggtacgtgaccgtcttccccctgcgggccctgcacaggaggaccccccggctggccctggccgtgtccctgagcatctgggtgggcagcgctgctgtgtctgcccctgtgctggccctgcaccggctgagccctggcccccgggcctactgcagcgaggccttccccagccgggccctggagcgggcctttgccctgtacaacctgctggccctgtacctgctgcccctgctggccacctgtgcctgctatgctgccatgctgcggcacctgggccgggtggccgtgcggcctgccccagctgacagcgccctgcagggccaggtgctggccgagcgggccggggctgtgcgggccaaggtgtcccggctggtggccgctgtggtgctgctgtttgctgcctgctggggccccatccagctgttcctggtgctgcaggccctgggccctgctggctcctggcaccccaggagctatgctgcctatgccctgaagacctgggcccactgcatgagctacagcaacagcgccctgaaccccctgctgtatgccttcctgggcagccacttccggcaggccttcagaagagtgtgcccctgtgccccccggcggccccggcggcccaggaggcctggccccagcgaccctgctgcccctcatgctgagctgctgcggctgggcagccacccagccccagcccgggcccagaagccaggcagcagcggcctggccgcccggggcctgtgtgtgctgggagaagataatgcccccctgtag

SEQ ID NO: 34562 - DNA, 3543 bp, Artificial Sequence
  Description of Artificial Sequence: Synthetic coding sequence
atggtgctgctgctgatcctgtctgtgctgctgctgaaggaggatgtgcggggcagcgcccagagcagcgagaggagagtggtggcccacatgcctggggacatcatcattggagccctcttctctgtgcaccaccagcccaccgtggacaaggtgcatgagaggaaatgtggggctgtgcgggagcagtatggcatccagagggtggaggccatgctgcacaccctggagcgcatcaacagcgaccccaccctgctgcccaacatcaccctgggctgtgagatccgggacagctgctggcacagcgctgtggccctggagcagagcattgagttcatccgggacagcctcatcagcagcgaggaggaggagggcctggtgcgctgtgtggatggcagcagcagcagcttccgcagcaagaagcccatcgtgggcgtgattggccctggcagcagctctgtggccatccaggtgcagaacctgctgcagctgttcaacatcccccagatcgcctacagcgccacctccatggacctgagtgacaagaccctcttcaagtacttcatgagggtggtgcccagtgatgcccagcaggcccgggccatggtggacatcgtgaagcgctacaactggacctacgtgtctgctgtgcacacagagggcaactatggagagagcggcatggaggccttcaaggacatgtctgccaaggagggcatctgcatcgcccacagctacaagatctacagcaatgctggggagcagagctttgacaagctgctgaagaagctgaccagccacctgcccaaggcccgggtggtggcctgcttctgtgagggcatgacagtgcggggcctgctgatggccatgaggcggctgggcctggccggggagttcctgctgctgggcagtgatggctgggccgacagatatgatgtgacagatggctaccagcgggaggccgtgggcggcatcaccatcaagctgcagagcccagatgtgaagtggtttgatgactactacctgaagctgcggcctgagaccaaccacaggaacccctggttccaggagttctggcagcaccgcttccagtgccgcctggagggcttcccccaggagaacagcaagtacaacaagacctgcaacagcagcctgaccctgaagacccaccacgtgcaggacagcaagatgggctttgtgatcaatgccatctacagcatggcctacggcctgcacaacatgcagatgagcctgtgccccggctacgccggcctgtgtgatgccatgaagcccattgatggcaggaagctgctggagagcctgatgaagaccaacttcaccggggtgtctggggacaccatcctgtttgatgaaaatggagacagccctggccgctatgagatcatgaacttcaaggagatgggcaaggactactttgactacatcaacgtgggctcctgggacaatggagagctgaagatggatgatgatgaggtgtggagcaagaagagcaacatcatccgctctgtgtgcagcgagccctgtgagaagggccagatcaaggtgatcagaaaaggagaggtgtcctgctgctggacctgcaccccctgcaaggaaaatgaatatgtgtttgatgagtacacctgcaaggcctgccagctgggctcctggcccacagatgacctgaccggctgtgacctgatccctgtgcagtacctgcgctggggagaccctgagcccatcgctgctgtggtgtttgcctgcctgggcctgctggccaccctgtttgtgacagtggtgttcatcatctacagagacacccctgtggtgaagagcagcagccgggagctgtgctacatcatcctggccggcatctgcctgggctacctgtgcaccttctgcctgattgccaagcccaagcagatctactgctacctgcagagaattggaattggcctgagccctgccatgagctacagcgccctggtgaccaagaccaacagaattgcccgcatcctggccggcagcaagaagaagatctgcaccaagaagccccgcttcatgtctgcctgtgcccagctggtgattgccttcatcctgatctgcatccagctgggcatcatcgtggccctcttcatcatggagcccccagacatcatgcatgactaccccagcatccgggaggtgtacctgatctgcaacaccaccaacctgggcgtggtgacccccctgggctacaacggcctgctgatcctgagctgcaccttctacgccttcaagaccagaaatgtgcctgccaacttcaatgaggccaagtacatcgccttcaccatgtacaccacctgcatcatctggctggcctttgtgcccatctacttcggcagcaactacaagatcatcaccatgtgcttctctgtgtccctgagcgccaccgtggccctgggctgcatgtttgtgcccaaggtgtacatcatcctggccaagccagagagaaatgtgcgcagcgccttcaccaccagcacagtggtgaggatgcacgtgggagatggcaagagcagcagcgctgccagccgcagcagcagcctggtgaacctgtggaagaggcggggcagcagcggggagaccctgagcagcaatggcaagtctgtgacctgggcccagaatgagaagagcagccggggccagcacctgtggcagaggctgagcatccacatcaacaagaaggagaaccccaaccagacagctgtgatcaagcccttccccaagagcacagagagccggggcctgggcgctggggccggggccggcggcagcgctggaggagtgggcgccactggaggagctggctgtgccggggccggccctgggggccctgagagcccagatgctggccccaaggccctgtatgatgtggccgaggccgaggagcacttccctgccccagcccggcccaggagccccagccccatcagcaccctgagccacagagctggcagcgccagcaggacagatgatgatgtgcccagcctgcacagcgagcctgtggcccggagcagcagcagccagggcagcctgatggagcagatcagctctgtggtgacccgcttcaccgccaacatcagcgagctgaacagcatgatgctgagcacagctgcccccagccctggggtgggcgcccccctgtgcagcagctacctgatccccaaggagatccagctgcccaccaccatgaccacctttgctgagatccagcccctgcctgccatcgaggtgactggaggagcccagcctgctgctggggcccaggccgctggagatgctgcccgggagagccctgctgctggccctgaggccgccgccgccaagccagacctggaggagctggtggccctgaccccacccagccccttccgggacagcgtggacagcggcagcaccacccccaacagccctgtgtctgagagcgccctgtgcatccccagcagccccaagtatgacaccctcatcatccgggactacacccagagcagcagcagcctgtag

SEQ ID NO: 34563 - DNA, 3639 bp, Artificial Sequence
  Description of Artificial Sequence: Synthetic coding sequence
atggtgctgctgctgatcctgtctgtgctgctgctgaaggaggatgtgcggggcagcgcccagagcagcgagaggagagtggtggcccacatgcctggggacatcatcattggagccctcttctctgtgcaccaccagcccaccgtggacaaggtgcatgagaggaaatgtggggctgtgcgggagcagtatggcatccagagggtggaggccatgctgcacaccctggagcgcatcaacagcgaccccaccctgctgcccaacatcaccctgggctgtgagatccgggacagctgctggcacagcgctgtggccctggagcagagcattgagttcatccgggacagcctcatcagcagcgaggaggaggagggcctggtgcgctgtgtggatggcagcagcagcagcttccgcagcaagaagcccatcgtgggcgtgattggccctggcagcagctctgtggccatccaggtgcagaacctgctgcagctgttcaacatcccccagatcgcctacagcgccacctccatggacctgagtgacaagaccctcttcaagtacttcatgagggtggtgcccagtgatgcccagcaggcccgggccatggtggacatcgtgaagcgctacaactggacctacgtgtctgctgtgcacacagagggcaactatggagagagcggcatggaggccttcaaggacatgtctgccaaggagggcatctgcatcgcccacagctacaagatctacagcaatgctggggagcagagctttgacaagctgctgaagaagctgaccagccacctgcccaaggcccgggtggtggcctgcttctgtgagggcatgacagtgcggggcctgctgatggccatgaggcggctgggcctggccggggagttcctgctgctgggcagtgatggctgggccgacagatatgatgtgacagatggctaccagcgggaggccgtgggcggcatcaccatcaagctgcagagcccagatgtgaagtggtttgatgactactacctgaagctgcggcctgagaccaaccacaggaacccctggttccaggagttctggcagcaccgcttccagtgccgcctggagggcttcccccaggagaacagcaagtacaacaagacctgcaacagcagcctgaccctgaagacccaccacgtgcaggacagcaagatgggctttgtgatcaatgccatctacagcatggcctacggcctgcacaacatgcagatgagcctgtgccccggctacgccggcctgtgtgatgccatgaagcccattgatggcaggaagctgctggagagcctgatgaagaccaacttcaccggggtgtctggggacaccatcctgtttgatgaaaatggagacagccctggccgctatgagatcatgaacttcaaggagatgggcaaggactactttgactacatcaacgtgggctcctgggacaatggagagctgaagatggatgatgatgaggtgtggagcaagaagagcaacatcatccgctctgtgtgcagcgagccctgtgagaagggccagatcaaggtgatcagaaaaggagaggtgtcctgctgctggacctgcaccccctgcaaggaaaatgaatatgtgtttgatgagtacacctgcaaggcctgccagctgggctcctggcccacagatgacctgaccggctgtgacctgatccctgtgcagtacctgcgctggggagaccctgagcccatcgctgctgtggtgtttgcctgcctgggcctgctggccaccctgtttgtgacagtggtgttcatcatctacagagacacccctgtggtgaagagcagcagccgggagctgtgctacatcatcctggccggcatctgcctgggctacctgtgcaccttctgcctgattgccaagcccaagcagatctactgctacctgcagagaattggaattggcctgagccctgccatgagctacagcgccctggtgaccaagaccaacagaattgcccgcatcctggccggcagcaagaagaagatctgcaccaagaagccccgcttcatgtctgcctgtgcccagctggtgattgccttcatcctgatctgcatccagctgggcatcatcgtggccctcttcatcatggagcccccagacatcatgcatgactaccccagcatccgggaggtgtacctgatctgcaacaccaccaacctgggcgtggtgacccccctgggctacaacggcctgctgatcctgagctgcaccttctacgccttcaagaccagaaatgtgcctgccaacttcaatgaggccaagtacatcgccttcaccatgtacaccacctgcatcatctggctggcctttgtgcccatctacttcggcagcaactacaagatcatcaccatgtgcttctctgtgtccctgagcgccaccgtggccctgggctgcatgtttgtgcccaaggtgtacatcatcctggccaagccagagagaaatgtgcgcagcgccttcaccaccagcacagtggtgaggatgcacgtgggagatggcaagagcagcagcgctgccagccgcagcagcagcctggtgaacctgtggaagaggcggggcagcagcggggagaccctgcgctacaaggaccggcggctggcccagcacaagtcagaaattgagtgcttcacccccaagggctccatgggaaatggaggccgggccaccatgagcagcagcaatggcaagtctgtgacctgggcccagaatgagaagagcagccggggccagcacctgtggcagaggctgagcatccacatcaacaagaaggagaaccccaaccagacagctgtgatcaagcccttccccaagagcacagagagccggggcctgggcgctggggccggggccggcggcagcgctggaggagtgggcgccactggaggagctggctgtgccggggccggccctgggggccctgagagcccagatgctggccccaaggccctgtatgatgtggccgaggccgaggagcacttccctgccccagcccggcccaggagccccagccccatcagcaccctgagccacagagctggcagcgccagcaggacagatgatgatgtgcccagcctgcacagcgagcctgtggcccggagcagcagcagccagggcagcctgatggagcagatcagctctgtggtgacccgcttcaccgccaacatcagcgagctgaacagcatgatgctgagcacagctgcccccagccctggggtgggcgcccccctgtgcagcagctacctgatccccaaggagatccagctgcccaccaccatgaccacctttgctgagatccagcccctgcctgccatcgaggtgactggaggagcccagcctgctgctggggcccaggccgctggagatgctgcccgggagagccctgctgctggccctgaggccgccgccgccaagccagacctggaggagctggtggccctgaccccacccagccccttccgggacagcgtggacagcggcagcaccacccccaacagccctgtgtctgagagcgccctgtgcatccccagcagccccaagtatgacaccctcatcatccgggactacacccagagcagcagcagcctgtag

SEQ ID NO: 34564 - DNA, 2829 bp, Artificial Sequence
  Description of Artificial Sequence: Synthetic coding sequence
atggtgctgctgctgatcctgtctgtgctgctgctgaaggaggatgtgcggggcagcgcccagagcagcgagaggagagtggtggcccacatgcctggggacatcatcattggagccctcttctctgtgcaccaccagcccaccgtggacaaggtgcatgagaggaaatgtggggctgtgcgggagcagtatggcatccagagggtggaggccatgctgcacaccctggagcgcatcaacagcgaccccaccctgctgcccaacatcaccctgggctgtgagatccgggacagctgctggcacagcgctgtggccctggagcagagcattgagttcatccgggacagcctcatcagcagcgaggaggaggagggcctggtgcgctgtgtggatggcagcagcagcagcttccgcagcaagaagcccatcgtgggcgtgattggccctggcagcagctctgtggccatccaggtgcagaacctgctgcagctgttcaacatcccccagatcgcctacagcgccacctccatggacctgagtgacaagaccctcttcaagtacttcatgagggtggtgcccagtgatgcccagcaggcccgggccatggtggacatcgtgaagcgctacaactggacctacgtgtctgctgtgcacacagagggcaactatggagagagcggcatggaggccttcaaggacatgtctgccaaggagggcatctgcatcgcccacagctacaagatctacagcaatgctggggagcagagctttgacaagctgctgaagaagctgaccagccacctgcccaaggcccgggtggtggcctgcttctgtgagggcatgacagtgcggggcctgctgatggccatgaggcggctgggcctggccggggagttcctgctgctgggcagtgatggctgggccgacagatatgatgtgacagatggctaccagcgggaggccgtgggcggcatcaccatcaagctgcagagcccagatgtgaagtggtttgatgactactacctgaagctgcggcctgagaccaaccacaggaacccctggttccaggagttctggcagcaccgcttccagtgccgcctggagggcttcccccaggagaacagcaagtacaacaagacctgcaacagcagcctgaccctgaagacccaccacgtgcaggacagcaagatgggctttgtgatcaatgccatctacagcatggcctacggcctgcacaacatgcagatgagcctgtgccccggctacgccggcctgtgtgatgccatgaagcccattgatggcaggaagctgctggagagcctgatgaagaccaacttcaccggggtgtctggggacaccatcctgtttgatgaaaatggagacagccctggccgctatgagatcatgaacttcaaggagatgggcaaggactactttgactacatcaacgtgggctcctgggacaatggagagctgaagatggatgatgatgaggtgtggagcaagaagagcaacatcatccgctctgtgtgcagcgagccctgtgagaagggccagatcaaggtgatcagaaaaggagaggtgtcctgctgctggacctgcaccccctgcaaggaaaatgaatatgtgtttgatgagtacacctgcaaggcctgccagctgggctcctggcccacagatgacctgaccggctgtgacctgatccctgtgcagtacctgcgctggggagaccctgagcccatcgctgctgtggtgtttgcctgcctgggcctgctggccaccctgtttgtgacagtggtgttcatcatctacagagacacccctgtggtgaagagcagcagccgggagctgtgctacatcatcctggccggcatctgcctgggctacctgtgcaccttctgcctgattgccaagcccaagcagatctactgctacctgcagagaattggaattggcctgagccctgccatgagctacagcgccctggtgaccaagaccaacagaattgcccgcatcctggccggcagcaagaagaagatctgcaccaagaagccccgcttcatgtctgcctgtgcccagctggtgattgccttcatcctgatctgcatccagctgggcatcatcgtggccctcttcatcatggagcccccagacatcatgcatgactaccccagcatccgggaggtgtacctgatctgcaacaccaccaacctgggcgtggtgacccccctgggctacaacggcctgctgatcctgagctgcaccttctacgccttcaagaccagaaatgtgcctgccaacttcaatgaggccaagtacatcgccttcaccatgtacaccacctgcatcatctggctggcctttgtgcccatctacttcggcagcaactacaagatcatcaccatgtgcttctctgtgtccctgagcgccaccgtggccctgggctgcatgtttgtgcccaaggtgtacatcatcctggccaagccagagagaaatgtgcgcagcgccttcaccaccagcacagtggtgaggatgcacgtgggagatggcaagagcagcagcgctgccagccgcagcagcagcctggtgaacctgtggaagaggcggggcagcagcggggagaccctgcgctacaaggaccggcggctggcccagcacaagtcagaaattgagtgcttcaccccacccagccccttccgggacagcgtggacagcggcagcaccacccccaacagccctgtgtctgagagcgccctgtgcatccccagcagccccaagtatgacaccctcatcatccgggactacacccagagcagcagcagcctgtag

SEQ ID NO: 34565 - DNA, 3639 bp, Artificial Sequence; identical to SEQ ID NO: 34563
  Description of Artificial Sequence: Synthetic coding sequence

SEQ ID NO: 34566 - DNA, 3543 bp, Artificial Sequence; identical to SEQ ID NO: 34562
  Description of Artificial Sequence: Synthetic coding sequence

SEQ ID NO: 34567 - DNA, 1149 bp, Artificial Sequence
  Description of Artificial Sequence: Synthetic coding sequence
atgaggtctgggggccggggccggccccggctgcggctgggggagcggggcctgatggagcccctgctgccccccaagaggcggctgctgccccgggtgcggctgctgcccctgctgctggccctggccgtgggcagcgccttctacaccatctggagcggctggcacagaagaacagaggagctgcccctgggccgggagctgcgggtgcccctgattggcagcctgcctgaggcccggctgcggcgggtggtgggccagctggacccccagaggctgtggagcacctacctgcggcccctgctggtggtgaggaccccaggcagccctggcaacctgcaggtgaggaagttcctggaggccaccctgcggagcctgacagctggctggcacgtggagctggaccccttcaccgccagcacccccctgggccctgtggactttggaaatgtggtggccaccctggaccccagggctgcccggcacctgaccctggcctgccactatgacagcaagctgtttcctcctggcagcaccccatttgtgggcgccacagattctgctgtgccctgtgccctgctgctggagctggcccaggccctggacctggagctgagccgggccaagaagcaggccgcccctgtgaccctgcagctgctcttcctggatggagaggaggccctgaaggagtggggccccaaggacagcctgtatggcagccgccacctggcccagctgatggagagcatcccccacagccctggccccacccgcatccaggccatcgagctgttcatgctgctggacctgctgggcgcccccaaccccaccttctacagccacttccccaggacagtgcgctggttccaccggctgcggagcattgagaagaggctgcaccggctgaacctgctgcagagccacccccaggaggtgatgtacttccagcctggagagccctttggatctgtggaggatgaccacatccccttcctgcggcggggcgtgcctgtgctgcacctgatcagcacccccttccctgctgtgtggcacaccccagctgacacagaggtgaacctgcacccccccaccgtgcacaacctgtgccgcatcctggccgtgttcctggccgagtacctgggcctgtag

SEQ ID NO: 34568 - DNA, 867 bp, Artificial Sequence
  Description of Artificial Sequence: Synthetic coding sequence
atgaggtctgggggccggggccggccccggctgcggctgggggagcggggcctgatggagcccctgctgccccccaagaggcggctgctgccccgggtgcggctgctgcccctgctgctggccctggccgtgggcagcgccttctacaccatctggagcggctggcacagaagaacagaggagctgcccctgggccgggagctgcgggtgcccctgattggcagcctgcctgaggcccggctgcggcgggtggtgggccagctggacccccagaggctgtggagcacctacctgcggcccctgctggtggtgaggaccccaggcagccctggcaacctgcaggtgaggaaggccgcccctgtgaccctgcagctgctcttcctggatggagaggaggccctgaaggagtggggccccaaggacagcctgtatggcagccgccacctggcccagctgatggagagcatcccccacagccctggccccacccgcatccaggccatcgagctgttcatgctgctggacctgctgggcgcccccaaccccaccttctacagccacttccccaggacagtgcgctggttccaccggctgcggagcattgagaagaggctgcaccggctgaacctgctgcagagccacccccaggaggtgatgtacttccagcctggagagccctttggatctgtggaggatgaccacatccccttcctgcggcggggcgtgcctgtgctgcacctgatcagcacccccttccctgctgtgtggcacaccccagctgacacagaggtgaacctgcacccccccaccgtgcacaacctgtgccgcatcctggccgtgttcctggccgagtacctgggcctgtag

SEQ ID NO: 34569 - DNA, 960 bp, Artificial Sequence
  Description of Artificial Sequence: Synthetic coding sequence
atgctgggccgcagcctgcgggaggtgtctgctgccctgaagcagggccagatcacccccacagagctgtgccagaagtgcctgagcctcatcaagaagaccaagttcctgaatgcctacatcaccgtgtctgaggaggtggccctgaagcaggccgaggagagcgagaagcgctacaagaatggccagagcctgggggacctggatggcatccccatcgctgtgaaggacaacttcagcaccagcggcatcgagaccacctgtgccagcaacatgctgaagggctacatccccccctacaatgccaccgtggtgcagaagctgctggaccagggcgccctgctgatgggcaagaccaacctggatgaatttgccatgggcagcggcagcacagatggagtgtttggacctgtgaagaacccctggagctacagcaagcagtaccgggagaagaggaagcagaacccccacagtgaaaatgaagattctgactggctgatcaccggcggcagcagcggcggcagcgctgctgctgtgtctgccttcacctgctacgccgccctgggcagtgacaccggcggcagcaccagaaatcctgctgcccactgcggcctggtgggcttcaagcccagctatggcctggtgagccgccacggcctcatccccctggtgaacagcatggatgtgcccggcatcctgacccgctgtgtggatgatgctgccatcgtgctgggcgccctggccggccctgacccccgggacagcaccaccgtgcatgagcccatcaacaagcccttcatgctgcccagcctggctgatgtgtccaagctgtgcatcggcatccccaaggtgaccttctccttccactacttcacagagatcctgagcagccccatcgagagcacagacctgggcggcggcctgggcggctttgagagcctgctgtgccacttctactag

SEQ ID NO: 34570 - DNA, 1587 bp, Artificial Sequence
  Description of Artificial Sequence: Synthetic coding sequence
atgctgggccgcagcctgcgggaggtgtctgctgccctgaagcagggccagatcacccccacagagctgtgccagaagtgcctgagcctcatcaagaagaccaagttcctgaatgcctacatcaccgtgtctgaggaggtggccctgaagcaggccgaggagagcgagaagcgctacaagaatggccagagcctgggggacctggatggcatccccatcgctgtgaaggacaacttcagcaccagcggcatcgagaccacctgtgccagcaacatgctgaagggctacatccccccctacaatgccaccgtggtgcagaagctgctggaccagggcgccctgctgatgggcaagaccaacctggatgaatttgccatgggcagcggcagcacagatggagtgtttggacctgtgaagaacccctggagctacagcaagcagtaccgggagaagaggaagcagaacccccacagtgaaaatgaagattctgactggctgatcaccggcggcagcagcggcggcagcgctgctgctgtgtctgccttcacctgctacgccgccctgggcagtgacaccggcggcagcaccagaaatcctgctgcccactgcggcctggtgggcttcaagcccagctatggcctggtgagccgccacggcctcatccccctggtgaacagcatggatgtgcccggcatcctgacccgctgtgtggatgatgctgccatcgtgctgggcgccctggccggccctgacccccgggacagcaccaccgtgcatgagcccatcaacaagcccttcatgctgcccagcctggctgatgtgtccaagctgtgcatcggcatccccaaggagtacctggtgcctgagctgagcagcgaggtgcagagcctgtggagcaaggctgctgacctgtttgaaagtgaaggagccaaggtgattgaggtgtccctgccccacaccagctacagcatcgtgtgctaccacgtgctgtgcaccagcgaggtggccagcaacatggccaggtttgatggcctgcagtatggccaccgctgtgacattgatgtgtccacagaggccatgtatgctgccacccggcgggagggcttcaatgatgtggtgcggggccgcatcctgagcggcaacttcttcctgctgaaggaaaattatgagaactactttgtgaaggcccagaaggtgcggcggctgattgccaatgactttgtgaatgccttcaacagcggcgtggatgtgctgctgacccccaccaccctgtctgaggccgtgccctacctggagttcatcaaggaggacaacagaaccaggtctgcccaggatgacatcttcacccaggccgtgaacatggccggcctgcctgctgtgtccatccctgtggccctgagcaaccagggcctgcccatcggcctgcagttcatcggccgggccttctgtgaccagcagctgctgactgtggccaagtggtttgagaagcaggtgcagtttcctgtgatccagctgcaggagctgatggatgactgcagcgctgtgctggagaatgagaagctggcctctgtgtccctgaagcagtag

SEQ ID NO: 34571 - DNA, 411 bp, Artificial Sequence
  Description of Artificial Sequence: Synthetic coding sequence
atgtggagccggctggtgtggctgggcctgcgggcccccctgggcggccggcagggcttcaccagcaaggctgacccccagggcagcggccgcatcacagctgctgtgattgagcacctggagcggctggccctggtggactttggcagccgggaggccgtggcccggctggagaaggccatcgcctttgctgaccggctgcgggctgtggacacagatggagtggagcccatggagagcgtgctggaggaccgctgcctgtacctgcggagtgacaacgtggtggagggcaactgtgctgatgagctgctgcagaacagccaccgggtggtggaggagtactttgtggcccctcctggcaacatcagcctgcccaagctggatgagcaggagcccttcccccacagctag

SEQ ID NO: 34572 - DNA, 630 bp, Artificial Sequence
  Description of Artificial Sequence: Synthetic coding sequence
atggagcccctggccgcctaccccctgaagtgcagcggcccccgggccaaggtgtttgctgtgctgctgagcatcgtgctgtgcaccgtgaccctcttcctgctgcagctgaagttcctgaagcccaagatcaacagcttctacgcctttgaggtgaaggatgccaagggccgcacagtgtccctggagaagtacaagggcaaggtgtccctggtggtgaatgtggccagtgactgccagctgacagacaggaactacctgggcctgaaggagctgcacaaggagtttggccccagccacttctctgtgctggccttcccctgcaaccagtttggagagagcgagccccggcccagcaaggaggtggagagctttgccaggaagaactacggcgtgaccttccccatcttccacaagatcaagatcctgggcagcgagggggagcccgccttccgcttcctggtggacagcagcaagaaggagccccgctggaacttctggaagtacctggtgaaccctgagggccaggtggtgaagttctggaagccagaggagcccattgaagtcatccggccagacattgctgccctggtgcggcaggtgatcatcaagaagaaggaggacctgtag

SEQ ID NO: 34573 - DNA, 2388 bp, Artificial Sequence
  Description of Artificial Sequence: Synthetic coding sequence
atggccaccatgctggagggccgctgccagacccagcccaggagcagccccagcggccgggaggccagcctgtggagcagcggcttcggcatgaagctggaggccgtgacccccttcctgggcaagtaccggccctttgtgggccgctgctgccagacctgcacccccaagtcctgggagagcctcttccacaggagcatcacagacctgggcttctgcaacgtcatcctggtgaaggaggagaacacccgcttccggggctggctggtgcggcggctgtgctacttcctgtggagcctggagcagcacatccccccctgccaggatgtgccccagaagatcatggagagcactggagtgcagaacctgctgagcggccgggtgcctgggggcaccggggagggccaggtgcctgacctggtgaagaaggaggtgcagaggatcctgggccacatccaggccccaccccggcccttcctggtgcggctcttctcctgggccctgctgcgcttcctgaactgcctcttcctgaatgtgcagctgcacaagggccagatgaagatggtgcagaaggccgcccaggccggcctgcccctggtgctgctgagcacccacaagaccctgctggatggcatcctgctgcccttcatgctgctgagccagggcctgggcgtgctgcgggtggcctgggacagccgggcctgcagccctgccctgcgggccctgctgaggaagctgggcggcctcttcctgcccccagaggccagcctgagcctggacagcagcgagggcctgctggcccgggctgtggtgcaggccgtgattgagcagctgctggtgtctggccagcccctgctgatcttcctggaggagcccccaggggccctgggcccccggctgagcgccctgggccaggcctgggtgggctttgtggtgcaggccgtgcaggtgggcatcgtgcctgatgccctgctggtgcctgtggccgtgacctatgacctggtgcctgatgccccctgtgacatcgaccacgccagcgcccccctgggcctgtggacaggagccctggccgtgctgcggagcctgtggagccgctggggctgcagccaccgcatctgcagccgggtgcacctggcccagcccttcagcctgcaggagtacatcgtgtctgcccggagctgctggggcggccggcagaccctggagcagctgctgcagcccatcgtgctgggccagtgcacagctgtgcctgacacagagaaggagcaggagtggacccccatcaccggccccctgctggccctgaaggaggaggaccagctgctggtgcggcggctgagctgccacgtgctgagcgcctctgtgggcagcagcgctgtgatgagcacagccatcatggccaccctgctgctcttcaagcaccagaagctgctgggggagttctcctggctgacagaggagatcctgctgcggggctttgatgtgggcttcagcggccagctgcggagcctgctgcagcacagcctgagcctgctgcgggcccacgtggccctgctgcgcatccggcagggcgacctgctggtggtgccccagcccggccctggcctgacccacctggcccagctgtctgctgagctgctgcccgtcttcctgtctgaggccgtgggcgcctgtgctgtgcggggcctgctggccggccgggtgcccccccagggcccctgggagctgcagggcatcctgctgctgagccagaatgagctgtaccggcagatcctgctgctgatgcacctgctgccccaggacctgctgctgctgaagccctgccagagcagctactgctactgccaggaggtgctggacaggctcatccagtgtggcctgctggtggccgaggagaccccaggcagcaggcctgcctgtgacaccggccggcagaggctgagcaggaagctgctgtggaagcccagcggggacttcacagacagcgacagtgatgactttggagaggctgatggccgctacttccggctgagccagcagagccactgcccagacttcttcctgttcctgtgccgcctgctgagccccctgctgaaggcctttgcccaggccgccgccttcctgcggcagggccagctgcctgacacagagctgggctacacagagcagctgttccagttcctgcaggccacagcccaggaggagggcatctttgaatgtgccgaccccaagctggccatctctgctgtgtggaccttccgggacctgggcgtgctgcagcagacccccagccctgctggcccccggctgcacctgagccccacctttgccagcctggacaaccaggagaagctggagcagttcatccggcagttcatctgcagctag

SEQ ID NO: 34574 - DNA, 2016 bp, Artificial Sequence
  Description of Artificial Sequence: Synthetic coding sequence
atggccaccatgctggagggccgctgccagacccagcccaggagcagccccagcggccgggaggccagcctgtggagcagcggcttcggcatgaagctggaggccgtgacccccttcctgggcaagtaccggccctttgtgggccgctgctgccagacctgcacccccaagtcctgggagagcctcttccacaggagcatcacagacctgggcttctgcaacgtcatcctggtgaaggaggagaacacccgcttccggggctggctggtgcggcggctgtgctacttcctgtggagcctggagcagcacatccccccctgccaggatgtgccccagaagatcatggagagcactggagtgcagaacctgctgagcggccgggtgcctgggggcaccggggagggccaggtgcctgacctggtgaagaaggaggtgcagaggatcctgggccacatccaggccccaccccggcccttcctggtgcggctcttctcctgggccctgctgcgcttcctgaactgcctcttcctgaatgtgcagctgcacaagggccagatgaagatggtgcagaaggccgcccaggccggcctgcccctggtgctgctgagcacccacaagaccctgctggatggcatcctgctgcccttcatgctgctgagccagggcctgggcgtgctgcgggtggcctgggacagccgggcctgcagccctgccctgcgggccctgctgaggaagctgggcggcctcttcctgcccccagaggccagcctgagcctggacagcagcgagggcctgctggcccgggctgtggtgcaggccgtgattgagcagctgctggtgtctggccagcccctgctgatcttcctggaggagcccccaggggccctgggcccccggctgagcgccctgggccaggcctgggtgggctttgtggtgcaggccgtgcaggtgggcatcgtgcctgatgccctgctggtgcctgtggccgtgacctatgacctggtgcctgatgccccctgtgacatcgaccacgccagcgcccccctgggcctgtggacaggagccctggccgtgctgcggagcctgtggagccgctggggctgcagccaccgcatctgcagccgggtgcacctggcccagcccttcagcctgcaggagtacatcgtgtctgcccggagctgctggggcggccggcagaccctggagcagctgctgcagcccatcgtgctgggccagtgcacagctgtgcctgacacagagaaggagcaggagtggacccccatcaccggccccctgctggccctgaaggaggaggaccagctgctggtgcggcggctgagctgccacgtgctgagcgcctctgtgggcagcagcgctgtgatgagcacagccatcatggccaccctgctgctcttcaagcaccagaagctgctgggggagttctcctggctgacagaggagatcctgctgcggggctttgatgtgggcttcagcggccagctgcggagcctgctgcagcacagcctgagcctgctgcgggcccacgtggccctgctgcgcatccggcagggcgacctgctggtggtgccccagcccggccctggcctgacccacctggcccagctgtctgctgagctgctgcccgtcttcctgtctgaggccgtgggcgcctgtgctgtgcggggcctgctggccggccgggtgcccccccagggcccctgggagctgcagggcatcctgctgctgagccagaatgagctgtaccggcagatcctgctgctgatgcacctgctgccccaggacctgctgctgctgaagccctgccagagcagctactgctactgccaggaggtgctggacaggctcatccagtgtggcctgctggtggccgaggagagctgggccacccagagcagctgcagcagcagctgccggcccccacccaggaagaagggcagcagctctgtgaggacccagagcagccccagcgtgctgagcggccccagcgagacctag

SEQ ID NO: 34575 - DNA, 2388 bp, Artificial Sequence; identical to SEQ ID NO: 34573
  Description of Artificial Sequence: Synthetic coding sequence

SEQ ID NO: 34576 - DNA, 483 bp, Artificial Sequence
  Description of Artificial Sequence: Synthetic coding sequence
atggccaccatgctggagggccgctgccagacccagcccaggagcagccccagcggccgggaggccagcctgtggagcagcggcttcggcatgaagctggaggccgtgacccccttcctgggcaagtaccggccctttgtgggccgctgctgccagacctgcacccccaagtcctgggagagcctcttccacaggagcatcacagacctgggcttctgcaacgtcatcctggtgaaggaggagaacacccgcttccggggctggctggtgcggcggctgtgctacttcctgtggagcctggagcagcacatccccccctgccaggatgtgccccagaagatcatggagagcactggagtgcagaacctgctgagcggccgggtgcctgggggcaccggggagggccaggtgcctgacctggtgaagaaggaggtgcagaggatcctgggccacatccaggccccaccccggcccttcctgtag

SEQ ID NO: 34577 - DNA, 2487 bp, Artificial Sequence
  Description of Artificial Sequence: Synthetic coding sequence
atggatgagagcgccctgaccctgggcaccattgatgtgtcctacctgccccacagcagcgagtacagcgtgggccgctgcaagcacaccagcgaggagtggggagaatgtggcttccggcccaccatcttccgcagcgccaccctgaagtggaaggagagcctgatgagcaggaagaggccctttgtgggccgctgctgctacagctgcaccccccagagctgggacaagttcttcaaccccagcatccccagcctgggcctgagaaatgtcatctacatcaatgagacccacaccaggcaccggggctggctggcccggcggctgtcctatgtgctcttcatccaggagagagatgtgcacaagggcatgtttgccaccaacgtgacagaaaatgtgctgaacagcagccgggtgcaggaggccatcgccgaggtggccgctgagctgaacccagatggcagcgcccagcagcagagcaaggctgtgaacaaggtgaagaagaaggccaagaggatcctgcaggagatggtggccaccgtgtccccagccatgatccggctgaccggctgggtgctgctgaagctgttcaacagcttcttctggaacatccagatccacaagggccagctggagatggtgaaggccgccacagagaccaacctgcccctgctcttcctgcctgtgcacaggagccacatcgactacctgctgctgaccttcatcctcttctgccacaacatcaaggccccctacatcgccagcggcaacaacctgaacatccccatcttcagcaccctcatccacaagctgggcggcttcttcatcagaagaaggctggatgagaccccagatggcaggaaggatgtgctgtaccgggccctgctgcacggccacatcgtggagctgctgcggcagcagcagttcctggagatcttcctggagggcaccaggagccgcagcggcaagaccagctgtgcccgggccggcctgctgtctgtggtggtggacaccctgagcaccaacgtcatcccagacatcctgatcatccctgtgggcatctcctatgaccgcatcatcgagggccactacaatggagagcagctgggcaagcccaagaagaatgaaagcctgtggagcgtggcccggggcgtcatccgcatgctgaggaagaactacggctgtgtgcgggtggactttgcccagcccttcagcctgaaggagtacctggagagccagagccagaagcctgtgtctgccctgctgagcctggagcaggccctgctgcctgccatcctgcccagccggcccagtgatgctgctgatgagggccgggacaccagcatcaatgaaagcagaaatgccacagatgagagcctgcggcggcggctgattgccaacctggccgagcacatcctcttcaccgccagcaagagctgtgccatcatgagcacccacatcgtggcctgcctgctgctgtaccgccaccggcagggcatcgacctgagcaccctggtggaggacttctttgtgatgaaggaggaggtgctggcccgggactttgacctgggcttcagcggcaacagtgaagatgtggtgatgcacgccatccagctgctgggcaactgtgtgaccatcacccacaccagcagaaatgatgagttcttcatcacccccagcaccaccgtgcccagcgtgtttgagctgaacttctacagcaatggagtgctgcacgtgttcatcatggaggccatcatcgcctgcagcctgtatgctgtgctgaacaagaggggcctgggcggccccaccagcaccccacccaacctgatcagccaggagcagctggtgaggaaggccgccagcctgtgctacctgctgagcaatgaaggcaccatcagcctgccctgccagaccttctaccaggtgtgccacgagaccgtgggcaagttcatccagtatggcatcctgactgtggccgagcatgatgaccaggaggacatcagccccagcctggccgagcagcagtgggacaagaagctgcctgagcccctgtcctggaggagtgatgaagaagatgaagattctgactttggagaggagcagagggactgctacctgaaggtgtcccagagcaaggagcaccagcagttcatcaccttcctgcagaggctgctgggccccctgctggaggcctacagcagcgctgccatctttgtgcacaacttcagcggccctgtgcctgagcctgagtacctgcagaagctgcacaagtacctgatcaccaggacagaaagaaatgtggccgtgtatgcagagagcgccacctactgcctggtgaagaatgctgtgaagatgttcaaggacattggagtcttcaaggagaccaagcagaagagggtgtctgtgctggagctgagcagcaccttcctgccccagtgcaaccggcagaagctgctggagtacatcctgagctttgtggtgctgtag

SEQ ID NO: 34578 - DNA, 2133 bp, Artificial Sequence
  Description of Artificial Sequence: Synthetic coding sequence
atggatgagagcgccctgaccctgggcaccattgatgtgtcctacctgccccacagcagcgagtacagcgtgggccgctgcaagcacaccagcgaggagtggggagaatgtggcttccggcccaccatcttccgcagcgccaccctgaagtggaaggagagcctgatgagcaggaagaggccctttgtgggccgctgctgctacagctgcaccccccagagctgggacaagttcttcaaccccagcatccccagcctgggcctgagaaatgtcatctacatcaatgagacccacaccaggcaccggggctggctggcccggcggctgtcctatgtgctcttcatccaggagagagatgtgcacaagggcatgtttgccaccaacgtgacagaaaatgtgctgaacagcagccgggtgcaggaggccatcgccgaggtggccgctgagctgaacccagatggcagcgcccagcagcagagcaaggctgtgaacaaggtgaagaagaaggccaagaggatcctgcaggagatggtggccaccgtgtccccagccatgatccggctgaccggctgggtgctgctgaagctgttcaacagcttcttctggaacatccagatccacaagggccagctggagatggtgaaggccgccacagagaccaacctgcccctgctcttcctgcctgtgcacaggagccacatcgactacctgctgctgaccttcatcctcttctgccacaacatcaaggccccctacatcgccagcggcaacaacctgaacatccccatcttcagcaccctcatccacaagctgggcggcttcttcatcagaagaaggctggatgagaccccagatggcaggaaggatgtgctgtaccgggccctgctgcacggccacatcgtggagctgctgcggcagcagcagttcctggagatcttcctggagggcaccaggagccgcagcggcaagaccagctgtgcccgggccggcctgctgtctgtggtggtggacaccctgagcaccaacgtcatcccagacatcctgatcatccctgtgggcatctcctatgaccgcatcatcgagggccactacaatggagagcagctgggcaagcccaagaagaatgaaagcctgtggagcgtggcccggggcgtcatccgcatgctgaggaagaactacggctgtgtgcgggtggactttgcccagcccttcagcctgaaggagtacctggagagccagagccagaagcctgtgtctgccctgctgagcctggagcaggccctgctgcctgccatcctgcccagccggcccagtgatgctgctgatgagggccgggacaccagcatcaatgaaagcagaaatgccacagatgagagcctgcggcggcggctgattgccaacctggccgagcacatcctcttcaccgccagcaagagctgtgccatcatgagcacccacatcgtggcctgcctgctgctgtaccgccaccggcagggcatcgacctgagcaccctggtggaggacttctttgtgatgaaggaggaggtgctggcccgggactttgacctgggcttcagcggcaacagtgaagatgtggtgatgcacgccatccagctgctgggcaactgtgtgaccatcacccacaccagcagaaatgatgagttcttcatcacccccagcaccaccgtgcccagcgtgtttgagctgaacttctacagcaatggagtgctgcacgtgttcatcatggaggccatcatcgcctgcagcctgtatgctgtgctgaacaagaggggcctgggcggccccaccagcaccccacccaacctgatcagccaggagcagctggtgaggaaggccgccagcctgtgctacctgctgagcaatgaaggcaccatcagcctgccctgccagaccttctaccaggtgtgccacgagaccgtgggcaagttcatccagtatggcatcctgactgtggccgagcatgatgaccaggaggacatcagccccagcctggccgagcagcagtgggacaagaagctgcctgagcccctgtcctggaggagtgatgaagaagatgaagattctgactttggagaggagcagagggactgctacctgaaggtgctgggctag

SEQ ID NO: 34579 - DNA, 2487 bp, Artificial Sequence; identical to SEQ ID NO: 34577
  Description of Artificial Sequence: Synthetic coding sequence

SEQ ID NO: 34580 - DNA, 945 bp, Artificial Sequence
  Description of Artificial Sequence: Synthetic coding sequence
atgagcagcacagctgccttctacctgctgagcaccctgggcggctacctggtgaccagcttcctgctgctgaagtaccccaccctgctgcaccagaggaagaagcagcgcttcctgagcaagcacatcagccacagaggaggagctggggagaacctggagaacaccatggccgccttccagcacgctgtgaagattggaacagacatgctggagctggactgccacatcaccaaggatgagcaggtggtggtgtcccatgatgagaacctgaagagggccactggagtgaatgtgaacatcagtgacctgaagtactgtgagctgcccccctacctgggcaagctggatgtgtccttccagagggcctgccagtgtgagggcaaggacaaccgcatccccctgctgaaggaggtgtttgaggccttccccaacacccccatcaacatcgacatcaaggtgaacaacaacgtgctgatcaagaaggtgtctgagctggtgaagcgctacaaccgggagcacctgactgtgtggggcaatgccaactatgaaattgtggagaagtgctacaaggagaacagcgacatccccatcctcttcagcctgcagagggtgctgctgatcctgggcctcttcttcaccggcctgctgccctttgtgcccatccgggagcagttctttgagatccccatgcccagcatcatcctgaagctgaaggagccccacaccatgagccgcagccagaagttcctgatctggctgagtgacctgctgctgatgaggaaggccctgtttgaccacctgacagcccggggcatccaggtgtacatctgggtgctgaatgaggagcaggagtacaagagggcctttgacctgggcgccactggagtgatgacagactaccccaccaagctgcgggacttcctgcacaacttcagcgcctag

SEQ ID NO: 34581 - DNA, 870 bp, Artificial Sequence
  Description of Artificial Sequence: Synthetic coding sequence
atgagcagcacagctgccttctacctgctgagcaccctgggcggctacctggtgaccagcttcctgctgctgaagtaccccaccctgctgcaccagaggaagaagcagcgcttcctgagcaagcacatcagccacagaggaggagctggggagaacctggagaacaccatggccgccttccagcacgctgtgaagattggaacagacatgctggagctggactgccacatcaccaaggatgagcaggtggtggtgtcccatgatgagaacctgaagagggccactggagtgaatgtgaacatcagtgacctgaagtactgtgagctgcccccctacctgggcaagctggatgtgtccttccagagggcctgccagtgtgagggcaaggacaaccgcatccccctgctgaaggaggtgtttgaggccttccccaacacccccatcaacatcgacatcaaggtgaacaacaacgtgctgatcaagaaggtgtctgagctggtgaagcgctacaaccgggagcacctgactgtgtggggcaatgccaactatgaaattgtggagaagtgctacaaggagaacagcgacatccccatcctcttcagcctgcagagggtgctgctgatcctgggcctcttcttcaccggcctgctgccctttgtgcccatccgggagcagttctttgagatccccatgcccagcatcatcctgaagctgaaggagccccacaccatgagccgcagccagaagttcctgatctggctgagtgacctgctgctgatgaggaaggccctgtttgagcccctgcacccagccagcaagaggaactttgagggccactgcagctacctggtggtgtcctgctacttctag

SEQ ID NO: 34582 - DNA, 873 bp, Artificial Sequence
  Description of Artificial Sequence: Synthetic coding sequence
atgagcagcacagctgccttctacctgctgagcaccctgggcggctacctggtgaccagcttcctgctgctgaagtaccccaccctgctgcaccagaggaagaagcagcgcttcctgagcaagcacatcagccacagaggaggagctggggagaacctggagaacaccatggccgccttccagcacgctgtgaagattggaacagacatgctggagctggactgccacatcaccaaggatgagcaggtggtggtgtcccatgatgagaacctgaagagggccactggagtgaatgtgaacatcagtgacctgaagtactgtgagctgcccccctacctgggcaagctggatgtgtccttccagagggcctgccagtgtgagggcaaggacaaccgcatccccctgctgaaggaggtgtttgaggccttccccaacacccccatcaacatcgacatcaaggtgaacaacaacgtgctgatcaagaaggtgtctgagctggtgaagcgctacaaccgggagcacctgactgtgtggggcaatgccaactatgaaattgtggagaagtgctacaaggagaacagcgacatccccatcctcttcagcctgcagagggtgctgctgatcctgggcctcttcttcaccggcctgctgccctttgtgcccatccgggagcagttctttgagatccccatgcccagcatcatcctgaagctgaaggagccccacaccatgagccgcagccagaagttcctgatctggctgagtgacctgctgctgatgaggaaggccctgtttgaccacctgacagcccggggcatccaggtgtccttctggaatgatgccttctggaagcagcacagcagccctgtgtag

SEQ ID NO: 34583 - DNA, 1620 bp, Artificial Sequence
  Description of Artificial Sequence: Synthetic coding sequence
atggccgagagccctggctgctgcagcgtgtgggcccgctgcctgcactgcctgtacagctgccactggaggaaatgtccccgggagaggatgcagaccagcaaatgtgactgcatctggtttggcctgctcttcctgaccttcctgctgagcctgtcctggctgtacatcggcctggtgctgctgaatgacctgcacaacttcaatgagttcctgttccgccgctggggccactggatggactggagcctggccttcctgctggtgatcagcctgctggtgacctacgccagcctgctgctggtgctggccctgctgctgcggctgtgccggcagcccctgcacctgcacagcctgcacaaggtgctgctgctgctgatcatgctgctggtggccgccggcctggtgggcctggacatccagtggcagcaggagtggcacagcctgcgggtgtccctgcaggccacagcccccttcctgcacatcggggctgctgctggcatcgccctgctggcctggcctgtggccgacaccttctaccgcatccaccggcggggccccaagatcctgctgctgctgctcttcttcggcgtggtgctggtgatctacctggcccccctgtgcatcagcagcccctgcatcatggagccccgggacctgccccccaagccaggcctggtgggccacagaggagcccccatgctggcccctgagaacaccctgatgagcctgaggaagacagcagaatgtggggccaccgtgtttgaaacagatgtgatggtgtccagtgatggagtgcccttcctgatgcatgatgagcacctgagcaggaccaccaacgtggcctctgtgttccccacccgcatcacagcccacagcagtgacttctcctggacagagctgaagaggctgaatgccggctcctggttcctggagcggcggcccttctggggcgccaagcccctggccggccctgaccagaaggaggccgagagccagacagtgcctgccctggaggagctgctggaggaggccgccgccctgaacctgagcatcatgtttgacctgcggcggcccccccagaaccacacctactatgacacctttgtgatccagaccctggagaccgtgctgaatgcccgggtgccccaggccatggtgttctggctgcctgatgaagatcgggccaacgtgcagaggcgggcccctggcatgaggcagatctacggccggcagggcggcaacagaacagagcggccccagttcctgaacctgccctaccaggacctgcccctgctggacatcaaggccctgcacaaggacaacgtgtctgtgaacctgtttgtggtgaacaagccctggctgttcagcctgctgtggtgtgccggcgtggacagcgtgaccaccaatgactgccagctgctgcagcagatgagataccccatctggctgatcaccccccagacctacctgatcatctgggtgatcaccaactgtgtgtccaccatgctgctgctgtggaccttcctgctgcagaggagatttgtgaagaagaggggcaagacaggcctggagacagctgtgctgctgacccgcatcaacaacttcatgatggagtag

SEQ ID NO: 34584 - DNA, 1773 bp, Artificial Sequence
  Description of Artificial Sequence: Synthetic coding sequence
atggccgagagccctggctgctgcagcgtgtgggcccgctgcctgcactgcctgtacagctgccactggaggaaatgtccccgggagaggatgcagaccagcaaatgtgactgcatctggtttggcctgctcttcctgaccttcctgctgagcctgtcctggctgtacatcggcctggtgctgctgaatgacctgcacaacttcaatgagttcctgttccgccgctggggccactggatggactggagcctggccttcctgctggtgatcagcctgctggtgacctacgccagcctgctgctggtgctggccctgctgctgcggctgtgccggcagcccctgcacctgcacagcctgcacaaggtgctgctgctgctgatcatgctgctggtggccgccggcctggtgggcctggacatccagtggcagcaggagtggcacagcctgcgggtgtccctgcaggccacagcccccttcctgcacatcggggctgctgctggcatcgccctgctggcctggcctgtggccgacaccttctaccgcatccaccggcggggccccaagatcctgctgctgctgctcttcttcggcgtggtgctggtgatctacctggcccccctgtgcatcagcagcccctgcatcatggagccccgggacctgccccccaagccaggcctggtgggccacagaggagcccccatgctggcccctgagaacaccctgatgagcctgaggaagacagcagaatgtggggccaccgtgtttgaaacagatgtgatggtgtccagtgatggagtgcccttcctgatgcatgatgagcacctgagcaggaccaccaacgtggcctctgtgttccccacccgcatcacagcccacagcagtgacttctcctggacagagctgaagaggctgaatgccggctcctggttcctggagcggcggcccttctggggcgccaagcccctggccggccctgaccagaaggaggccgagagccagacagtgcctgccctggaggagctgctggaggaggccgccgccctgaacctgagcatcatgtttgacctgcggcggcccccccagaaccacacctactatgacacctttgtgatccagaccctggagaccgtgctgaatgcccgggtgccccaggccatggtgttctggctgcctgatgaagatcgggccaacgtgcagaggcgggcccctggcatgaggcagatctacggccggcagggcggcaacagaacagagcggccccagttcctgaacctgccctaccaggacctgcccctgctggacatcaaggaccgcttcctgctgcctgcccaggccggcctgaagctgctggccagcagcaacctgcctgccagcgccagccagagcgctggcatcaccggcctgagccactgccccccccagcccccaggctacaagcatgagctgagccacctggccatggccctgcacaaggacaacgtgtctgtgaacctgtttgtggtgaacaagccctggctgttcagcctgctgtggtgtgccggcgtggacagcgtgaccaccaatgactgccagctgctgcagcagatgagataccccatctggctgatcaccccccagacctacctgatcatctgggtgatcaccaactgtgtgtccaccatgctgctgctgtggaccttcctgctgcagaggagatttgtgaagaagaggggcaagacaggcctggagacagctgtgctgctgacccgcatcaacaacttcatgatggagtag

SEQ ID NO: 34585 - DNA, 1383 bp, Artificial Sequence
  Description of Artificial Sequence: Synthetic coding sequence
atggactggagcctggccttcctgctggtgatcagcctgctggtgacctacgccagcctgctgctggtgctggccctgctgctgcggctgtgccggcagcccctgcacctgcacagcctgcacaaggtgctgctgctgctgatcatgctgctggtggccgccggcctggtgggcctggacatccagtggcagcaggagtggcacagcctgcgggtgtccctgcaggccacagcccccttcctgcacatcggggctgctgctggcatcgccctgctggcctggcctgtggccgacaccttctaccgcatccacagaagaggccccaagatcctgctgctgctgctcttctttggagtggtgctggtgatctacctggcccccctgtgcatcagcagcccctgcatcatggagccccgggacctgccccccaagccaggcctggtgggccacagaggagcccccatgctggcccctgagaacaccctgatgagcctgaggaagacagcagaatgtggggccaccgtgtttgaaacagatgtgatggtgtccagtgatggagtgcccttcctgatgcatgatgagcacctgagcaggaccaccaacgtggccagcgtcttccccacccgcatcacagcccacagcagtgacttctcctggacagagctgaagaggctgaatgccggctcctggttcctggagcggcggcccttctggggcgccaagcccctggccggccctgaccagaaggaggccgagagccagacagtgcctgccctggaggagctgctggaggaggccgccgccctgaacctgagcatcatgtttgacctgcggcggcccccccagaaccacacctactatgacaccttcgtcatccagaccctggagaccgtgctgaatgcccgggtgccccaggccatggtgttctggctgcctgatgaggaccgggccaacgtgcagaggcgggcccctggcatgaggcagatctacggccggcagggcggcaacagaacagagcggccccagttcctgaacctgccctaccaggacctgcccctgctggacatcaaggccctgcacaaggacaacgtgtctgtgaacctgtttgtggtgaacaagccctggctgttcagcctgctgtggtgtgccggcgtggacagcgtgaccaccaatgactgccagctgctgcagcagatgagataccccatctggctgatcaccccccagacctacctgatcatctgggtgatcaccaactgtgtgtccaccatgctgctgctgtggaccttcctgctgcagaggagatttgtgaagaagaggggcaagacaggcctggagacagctgtgctgctgacccgcatcaacaacttcatgatggagtag

SEQ ID NO: 34586 - DNA, 1383 bp, Artificial Sequence; identical to SEQ ID NO: 34585
  Description of Artificial Sequence: Synthetic coding sequence

SEQ ID NO: 34587 - DNA, 771 bp, Artificial Sequence
  Description of Artificial Sequence: Synthetic coding sequence
atggcccagaggagtgacctgctggagctggactgccagctgacccgggacagagtggtggtggtgtcccatgatgagaacctgtgccggcagagcggcctgaacagagatgtgggcagcctggactttgaggacctgcccctgtacaaggagaagctggaggtgtacttcagccctggccactttgcccacggcagtgacaggaggatggtgcggctggaggacctcttccagcgcttccccaggacccccatgtctgtggagatcaagggcaagaatgaggagctgatccgggagattgctggcctggtgagaagatatgacagaaatgagatcaccatctgggccagcgagaagagctctgtgatgaagaagtgcaaggccgccaaccctgagatgcccctgtccttcaccatcagccggggcttctgggtgctgctgagctactacctgggcctgctgcccttcatccccatccctgagaagttcttcttctgcttcctgcccaacatcatcaacagaacctacttccccttcagctgcagctgcctgaaccagctgctggccgtggtgtccaagtggctgatcatgaggaagagcctcatccgccacctggaggagcggggcgtgcaggtggtgttctggtgcctgaatgaggagagtgactttgaagctgccttctctgtgggcgccaccggggtcatcacagactaccccacagccctgcggcactacctggacaaccacggccctgctgcccggaccagctag

SEQ ID NO: 34588 - DNA, 957 bp, Artificial Sequence
  Description of Artificial Sequence: Synthetic coding sequence
atgagcctgctgctgtactatgccctgcctgccctgggcagctatgccatgctgagcatcttcttcctgcggcggccccacctgctgcacaccccccgggcccccaccttccgcatccggctgggcgcccaccggggcggcagcggggagctgctggagaacaccatggaggccatggagaacagcatggcccagaggagtgacctgctggagctggactgccagctgacccgggacagagtggtggtggtgtcccatgatgagaacctgtgccggcagagcggcctgaacagagatgtgggcagcctggactttgaggacctgcccctgtacaaggagaagctggaggtgtacttcagccctggccactttgcccacggcagtgacaggaggatggtgcggctggaggacctcttccagcgcttccccaggacccccatgtctgtggagatcaagggcaagaatgaggagctgatccgggagattgctggcctggtgagaagatatgacagaaatgagatcaccatctgggccagcgagaagagctctgtgatgaagaagtgcaaggccgccaaccctgagatgcccctgtccttcaccatcagccggggcttctgggtgctgctgagctactacctgggcctgctgcccttcatccccatccctgagaagttcttcttctgcttcctgcccaacatcatcaacagaacctacttccccttcagctgcagctgcctgaaccagctgctggccgtggtgtccaagtggctgatcatgaggaagagcctcatccgccacctggaggagcggggcgtgcaggtggtgttctggtgcctgaatgaggagagtgactttgaagctgccttctctgtgggcgccaccggggtcatcacagactaccccacagccctgcggcactacctggacaaccacggccctgctgcccggaccagctag

SEQ ID NO: 34589 - DNA, 1563 bp, Artificial Sequence
  Description of Artificial Sequence: Synthetic coding sequence
atgctgctcttcctgtggattgagaccagcagcgagtacttcaactttgactgggtgaccttcctgggcaccggctactggttcttctggagcatcttcatcctgagcctggcccgcatcctgacagcctacagcagcctgctgctgctgctgggcttcctgctgctgtgggagcgcatcgagctgtacctgcacctgtgccacaagatcctgatcctgctggtgatcctgctgtgtgtgatcctgatgttcatcatctgcaagttctggaaggagcgctggctggtggccggcctgtccatgcagatctttgccccctacgtgcacctggtgtccatcaccgtgatggtgatcctcttctggcctgtggccttctacgtggcctgcctggagcgggaggtgaggatgaggcgctacaggatgacccacagcgagaagaagaggctgaagcagtgcaacgtcatcacccggctgcggggcctgcaggtgcctgtgggcctgcccttcctgctgatcctgctgggcctgtacctgatgcccctgggcatctacagcccctgcatccaggagaaggagaacctgggccccaagcccaccatcttcggccacagaggagcccccatgctgggccctgagaacaccatgatgagctttgagaaggctgtggagcacggggcccacggcctggagacagacatccacctgtcctatgaccacgtgcccttcctgatgcatgactttgacctgaagaggaccaccaacattggagaggtgcagcctgagagcgcctgtgaaaatcctgccttcttcaactgggacttcctgagcaccctgaatgctgggaagtggtttgtgaagccagagctgcggcccttctacaacatgaagcccctgtctgaggccgacaaggagcgggccaggaaccagagcatccccaccctggccgacctgctgaccctggccgagaaggagaggaagtttgtgatctttgacctgcaccggcccccacccaagcaccccctgcggcacacctttgtgcggcaggtggtgtctgtcatcctggccagcaagattgagcagcacctgatcttctggctgcctgcccatgaccggcagtatgtgcgctctgtggcccctggcttccagcacgtgggccgcctggtgtccattgagaccctggccaagaacaacatcagcatcatcaacgtggactacaagaagctgttccccaacggcctgcgggactacaaggccgccaacatccacatcaacgtgtacacagtgaatgagccctggctgttcagcctggcctggtgcagccgcatcaacagcgtgaccacagacaacatcggcctgctgagccagctggaccacccccacttcttcatgacccccaagttctacgtgttcatgtggctgctggccgacatcatctctgtgctcttcatcgtggccatcttctgcttccactggaggcgggagacagagaaggagaagctgtttgagaccagcagcaccaggacagacacccagagcggcagcaagaatgaggaggacagatag

SEQ ID NO: 34590 - DNA, 1872 bp, Artificial Sequence
  Description of Artificial Sequence: Synthetic coding sequence
atgctgctcttcctgtggattgagaccagcagcgagtacttcaactttgactgggtgaccttcctgggcaccggctactggttcttctggagcatcttcatcctgagcctggcccgcatcctgacagcctacagcagcctgctgctgctgctgggcttcctgctgctgtgggagcgcatcgagctgtacctgcacctgtgccacaagatcctgatcctgctggtgatcctgctgtgtgtgatcctgatgttcatcatctgcaagttctggaaggagcgctggctggtggccggcctgtccatgcagatctttgccccctacgtgcacctggtgtccatcaccgtgatggtgatcctcttctggcctgtggccttctacgtggcctgcctggagcgggaggtgaggatgaggcgctacaggatgacccacagcgagaagaagaggctgaagcagtgcaacgtcatcacccggctgcggggcctgcaggtgcctgtgggcctgcccttcctgctgatcctgctgggcctgtacctgatgcccctgggcatctacagcccctgcatccaggagaaggagaacctgggccccaagcccaccatcttcggccacagaggagcccccatgctgggccctgagaacaccatgatgagctttgagaaggctgtggagcacggggcccacggcctggagacagacatccacctgtcctatgaccacgtgcccttcctgatgcatgactttgacctgaagaggaccaccaacattggagaggtgcagcctgagagcgcctgtgaaaatcctgccttcttcaactgggacttcctgagcaccctgaatgctgggaagtggtttgtgaagccagagctgcggcccttctacaacatgaagcccctgtctgaggccgacaaggagcgggccaggaaccagagcatccccaccctggccgacctgctgaccctggccgagaaggagaggaagtttgtgatctttgacctgcaccggcccccacccaagcaccccctgcggcacacctttgtgcggcaggtggtgtctgtcatcctggccagcaagattgagcagcacctgatcttctggctgcctgcccatgaccggcagtatgtgcgctctgtggcccctggcttccagcacgtgggccgcctggtgtccattgagaccctggccaagaacaacatcagcatcatcaacgtggactacaagaagctgttccccaacggcctgcgggactacaaggccgccaacatccacatcaacgtgtacacagtgaatgagccctggctgttcagcctggcctggtgcagccgcatcaacagcgtgaccacagacaacatcggcctgctgagccagctggaccacccccacttcttcatgacccccaagttctacgtgttcatgtggctgctggccgacatcatctctgtgctcttcatcgtggccatcttctgcttccactggaggcgggagacagagaaggagaagctgtttgagaccagcagcaccaggacagacacccagagcggcaacctgcacatcgccatgaagccccctgtgcgggtggtggagggcccctggaccctggccgccctgtacccagccctgcccaagagcggcaaggagcaccagggccacttcaactttgctgcccccagcaagaagctgctgcccatcaagaatgctgtgacccccctgaagccaggcaagcatgagatccagccccccatgcccaccgtggtgtttgagctgacccaggcccccacccggcaggccaccagcgaggccaccttccagaccaccctgcccaccctgaaggtggacaagcccaccatgcccagcattgaggtgccctacccctag

SEQ ID NO: 34591 - DNA, 1254 bp, Artificial Sequence
  Description of Artificial Sequence: Synthetic coding sequence
atgaccaccctggtgcctgccaccctgtccttcctgctgctgtggaccctgcccggccaggtgctgctgcgggtggccctggccaaggaggaggtgaagagcggcaccaagggcagccagcccatgagccccagcgacttcctggacaagctgatgggccgcaccagcggctatgatgcccgcatccggcccaacttcaagggcccccctgtgaatgtgacctgcaacatcttcatcaacagcttcagcagcatcaccaagaccaccatggactacagagtgaatgtgttcctgcggcagcagtggaatgacccccggctgagctaccgggagtacccagatgacagcctggacctggaccccagcatgctggacagcatctggaagccagacctcttctttgccaatgagaagggggccaacttccacgaggtgaccacagacaacaagctgctgcgcatcttcaagaatggaaatgtgctgtacagcatccggctgaccctcatcctgagctgcctgatggacctgaagaacttccccatggacatccagacctgcaccatgcagctggagagctttggctacaccatgaaggacctggtgtttgagtggctggaggatgccccagctgtgcaggtggccgagggcctgaccctgccccagttcatcctgagagatgagaaggacctgggctgctgcaccaagcactacaacacaggcaagttcacctgcatcgaggtgaagttccacctggagcggcagatgggctactacctgatccagatgtacatccccagcctgctgattgtcatcctgtcctgggtgtccttctggatcaacatggatgctgccccagcccgggtgggcctgggcatcaccaccgtgctgaccatgaccacccagagcagcggcagccgggccagcctgcccaaggtgtcctatgtgaaggccatcgacatctggatggctgtgtgcctgctgtttgtgtttgctgccctgctggagtatgctgccatcaactttgtgtcccggcagcacaaggagttcatccggctgcggcggcggcagaggcggcagaggctggaggaggacatcatccaggagagccgcttctacttccggggctacggcctgggccactgcctgcaggccagagatggcggccccatggagggcagcggcatctacagcccccagcccccagcccccctgctgcgggagggggagaccaccaggaagctgtatgtggactag

SEQ ID NO: 34592 - DNA, 1002 bp, Artificial Sequence
  Description of Artificial Sequence: Synthetic coding sequence
atgttcaagctgtgcagcaacaagatggtgtcccaggagggcagcgaggtggagctgctggtgtcccctggggcccggagtgaacatggccgctacctgcaggaccccatcgtgtccattgacctgtctgagtggctgcgcatcatcgagttcctgctgcagggcctgaaggtgtatggctctgtgtaccacatcaaccacggcaaccccttcaacatggaggtgctggtggacagctggccagagtaccagatggtgatcatccggccccagaagcaggagatgacagatgacatggacagctacaccaacgtgtacaggatgttcagcaaggagccccagaagtctgaggaggtgctgaagaactgtgaaattgtgaactggaagcagaggctgcagatccagggcctgcaggagagcctgggggagggcatccgggtggccaccttcagcaagtctgtgaaggtggagcacagccgggccctgctgctggtgacagaggacatcctgaagctgaatgccagcagcaagagcaagctgggctcctgggccgagaccggccacccagatgatgaatttgaaagtgagacccccaacttcaagtatgcccagctggatgtgtcctacagcggcctggtgaatgacaactggaagaggggcaagaatgaaagaagcctgcactacatcaagcgctgcatcgaggacctgcctgctgcctgcatgctgggccctgagggcgtgcctgtgtcctgggtgaccatggaccccagctgtgaggtgggcatggcctacagcatggagaagtacagaagaacaggcaacatggcccgggtgatggtgcgctacatgaagtacctgcggcagaagaacatccccttctacatctctgtgctggaggagaatgaagacagcagaagatttgtgggccagtttggcttctttgaggccagctgtgagtggcaccagtggacctgctacccccagaacctggtgcccttctag

SEQ ID NO: 34593 - DNA, 909 bp, Artificial Sequence
  Description of Artificial Sequence: Synthetic coding sequence
atgatcctgctgaacaacagccacaagctgctggccctgtacaagagcctggcccggagcatccctgagagcctgaaggtgtatggctctgtgtaccacatcaaccacggcaaccccttcaacatggaggtgctggtggacagctggccagagtaccagatggtgatcatccggccccagaagcaggagatgacagatgacatggacagctacaccaacgtgtacaggatgttcagcaaggagccccagaagtctgaggaggtgctgaagaactgtgagatcgtgaactggaagcagaggctgcagatccagggcctgcaggagagcctgggggagggcatccgggtggccaccttcagcaagtctgtgaaggtggagcacagccgggccctgctgctggtgacagaggacatcctgaagctgaatgccagcagcaagagcaagctgggctcctgggccgagaccggccacccagatgatgaatttgagagcgagacccccaacttcaagtatgcccagctggatgtgtcctacagcggcctggtgaatgacaactggaagaggggcaagaatgaaagaagcctgcactacatcaagcgctgcatcgaggacctgcctgctgcctgcatgctgggccctgagggcgtgcctgtgtcctgggtgaccatggaccccagctgtgaggtgggcatggcctacagcatggagaagtacagaagaactggaaacatggcccgggtgatggtgcgctacatgaagtacctgcggcagaagaacatccccttctacatctctgtgctggaggagaatgaagacagccgccgctttgtgggccagtttggcttctttgaggccagctgtgagtggcaccagtggacctgctacccccagaacctggtgcccttctag
